United States Patent 11,602,557 (BUNYAVIRALES VACCINE) - sequence listing, part 10

SEQ ID NO: 11910 - RNA, 5088 nt, Artificial Sequence
  derived and/or modified CDS sequence (opt1) from CCHFV(AP92)__DQ211625.1__GP
augcccgaccacuucauccugcuccugcugauguacaccguguuccaccagcacccgcaggacgucagcgccaacgugcaccucgugaaccccuccaacagcaccacgggcgccuccaccgcguucaaccccguccacaacgccaccaccgacgggcagaagcagagcacguccaccaccaccauggcccgccccagcacggugacccagaucaccaccgcccaggccauggagguggacggcuccggggagagcacgacccugccggcggucacccccacccccgccgagacgaccacccacgccaaccagaaguccgccagcaccaugggcacgcugaccaccucccucgaggacaccgcgcugaugacgcugaccgggcggagcauccucaccucccagagccagaccggcuccuucgaccgcacgagcaagccccagaccccgcgguccaccaaccagccccugcgcaagcugcucagcgccguguccaccgaggccgcgccccagacgagccccaccgccgugaccgccgaccagaccgaggccagcacguccccgcaggucaccaccgacaccagccccuccacccccacgcaggucaccagcuccgccggcagcuccagcuccaacaccagcaaccacuccaagaccacgccccagcugaccagcuccgggagcgaggcccagcagacccagccgaccacgaugcccaacaccaccgcccuggugacccccacggcgcacaucucccccaccaaccggagcaagcgcaacuccgaggucgagaucauccucacccugccgcagggccugaagaaguacuacagcaagauccucaagcugcugcaccucacccuggaggaggacuccgaggggcugcucgaguggugcacgcggacccugaagcaggccugcgacgacggcuacuuccaggagcgcaucaaggaguucuuccugaccggggagggcuacuucaacgaggugcuccuguuccggagccccagccagcugggcaccacggggagcccccucgccuccccgcccaccgccgagcccuucaaguccuucuacgccaagggcuuccugaucauggacagcggguacuucuccgcgaagugcuaccccaaggccagcaacuccggccugcagcucaucaacaucacccagcacagcaucaagguggucaacacccccggcccgaaguacuccaaccugaagacggugaacugcaucaaccugaaggugagcaccgacaaggaccacuccgagcucgaggucaacgugcugcugccccagguggccgucaacaucagcaacugccacgugcucaucaagucccacgugugcgacuacagccuggacaccgacgggaugauccgccugccccaggucacccacgagggcacguucaucccggggaccuacaagaucgugaucgacaagaagaacaagcucaacgaccggugcaccaugaccacgaacugcgucaucaagggcaaggaggugcgcaaggggcaguccacccugcggcaguaccgcaccgagauccgggugggccagaugagcuccggcacccgccggcugcucagcgagggcggggacgggggcugcaucagccgcacgcagcugaucaagaccgagaccgccgagguccacggggacgacuacggcggccccggggagaagaucaccaucugcaacggcuccaccaucguggaccagcggcuggggagcgagcucggcugcuacacgaucaaccgcaucaaguccuucaagcugugcgagaacagcgcccaggggaagaacugcgagaucgacuccgcgcccgugcagugccggcagggcuacugccugaagaucagccaggagggccgcgggcacgugaagcugucccgcggcagcgagaucgugcucgacgugugcgacaccuccugcgagaucaugauccccaaggggaccggcgacauccuggucgacugcagcggcgggcagcagcacuuccugcaguccaaccucguggaccugggcugcccgaacaucccccugcucgggaagauggccaucuacaucugccggaugagcaaccaccccaagaccacgauggccuuccuguucugguucuccuucggcuacgugaucacgugcauccugugcaagacccucuucuacauccugaucaucaucgggacccugggcaagaagcucaagcaguaccgcgagcugaagccccagaccugcaccaucugcgagagcgucccggugaacgccaucgacgcggagaugcacgaccugaacugcuccuacaacaucugccccuacugcgccagccggcucaccuccgagggccugacccgccacgugaaccagugccccaagcggaaggagaaggucgaggagacggagcuguaccucaaccuggagcgcauccccuggaucgugcggaagcugcuccaggugagcgaguccaccggggucgcccugaagcgcagcagcuggaugaucgugcugcucauccugcugaucguguccaugagcccgguccaguccgcccccaucagccaggagcggaccguggcccucuaccagucccgcgaggacuacaugggcaucugccuggugaucauggggagcguccugcucgcggugucccugcuggugcggggccucaucgacagcaucuccagcaccuucuuccccgggcuguccgucugccgcacgugccacaucggcagcaucaacggcuucgagaucgagucccacaagugcuacugcgggcugcucugcugccccuacugccgggccugcagcaccgaccaggacgcccaccaguuccaccuguccgugugcaagaagcgcaaggccggcagcaacgugaugcuggccgucugcaagcggaugugcuucaaggcgaucaucgaggccuccaacaagguccucuucauccgcaacgugaucaacaccaccuucguggugugcauccuggugauggucgccugcaucgccagcuccgccgcgguggagauggagaaccugccggccgggacgugggagcgggaggaggagcucaccaacuucugccaccaggagugccaggugaccgagaccgagugccugugccccuacgagagcuucauccugcgcaagccccucuuccuggacagcaucgccaagggcgucaagaaccugcucaacuccacgagccuggagaccucccugagcaucgaggcccccuggggcgcgaucaacgcccaguccaccuacaagccgaccgccagcuccgccaacaucgcccucacguggagcuccguggagcaccgggggaacaagauccuggugagcggccgcuccgagagcaucaugaagcuggaggagcgcaccgggaucuccuggaaccucggcgucgaggacgcgagcgagucccggacccugaccaucagcgugauggaccugucccagauguacagccccguguucgaguaccucuccggggaccgccaggucgaggaguggcccaaggccacgugcaccggcaacugccccgagcggugcgggugcaccagcuccacgugccuguacaaggaguggccgcacagccgcaacuggcggugcaaccccaccuggugcuggggcgugggcaccgggugcacgugcugcggccuggacgugaaggagcuguucaccgaccacaugcucgucaaguggaagguggaguacaucaagaccgaggccaucgugugcgucgagcugaccagccaggagcgccagugcucccucaucgaggccgggacccgguucagccugggccccgugaccaucacccuguccgagccgcgcaacauccagcagaagcucccgcccgagcugaucacgcugcaccccaagaucgaggacggcuacuucgaccucaugcacguccagaaggugaugagcgccuccaccgugugcaagcugcagagcugcacccacgggguccccggcgaccugcagaucuaccacguggggaaccuccugaagggcgaccgggugaacgggcaccugauccacaaggucgagccccaccucaacaccuccuggaugagcugggacggcugcgaccuggacuacuucugcaacaugggcgacuggcccuccugcacguacaccggggugacccagcacaaccacgcggccuucgccaaccugcucaacaucgagaccgacuacacgaagaccuuccacuuccacagcaagcgcgugaccgcccacggcgacacgccccagcuggaccugaaggcccggccgcgcuacggggcgggcgagaucaccguccucguggagguggccgacauggagcugcacaccaagaaggucgaggugaccgggcugaaguucgccucccugaccugcagcggcugcuacgccugcuccagcggcaucuccugcaaggugcggauccacgucgacgagcccgacgagcucacggugcacgucaagagcuccgaccccgacaucguggcggccagcagcucccugauggcccgcaagaucgaguucgggguggacagcaccuucaaggccuucuccagcaugcccaaggacucccucugcuucuacaucguggagcgggacuacugcaacagcugcaagaacgaggagacccagcgcugcgucaacgccaagcuggagcagccgcaguccauccugaucgagcacaccggcacgaucaucgggaagcagaacgacacgugcggcagccggaccuccugcuggcucgacagcuucaaguccuucuucuacgggcugaaguccaugcugagcggcaucuucggcaacguguuccucgggaucuuccuguuccuggcgcccuucgcccugcuccuguucuucuucuucuucggcuggcgcauccuguucugcuucaagugcugccggcgcacccggggccucuucaaguaccgccacaucaaggacgacgaggaggugggguacaagaagaucaucgagcgccugaacaacaagaagggcaagcaccggcugcucgacggggagcgccuggccgaccggaagaucgccgagcuguucagcaccaagacccacaucggcuga

SEQ ID NO: 11911 - RNA, 5085 nt, Artificial Sequence
  derived and/or modified CDS sequence (opt1) from CCHFV(UCCR4413)__KY484038.1__GP
augcugcgcuacauccucuacgcccugcuggccagcgcgauccuccaccagcaccuguacaaggugggcgccgacacccagaagcccaccguccggacgaacaccacccacaagaucuccccgaccgccacggccaaccgcaccaccuacgagcaggccacccccagcacgacccccaaguccagcaccaagcccaccacgcacaucgcgaccgcccaccuggccgaguccgacgggagcggcgagaccacccuccugcugccgacgaccgccucccaguacaccaccgaggggcagacgagccucgagcccaccgcggaggagaccggcuccaacaccauccccagcgacacgaccuccaccagccccaucaccgagaacuccgagagcacggacacccagaugaacguguccgacagcuccagcuccccgcuggccacccagggggcccggagccccgcccgcaaccugcucagcgugcccuccgucgagcccggccagcagaccacgccgaagcagcccaccaccaagggcaccgugacgcccaccaccccgcagccgaccaccagcucccccacgcccgcccccaccagcgcgacccuguccaccaacagcuccagcaucuccacgccggugcagaccagcagcccccugcagcccauggcccccucccacgagacccagcacgcccucuacaccacguccaccgagagcacccugcggacccuguccgccgagcgcauccacccgacgaaccggagccgccggaacuccgaggucgagaucauccucacccugccccaggggcugaagaaguacuacagccgccuccugaagcugcuccaccugaccauggaggaggacaccgagggccugcaggaguggugcgugcgggugcucgggcagacgugcgacgacuccuacuuccacaagcgccuggccgaguucuucaucaccggcaccggguucuucaacgagguccuccucuuccggagccccagcacccccacgaccaucaagccgucccccaccggcagccccaccguggagccguuccgcuccuacuacgcgaagggcagccugacgaucgacuccggguacuucagcgccaagugcuacccccggaccuccaacagcggccugcagcucaucaaccugacccagcacuccguggagaucgccaacacccccgggcccaagcacagcucccugaagacgaucaacugcaucaacaucaaggccagcaccgacaaggagcacaacgaggucgagaucaacgugcuccugccccagguggccaucaaccuguccaacugccacgucagcauccgcucccacgugugcgacuacagccucgacaccgacggcaagauccggcugccccagaucucccacgagggcaccuucauccccgggacguacaagaucaucaucgacaagaagaacaagcugaacgaccgcugcagccucaucaccagcugcgugaucaagggccgggagcugcgcaaggggcaguccacccugcggcaguacaagaccgagaucaagaucggccagacgagcuccgggagccgccgccuccuguccgagagcuccgcgagcggcugcaucucccggacccagaugaucaagagcgagaccgccgagauccacgacgacaucuacggcgggcccggcgagaagcugaccaucugcaacgggaccacggucguggaccagcgccucggcuccgagcuggggugcuacaccaucaaccggaucaagaccuacaagcugugcgagaacagcgugaaggagaagaccugcgagaucgacuccgucccggugaagugccgccagggccugugccucaagaucacgcaggagggccgggggcacgugaagcugagccgcggcuccgagaucguccuggacaucugcgacagcuccugcgagcucaugauccccaaggggaccggcgacauccugguggacugcagcgggggccagcagcacuuccugcaggacaaccucgucgaccugggcugccccaacaucccccugcucgggaagguggccaucuacaucugccggauguccaaccacccgaagaccaccauggccuuccuguucugguucagcuucggcuacgugaucacgugcauccugugcaagauccucuucuaccugcugaucaucaccgggacccucggcaagaagcugaagcaguaccgcgagcugaagccccagaccugcacgaucugcgagagcacccccgucaacgccaucgacgcggagaugcacgaccucaacugcuccuacaacaucugccccuacugcgccagccggcugaccuccgacggccugauccgccacgugaaccucugcccgaagcggaaggagaagguggaggagaccgagcuguaccugaaccucgagcgcauccccugguucguccggaagcugcuccaggugagcgaguccacggggguggcccugaagcgcagcuccuggcugcugauccucgucauccugcugaccgugagcaugucccccgugcagagcgcccccaucaaccagcagcgggcggucgaggccuaccaggcccgcgagggcuacaccgggaucugccucuucauccugggcuccgugcuguucaugaccagcuggcucacgaaggggcugaucgacuccaucggcgacagcuucuucccgggccuguucgugugcaagaccugcuccaucgggagcaucaacggcuucgagaucgagucccaccggugcuacugcagccuccugugcugccccuacugccggaccugcuccgccgacaaggacagccaccagcugcaccucagcaucugcaagaagaagaaggccggguccaacgucaugcuggcggugugcaagcggaugugcuucaaggccaccaucgaggccagcaaccgcgugcugcucauccgcuccaucaucaacacgaccuucaucaucugcaugcugauccuggucgugugcgugaucagcaccuccgccgucgagauggaggaccuccccgccggcaccugggagcgggaggaggaccugacgaacuucugccaccaggagugccaggugaccgagaccgagugccugugccccuacgaggcguucgugcuccgcaagccgcuguuccugagcuccaucgucaaggggaagaagaaccuccugaacagcgccucccuggagaccagccucuccaucgaggcccccuggggcgccaucaacgcccagagcacguucaagcccaccaucuccaccgcgaacaucgcccugagcugguccagcguggagcaccggggcaacaaggugcuggucuccgggcgcagcgaguccaucaugaagcucgaggagcggaccggcaucagcuggaaccuggggguggaggacgccagcgagucccgcaugcugacggugagcgucauggaccucucccagauguaccugccgguguucgaguaccugagcggcgaccgccagguggaggaguggcccaaggcgaccugcaccggggacugccccgagcgcugcggcugcaccuccagcacgugccuccacaaggaguggccccacucccggaacuggcgcugcaacccgaccuggugcuggggcgucgggaccggcugcacgugcugcgggcuggacgugaaggaccuguucaccgacuacauguucgugaaguggaaggucgaguacaucaagaccgaggccaucgugugcguggagcucaccagccaggagcggcagugcucccugaucgaggccggcacccgcuucaaccuggggcccgucaccaucacgcucagcgagccccggaacauccagcagaagcugcccuccgagaucgugacccugcacccgaagaucgaggagggcuucuucgaccucaugcacgugcagaagguccugagcgccuccaccgugugcaagcugcagagcugcacccacggcguggccggggaccuccaggucuaccacgugggcaaccugcugaagggggacaagaucaacggccacuccauccacaagaucgagccccaccucaacacgagcuggauguccugggacggcugcgaccuggacuacuacugcaacaugggggacuggcccagcugcaccuacaccggcgugacccagcacaaccacgccgcguucgucaaccugcucaacaucgagacggacuacaccaaguccuuccacuuccacagcaagcgcgugaccgcccacggggacacgccccagcuggaccugaaggcccggccgauguacggcgccggggagaucaccgugcucgucgagguggccgacauggagcugcacagcaagaacaucgagaucuccggccugaaguucgcgagccugaccugcuccggcugcuacgccugcagcuccgggaucagcugcaagguccgcauccacguggacgagcccgacgagcuggccgugcacgucaaguccgacgaccuggacgugguggccgccagcuccagccucauggcgcggaagaucgaguucggcaccgacuccaccuucaaggccuucagcuccaugcccaaggagagccugugcuucuacaucgucgagcgcgacuucugcaaguccugcgccgccgaggacacgcagaagugcgugaaggcgaagcuggagcagccccagagcauccugaucgagcacaaggggaccaucaucggcaagcagaacgacacgugcuccaccaagaccagcugcuggcucgaguccuucaagagcuucuucuacgggcugaagaacaugcugagcggcguguucggcuccgccaucauggggauccuccuguuccuggccccguucauccuccugauccuguucuucuucuucggcuggcggauccucuucugccugcgcugcugccggcgcacccgcgggcuguucaaguacaagcacaucaaggacgacgaggaggccggcuacaagaagaucaucgagaagcucaacaacaagaagggcgggaccagcaagcugcuggacggcgagcggcucgccgaccgcaagaucgcggagcuguucuccaccaaggcccacaucggguga

SEQ ID NO: 11912 - RNA, 5076 nt, Artificial Sequence
  derived and/or modified CDS sequence (opt1) from CCHFV(SCT ex Afghanistan)__KC344856.1__GP
augcaccacgccuaccagaucauguacacccugcucgugugcgccauccugugcccccagccguggagccuggagggcacccacgucccccucaacgggacgaagcacaacggcaccgggaucaccgcggcccccggcgggucccagggccccaccagcccggccuccacggccgugagccugacccccgaccccuucaccaccgagcccacggccuccgcgguggagcuggagagcuccggcgaggggcacaccagccucuccgucaccacccagggccugacgagcccggagaccacccccgggcugcccaccgugacggacaccggcguguccagcaccuccaucuucgggaucggcauccgcgucgccggcgacacccccacgagcaccacccacaccgggcucccguccagccccuccaugcccagcacggcccagggcccccaccacgccgugcgggggcugcuguccgugagcagcacccgcccgggcgaggcguccaccaucaccguccccggcgaggccgggacggaggccaacagcuccagcuccgccaucagcaagaagcccgcccccuccccgaccgcggaggccaucaccgaggccaacaacagcuccaacccccggcagcccgagcucagcacccagcccgccaucccgggccuggugacguccagcgcccagcccauccugcuccaguccgcgaccagcaccgccgcccaggacaucuaccccucccccaccaaccgcagcaagcggaaccuggagauggagaucauccugacgcucucccaggggcugaagaaguacuacggcaagauccugcgcauccucgaccugacccuggaggaggacaccgaggggcuccuggaguggugcaagcggaaccugggccugaccugcaacgacaacuucuuccaggagcgcaucgaggaguucuuccugaccggcgaggggcacuucaacgaggugcugcaguucaagacgccgagcacccucucccccaccgagcccacccacacgcggaccccgaccgucaagcccuucaagagcuacuucgcccgcggcuuccugagcaucgacuccggguacuucagcgccaagugcuacuccaagaccagcaacuccggccugcagcucaucaacaucacgcagcaccccgcgcggaucgccgacacccccgggccgaagaucaccaaccugaaggccaucaacugcaucaaccugaaggccagcguguucaaggagcaccgcgagaucgagaucaacgugcuccugccccaggucgccgugaaccuguccaacugccacgugcucaucaagagccacgucugcgacuacucccuggacaucgacggcgcggugcggcugccccacgugcaccacaagggcaccuucauccccgggacguacaagaucgucaucgacaagcgcaacaagcagaacgaccggugcacccucgugaccaacugcgugaucaagggcaaggagauccgcaaggggcagagcgcccugcggcaguaccgcaccgagauccggaucggcaaggccuccgccgggagccgccggcugcucuccgaggagagcggcgacgacugcaucucccgcacgcagcugcugcgcaccgagaccgcggagguccacaacgacaacuacggcgggccgggcgacaagaucaccaucugcaacgggagcacgaucguggaccagcggcucggcuccgagcugggcugcuacaccaucaaccgcgucaagagcuucaagcugugcgagaacagcgccaccgggaaguccugcaagaucgacagcacccccgugaagugccggcagggcuucugccugaagaucacgcaggaggggcgcggccacgugaagcucucccgggggagcgaggucgugcuggacgccugcgacuccagcugcgagaucaugauccccaagggcaccggcgacauccugguggacugcuccgggggccagcagcacuuccucaaggacaaccugaucgaccuggggugccccaacaucccgcuccugggcaagauggccaucuacaucugccgcaugagcaaccaccccaagaccaccauggccuuccuguucugguucuccuucggguacgucaucacgugcaucuucugcaaggugaucuucuaccuccugaucguggucggcacccugggcaagaaguucaagcaguaccgggagcucaagccccagaccugcaccaucugcgagacgacccccaccaacgcgaucgacgccgagaugcacgaccugaacugcagcuacaacaucugcccguacugcgccucccgccugaccagcgacgggcucgcccggcacgugacgcagugccccaagcgcaaggagaagguggaggagaccgagcuguaccugaaccucgagcggauccccuggaucguccgcaagcugcuccagguguccgagagcaccggcguggcccucaagcgguccagcuggcugaucguccugcucgugcugcugaccgugucccucagccccguccaguccgcgccgaucgggcacggcaagaccaucgagacguaccagacccgcgagggguacaucagcgugugccuguucgugcugggcggcauccucuucgucgugagcugccugaucaaggggcugguggacuccgucggcaacagcuucuuccccgggcucuccaucugcaagaccugcagcaucggcuccgugaacggguucgagaucgagagccacaagugcuacugcucccugcugugcugccccuacugccggcacugcagcaccgaccgcgagauccaccagcuccaccuguccaucugcaagaagcggcgcacgggcggcaacgugaugcuggccgucugcaagcggaugugcuuccgcgccaccauggaggugagcaacaagguccucuucauccgcaacaucaucaacaccaccuucgugaucugcauccugauccuggccgugugcguggucuccacgagcgccguggagauggagucccuccccgcggggaccugggagcgggaggaggaccugaccaacuucugccaccaggagugccaggugaccgagacggagugccugugcccguacgaggcccucguccugcgcaagccccuguuccucaacagcaucgugaagggcaugaagaaccugcugaacuccaccaaccucgagaccagccuguccaucgaggcccccuggggcgccaucaacgugcagagcaccuucaagccgacggucuccaccgcgaacaucgcccugagcuggagcuccguggagcaccgggggaacaagauccucgugagcggccgcuccgagagcaucaugaagcuggaggagcggaccgggaucuccugggaccugggcgucgaggacgccagcgaguccaagagccucaccguguccgugauggaccugagccagauguacucccccgucuucgaguaccugagcggggaccgccagguggaggaguggcccaaggccacgugcaccggcgacugccccgagcggugcgggugcaccuccagcacgugccuccacaaggaguggccgcacucccgcaacuggcggugcaaccccaccuggugcuggggcgugggcaccgggugcacgugcugcggccuggacgucaaggaccuguucaccgacuacauguucgugaaguggaagguggaguacaucaagaccgaggccaucgucugcguggagcucaccagccaggagcgccagugcucccugaucgaggcggggacccgguucaaccugggccccgucaccaucacgcucagcgagccccgcaacauccagcagaagcugccgcccgagaucaucacccugcacccccggaucgaggagggguucuucgaccucaugcacgugcagaaggugcuguccgccagcaccgucugcaagcugcagagcugcacccacggcgugcccggcgaccuccagguguaccacaucgggaaccugcugaagggcgacaagcucaacgggcacaugauccacaagaucgagccgcacuucaacacguccuggaugagcugggacggcugcgaccuggacuacuacugcaacaugggggacuggcccuccugcaccuacaccggcgucacccagcacaaccacgccgccuucgugaaccugcucaacaucgagaccgacuacacgaagaacuuccacuuccacagcaagcgcgugaccgcccacggcgacacgccccagcuggaccugaaggcgcggcccaccuacggggccggcgagaucaccguccucguggagguggccgacauggagcugcacaccaagaagaucgacaucuccgggcugaaguucgccagccugaccugcgccggcugcuacgcgugcuccagcggcaucuccugcaagguccgcauccacguggacgagccggacgagcucaccgugcacgucaagagcgaggaccccgacaucguggccgccuccacgagccugaucgcccggaagcucgagcuggggaccgacuccaccuucaaggcguucagcgccaugcccaagaccucccugugcuucuacaucguggagcgcgaguacugcaagagcugcuccaaggaggacacgcagaagugcgucaacaccaagcucgagcacccccagggcauccugaucgagcacaaggggaccaucaucggcaagcagaacgacacgugcaccgccaaggccgggugcuggcuggagagcgugaaguccuucuucuacggccucaagaacaugcugagcggcaucuucgggaacguguucaucggcaucuuccuguuccuggccccguucguccuccugauccuguucuucauguucggguggcggcuccuguucugcuucaagugcugccgccggacccgcggccuguucaaguaccgccaccucaaggaggacgaggagagcggguaccggcgcaucaucgagcggcugaacaacaagaagggcaagaacaagcugcucgacggcgagcgccuggcggaccggcgcaucgccgagcuguucuccaccaagacccacaucggguga

SEQ ID NO: 11913 - RNA, 5070 nt, Artificial Sequence
  derived and/or modified CDS sequence (opt1) from CCHFV(SPU 431/85)__KJ682812.1__GP
augcccgugaacaucauguacacgccccuggucugcgccgugaucugccuccagcuguggaaccugggcgggacccucgugagcaccaaccgcacccagcacaacgagaccgggaccgucgccacccccgaggggacccugcggccccgccugcccguguccaccgcccuccccaccaagagcgaccggcccuccguggggcccgccgccagcuccagcgggcuggagggcuccggcgagcccaacaccagccccuccaucaccaccaaggggcugaccccgcccgagaccacccccgcccucccgaccgccaccgacaccgacgccagcuccaccggcgucguggacgugagcacccagaugaccaaggacauccccauguccaccgccuacaccaacccgcccagcaccccguccgcccccagcacgccccaggggacgcaccacaccgcccgcggccugcuguccgucgcgagcaccaaguccgaggaggugagcaugagcaccucccccgccaagacgagcaccgagaccuccagcccgccgcccgccaccuccgagacgcccaccccgagccccaccacccaggugcccacggggaacaacaaccccaacaccucccggcagccgacccccagcgcccagcccgccauguccaacccggcgaccagccccgcccagcccaaccucucccagagcgcgccgcccaccgccgaccagggcguccaccccucccccacgaaccgcagcaagcggaaccuggagaucgagaucauccugacccucucccagggccugcgcaaguacuacgggaagauccugaagcuccuggaccugacccucgaggaggacaccgagggccugcuggaguggugcaagcggaaccucgggcugacgugcgacgacaacuucuuccagaagcgcaucgaggaguucuuccugaccggcgagggcuacuucaacgaggugcuccaguucaaggugcccagcacccuguccagcaccgagcccacgcacacccggccgcccaccgucgagcccuucaaguccuacuucgccaagggguuccugagcaugaacagcggcuacuucuccgcgaagugcuacccgcgcaccagcaacuccgggcuccagcugaucaacgugacgaagcacagcgccaagaucgccgacacccccggccccaagaucaccaaccugaagaccaucaacugcaucaaccuccgggccuccguguucaaggagcaccgcgaggucgagaucaacgugcugcugccccagguggccgucaaccucagcaacugccacgcgcagaucaagucccacgugugcgacuacagccuggccacggacgggauggugcggcugccgcacauccaccacgagggcaccuucauccccggcaccuacaagaucgucaucgacaagaagaacaagcagaacgaccgcugcacccucgugacgaacugcgucaucaaggggcgggaggugcgcaagggccaguccgcccugcggcaguacaagaccgagauccgcaucgggaaggccagcuccggcagccggcgccugcucuccgaggagagcgacggggacugcaucucccgcacccagcugcugcggaccgagacgaccgagauccacagcgacaacuacggcggccccggggacaagaucaccaucugcaacggcuccaccaucguggaccagcgccucgggagcgagcugggcugcuacacgaucaaccgggucaagagcuucaagcugugcgagaacuccgccaccggcaaguccugcgagaucgacuccacccccgugaagugccgccagggcuucugccucaagaucacccaggagggccgggggcacgugaagcugagccgcggcuccgagaucguccuggacgcgugcgacagcaacugcgagaucaugaucccgaaggggacgggcgacauccugguggacugcuccggcgggcagcagcacuuccucaaggacaaccugaucgaccugggcugccccaacaucccccuccuggggaagauggccaucuacaucugccggaugagcaaccaccccaagaccaccauggccuuccuguucugguucuccuucggcuacgugaucacgugcauccucugcaaggucaucuucuaccugcugaucguggccgggacggugggcaagaaguucaagcaguaccgcgagcuccggccgcagaccugcaccaucugcgagaccauccccgucaacgcgaucgacgccgagaugcacgaccugaacugcagcuacaacaucugccccuacugcgccucccgccugaccagcgacggccucgcccggcacgugaugcagugcccgaagcgcaaggagaagguggaggagacggagcuguaccugaaccucgagcggauccccugggucgugcgcaagcugcuccagguguccgagagcaccggggucgcccucaagcgguccagcuggcugaccgugcugcucgugcugcugaucgucucccucagccccgugcaguccgcgcccaucggccacgggaagaccaucgagacguaccaggcccgcgagggcuacaccagcuucugccuguucauccuggggagcauccucuucguggucuccugccuggugaagggccugaucgacagcgugggcaacuccuucuucccggggcucagcaucugcaagaccugcuccaucggcagcaucaacggguucgagaucgagucccacaagugcuacugcagccuguucugcugccccuacugccggcacugccccgccgaccgcgagauccacaagcugcaccucuccaucugcaagaagcggaagaccggcagcaacgucaugcuggccgugugcaagcgcaugugcuuccgcgccacgaucgagguguccaaccgggcgcugcucauccgcaacaucaucaacaccaccuucgucgugugcauccugacccuggccgugugcgucgugagcacguccgccguggagauggagagccuccccgccgggaccugggagaaggaggaggaccugaccaacuucugccaccaggagugccaggucaccgagacggagugccugugcccguacgaggcccucgugcugcggaagccccuguuccucgacuccaucgugaagggccgcaagaaccugcugaacagcaccucccucgagaccagccuguccaucgaggcgcccuggggcgccaucaacguccagagcaccuucaagcccacggugagcgccgccaacaucgcgcuguccuggagcuccguggagcaccgggggaacaagauccucgucagcggccgcuccgagagcaucaugaagcuggaggagcggaccgggaucuccugggaccugggcguggaggacgccagcgaguccaagcuccugaccgugagcgucauggaccugucccagauguacagcccgguguucgaguaccucuccggggaccgccagguggaggaguggcccaaggcgaccugcacgggcgacugccccgagcggugcggcugcaccagcagcacgugccugcacaaggaguggccccacagccgcaacuggcggugcaacccgaccuggugcuggggcgucggcaccgggugcacgugcugcggccuggacgugaaggaccucuucaccgacuacauguucgugaaguggaaggucgaguacaucaagaccgaggccaucgugugcgucgagcugacgucccaggagcgccagugcagccugaucgaggccggcacccgguucaaccucgggcccgugaccaucacccuguccgagccccgcaacauccagcagaagcugcccccggagaucaucacgcuccacccccggaucgaggagggcuucuucgaccugaugcacgugcagcgcguccugagcgcgagcaccgugugcaagcuccaguccugcacccacggggugcccggcgaccugcaggucuaccacaucgggaaccugcucaagggcgacaaggugaacggccaccugauccacaagaucgagccccacuucaacaccagcuggauguccugggacgggugcgaccuggacuacuacugcaacaugggcgacuggccgagcugcaccuacacgggggugacccagcacaaccacgccgccuucgucaaccuccugaacaucgagaccgacuacaccaagaacuuccacuuccacuccaagcgggugacggcccacggcgacacgccccagcuggaccucaaggcccgccccaccuacggggcgggcgaggugaccguccugguggagguggccgacauggagcugcacacgaagaagaucgagaucagcggccucaaguucgccucccugaccugcaccgggugcuacgccugcagcuccggcaucagcugcaaggucaagauccacguggacgagcccgacgagcugaccgugcacgucaaguccgaggacccggacaucguggccgcggggagcucccucauggcccggaagcuggaguucggcgccgacagcacguucaaggccuucuccgcgaugcccaagaccagccugugcuucuacaucguggagcgcgaguacugcaaguccugcagccgggaggacacccgcaagugcgucaacaccaagcucgaccgcccccaguccauccugaucgagcacaaggggacgaucaucggcaagcagaacaacacgugcaccgccaaggccagcugcuggcuggagagcgugaaguccuucuucuacggccucaagaacaugcugagcgggaucuucggcaacguguucaucgggaucuuccuguucaucgccccguucguccuccugauccuguucuucauguucggcuggcggauccuguucugcuucaagugcugccgccggacccgcggccucuucaaguaccggcaccugaaggacgacgaggagacgggguaccgcaagaucaucgagcggcugaacaacaagaagggcaagaacaagcuccuggacggggagcgccuggccgaccggaagaucgcggagcuguucuccaccaagagccacaucggcuga

SEQ ID NO: 11914 - RNA, 5070 nt, Artificial Sequence
  derived and/or modified CDS sequence (opt1) from CCHFV(SPU 556/87)__KJ682811.1__GP
augaccgugaacaccgucugcacgccccuggugugcgccguguucugccuccagcuguggaaccugggcgggacccucgucccgaccaaccgcacccagcacaacaagacgggcaccauggccacccccgaggggacccugggcccccggcugcccgugagcacggcgcucccgaccaaguccgaccgccccagcguggggcccgccgcccccuccagcggccuggagggcuccggggagccgaacaccagccccuccaucaccacgaagggccuggcccuccccgagaccacccccgccccgcccaccgcgacggacaccgacgccagcuccaccggggucgugaacgugagcacccagaugacgaaggacauccccauguccaccgccuacaccaacccgcccagcacccccuccgcccccagcacgccccagggcacccaccacaccgcgcgggggcugcuguccgucgccagcaccaaguccgaggaggugagcauguccacgagcccgggcaagaccagcaccgagaccuccagcccgccgcccgccacguccgagacccccgcccccagccccaccacccaggcccccacgggcaacaacaaccccaacaccucccgccagcccacccccagcgcgcagccggccauguccaaccccaccaccagccccgcccagcccaaccuccugcagaacgccccgcccacggccgaccagggggugcaccccggccccaccaaccgguccaagcgcaaccuggagauggagaucauccucacccugagccaggggcugcggaaguacuacggcaagauccucaaguuccuggaccugacccucgaggaggacacggagggccugcuggaguggugcaagcgcaaccucgggcugaccugcgacgacaacuucuuccagaagcggaucgaggaguucuuccugaccggcgagggguacuucaacgagguccuccaguucaaggugccguccacccugagcuccacggagcccacccacaccggcagccccaccguggagcccuucaaguccuacuucgcgaagggguuccugagcaugaacuccggcuacuucagcgccaagugcuacccgcgcacguccaacagcggccuccagcugaucaacgucaccaagcacagcgccaagaucgccgacacccccgggcccaagaucaccaaccugaagacgaucaacugcaucaaccuccgggccuccguguucaaggagcaccgcgagguggagaucaacguccugcugccccagguggcggugaaccucagcaacugccacgcccagaucaagucccacgucugcgacuacagccuggccaccgacggcauggugcggcugccgcgcauccaccacgaggggaccuucauccccggcaccuacaagaucgugaucgacaagaagaacaagcagaacgaccggugcacgcucgucaccaacugcgugaucaaggggcgcgagguccggaagggccaguccgcccugcgccaguacaagaccgagauccggaucggcaaggccagcuccgggagccgccggcugcucuccgaggagagcgacggcgacugcaucucccgcacccagcugcugcgcacggagaccgcggagauccacagcgacaacuacgggggccccggggacaagaucaccaucugcaacggcuccaccaucguggaccagcggcucggcagcgagcuggggugcuacacgaucaaccgcgugaaguccuucaagcugugcgagaacagcgccaccggcaaguccugcgagaucgacagcacccccgucaagugccggcagggguucugccucaagaucacccaggagggccgcggccacgugaagcugagccggggguccgagaucgugcuggacgccugcgacagcuccugcgagaucaugaucccgaagggcacgggggacauccuggucgacugcagcggcgggcagcagcacuuccucaaggacaaccugaucgaccugggcugccccaacaucccccuccugggccgcauggccaucuacaucugccggauguccaaccaccccaagaccaccauggcguuccuguucugguucagcuucggguacgugaucacgugcauccucugcaaggugaucuucuaccugcugaucgucgccggcaccguggggaagaaguucaagcaguaccgcgagcuccggccgcagaccugcaccaucugcgagaccacccccgugaacgccaucgacgccgagaugcacgaccugaacugcuccuacaacaucugccccuacugcgccagccgccugacguccgacggccucgcgcggcacgucaugcagugcccgaagcgcaaggagaagaucgaggagaccgagcuguaccugaaccucgagcggauccccuggguggugcgcaagcugcugcaggucagcgaguccaccgggguggcccucaagcggagcuccuggcugaccgugcugcucguccugcugaucgugagccucucccccgugcagagcgcccccaucggccacggcaagacgaucgagaccuaccaggcccgcgagggguacaccuccuucugccuguucauccugggcagcauccucuucaucgucuccugccuggugaaggggcugaucgacagcgugggcaacagcuucuucccggggcucuccaucugcaagaccugcagcaucggcuccgucaacggcuucgagaucgagagccacaagugcuacugcucccuguucugcugccccuacugccggcacugcagcgccgaccgcgagauccacaagcugcaccucuccaucugcaagaagcggaagacggggagcaacgugauguccgcggugugcaagcgcaugugcuuccgcgccaccaucgaggucagcaaccgggcccugcugauccgcuccaucaucaacaccaccuucgccgugugcauccucacgcuggccgugugcgucgugagcaccuccgcgguggagauggagagccugcccgccggcaccugggagcgggaggaggaccucaccaacuucugccaccaggagugccaggucacggagaccgagugccugugccccuacgaggcccuggugcuccgcaagccgcuguuccuggacuccaucgugaaggggaagaagaaccuccugaacagcaccucccuggagaccagccucuccaucgaggcccccuggggcgcgaucaacguccagagcacguucaagcccaccgugagcgccgccaacaucgcccuguccuggagcuccguggagcaccgggggaacaagauccuggucagcggccgcuccgagagcaucaugaagcucgaggagcggaccggcaucuccugggaccuggggguggaggacgccagcgaguccaagcugcucaccgugagcgucauggaccugucccagauguacagccccguguucgaguaccuguccggcgaccgccagguggaggaguggccgaaggcgacgugcaccggggacugccccgagcggugcggcugcaccagcuccacgugccuccacaaggaguggccccacagccgcaacuggcggugcaaccccaccuggugcuggggcgucgggaccggcugcacgugcugcgggcuggacgugaaggaccuguucaccgacuacauguucgugaaguggaaggucgaguacaucaagaccgaggccaucgugugcguggagcucaccucccaggagcgccagugcagccugaucgaggccggcacccgguucaaccuggggccggucaccaucacgcucuccgagccccgcaacauccagcagaagcugccgcccgagaucaucacccugcacccccggaucgaggagggcuucuucgaccucaugcacgugcagaagguccugagcgccagcaccgugugcaagcugcaguccugcacccacggcgugcccggggaccuccaggucuaccacaucggcaaccugcugaagggggacaaggugaacggccaccucauccacaagaucgagccccacuucaacaccagcuggauguccugggacgggugcgaccuggacuacuacugcaacaugggcgacuggcccagcugcacguacaccggcgugacccagcacaaccacgccgcguucgucaaccugcucaacaucgagaccgacuacacgaagaacuuccacuuccacuccaagcgcgugaccgcccacggggacaccccgcagcuggaccugaaggcccggcccaccuacggcgccggggaggugacgguccucguggagguggccgacauggagcugcacaccaagaagaucgagaucagcggccugaaguucgcgucccucagcugcaccgggugcuacgccugcuccagcggcaucuccugcaagguccgcauccacguggacgagcccgacgagcugaccgugcacgucaagagcgaggaccccgacaucguggccgccggcuccagccugauggcgcggaagcucgaguucggggccgacuccacguucaaggccuucagcgccaugccgaagaccucccugugcuucuacaucguggagcgcgaguacugcaagagcugcucccgggaggacacccagaagugcgucaacaccaagcuggagcgcccccagagcauccucaucgagcacaagggcacgaucaucgggaagcagaacgacacgugcaccgccaaggcgagcugcuggcuggaguccgucaagagcuucuucuacggccugaaguccaugcucagcggcaucuucgggaacguguucaucggcaucuuccuguucaucgcccccuucgugcugcucauccuguucuucauguucggguggcgcauccuguucugcuucaagugcugccggcgcacccggggccuguucaaguaccgccaccucaaggacgacgaggagaccggguaccggaagaucaucgagcgccugaacaacaagaagggcaagaacaagcugcucgacggcgagcggcuggccgaccgcaagaucgccgagcuguucuccaccaagagccacaucggguga

SEQ ID NO: 11915 - RNA, 5070 nt, Artificial Sequence
  derived and/or modified CDS sequence (opt1) from CCHFV(SPU 18/88)__KJ682810.1__GP
augcccuucaacaucauguacaccccgcugcucugcgccauccugugccugcagcucuggagccuggagggcaucuacgggcuguccaacaagacccagcacaacgacacgagcaccaucaaggugcccgaggagucccagaagaccagccuccccgccaacaccgcgucccccaucacgagcgacccguccagcgccaccuccaccgcccuggccagcggccccgagggguccggcgacaccagcacgucccccagcgucaccacccaggggcccacccugcucgagacgaccccggagccccacaccaccaucgacaucgacgaguccagcacggccaucgcggacaucuccacccagaccgugaaggacauccccacccccacgacccacaccagccugccguccacccccagcgcccccacgaucccccaggaggcccaccacaccgcccgcggccugcucagcgugaccuccaccaagccgggcgagacgagcacccccaccucccccggggaggcgagcaccgaggccuccagcccccagccgacgaucuccgagacccccagcccgccgcccaccacccaggcccccacggagaucaacaaccccaacaccucccggcagcccaugcccagcacccagcccgccgcccccaacuccgucaccccgcccgugcagcccaccuucagccaguccgacgugagcacggucgcgcaggacauccaccccuccccgaccaaccgcagcaagcggaaccuggagauggagaucauccugacccucucccagggccugaagaaguacuacgggaaggugcugaagcuccuggaccugacccucgaggaggacacggagggccugcuggaguggugcaagcgcaaccucgggcugaccugcgacgacaacuucuuccagaagcggaucgaggaguucuuccugaccggcgagggccacuucaacgaggugcuccaguucaagacccccagcacgcugucccccaccgagcccgcccgcgucgagagcccgaccguggagcccuucaagagcuacuucgccaagggguuccuguccauggacagcggcuacuucuccgccaagugcuaccccaagagcuccaacagcgggcuccagcugaucaacgugacccagcacuccauccggaucacggacacccccggcccgaagaucaccagccugaagaccaucaacugcaucaaccucaaggcccuggucuucaaggagcaccgcgagaucgagaucaacgugcugcucccccagguggcggucaaccuguccaacugccacgugcugaucaagagccacgccugcgacuacucccucgacaucgacggccccgugcggcugccccgcauccaccacgaggggacguucaucccgggcaccuacaagaucgucaucgacaagaagaacaagcagaacgaccggugcacccuggugaccaacugcgugaucaaggggcgcgagauccggaagggccagagcguccuccgccaguaccggacggagaucaagaucgggaaggccuccagcggcucccgccggcugcugagcgaggaguccaacgacgacugccucagccgcacccagcugcugcggaccgagaacgccgagauccacagcgacaacuacggcgggcccggcgacaagaucaccaucugcaacggguccacgaucguggaccagcgccucggcagcgagcuggggugcuacaccaucaaccgggugaaguccuucaagcugugcgagaacagcgccaccggcaaguccugcgagaucgacagcacccccguccgcugccgccagggcuucugccugaagaucacgcaggaggggcggggccacgugaagcucucccgcgggagcgaggucgugcuggacgcgugcgacuccagcugcgagaucaugauccccaagggcaccggggacauccugguggacugcuccggcggccagcagcacuuccucaaggacaaccuggucgaccuggggugcccgaacaucccccuccugggcaagauggccaucuacaucugccggaugagcaaccaccccaagaccaccaugggguuccuguucugguucuccuucggcuacgugaucacgugcauccucugcaaggugaucuucuaccugcugaucgucgugggcacccucgggaagaaguucaagcaguaccgcgagcugaagccccagaccugcaccaucugcgagacgaacccggugaacgccaucgacgccgagaugcacgaccugaacugcagcuacaacaucugccccuacugcgccucccggcucaccagcgacggccuggcgcgccacgucaugcagugccccaagcggaaggagaagaucgaggagaccgagcuguaccucaaccuggagcgcaucccguggguggugcggaagcugcuccaggucuccgagagcaccgggguggcccugaagcgcuccagcuggcuggugauccuccugguccugcucaccgugagccugucccccgugcagagcgcccccaucucccacggcgagacggucgagguguaccagacccgggagggguacaccagcaucugccuguucgugcucggcuccauccuguuccuggucagcugccucaugaagggccugguggacuccguggggaacagcuucucccccggccugagcaucugcaagaccugcuccaucgggagcaucaacggcuucgagaucgagucccacaagugcuacugcagccucuucugcugcccguacugccgccacugcuccgccgacaucgagauccacaagcugcaccugagcaucugcaagaagcggaagacgggguccaacgucaugcucgcggugugcaagcgcaugugcuuccgggccaccguggaggucagcaacaaggcccugcugauccgcaacaucaucaacaccaccuucguggugugcauccucauccuggccgucugcgugguguccacgagcgccgucgagauggagaaccugcccgcgggcaccugggagaaggaggaggaccucaccaacuucugccaccaggagugccaggugaccgagacggagugccugugccccuacgaggcccuggugcuccggaagccccuguuccuggacagcaucgucaagggcaagaagaaccuccugaacuccaccagccuggagaccucccucagcaucgaggccccguggggcgccaucaacgugcaguccaccuucaagcccacggugagcgccgcgaacaucgcccuguccuggagcuccgucgagcaccgcgggaacaagauccuggugagcgggcgguccgagagcaucaugaagcucgaggagcgcaccggcaucuccugggaccuggggguggaggacgccagcgaguccaagcugcucaccgucagcgugauggaccugucccagauguacagccccguguucgaguaccuguccggcgaccgccaggucgaggaguggcccaaggcgaccugcacgggcgacugcccggagcggugcgggugcaccagcagcacgugccuccacaaggaguggccccacucccgcaacuggcggugcaaccccaccuggugcuggggcguggggaccggcugcacgugcugcgggcuggacgugaaggaccuguucaccgacuacauguucgucaaguggaagguggacuacaucaagaccgaggccaucgugugcgucgagcucaccagccaggagcgccagugcucccugaucgaggccggcacccgguucaaccugggccccgugaccaucacccucagcgagccgcgcaacauccagcagaagcugccgcccgagaucgucacgcugcacccccggaucgaggagggguucuucgaccucaugcacauccagaaggugcuguccgccagcaccgugugcaagcugcaguccugcacccacggcguccccggggaccuccagaucuaccacaucggcaaccugcugaagggcgacaaggugaacgggcaccucauccacaagaucgagccccacuucaacaccagcuggauguccugggacggcugcgaccuggacuacuacugcaacaugggggacuggcccagcugcuccuacacgggcgugacccagcacaaccacgccgccuucgucaacaugcugaacaucgagaccgacuacaccaagaacuuccacuuccacagcaagcgcgugaccgcgcacggggacacgccccagcucgaccugaaggcccggccgaccuacggcgccggcgagaucaccgugcuggucgagguggccgacauggagcuccacaccaagaagaucgagaucuccgggcugaaguucgccagccugacgugcaccggcugcuacgcgugcuccagcgggaucuccugcaaggugcgcauccacgucgacgagcccgacgagcucaccgugcacgucaagagcgaggaccccgacaucguggccgccuccagcagccugauggcccggaagcuggaguucggcaccgacuccacguucaaggccuucagcgcgaugcccaagaccucccucugcuucuacaucguggagcgcgaguacugcaagagcugcuccaaggaggacacccagaagugcgugaacaccaagcuggagcagccgcagagcauccugaucgagcacaaggggacgaucaucggcaagcagaacgacacgugcaccggcaaggccgggugcuggcucgaguccaucaagagcuucuucuacggccugaagaacaugcuguccgggaucuucggcaacgucuucaucgggaucuuccuguuccucgcccccuucaucaugcugauccuguucuucauguucggcuggcggauccucuucugcuucaagugcugccgccggacccgcggccuguucaaguaccggcaccugaaggacgacgaggagaucggguaccgcaagaucaucgagcggcucaagaacaagaagggcaagaacaagcugcuggacggggagcgccucgccgaccggaagaucgccgagcuguucagcaccaagacccacaucggcuga

SEQ ID NO: 11916 - RNA, 5070 nt, Artificial Sequence
  derived and/or modified CDS sequence (opt1) from CCHFV(SPU 497/88)__KJ682808.1__GP
augcccuucaacaucauguacaccccgcugcucugcgccauccugugccugcagcucuggagccuggagggcaucuacgggcuguccaacaagacccagcacaacgacacgagcaccaucaaggugcccgaggagucccagaagaccagccuccccgccaacaucgcgucccccaccacgagcgacccgcccuccgccaccagcaccgccuccgccagcggccccgagggguccggcgacaccagcacgucccccagcgucaccacccaggggccgaccccccuggagaucacgcccgagccccacaccaccaucgacaucgacaaguccagcaccuccaucgccgacaucagcacgcgcaccgugaaggacaucccgacccccaccacgcacaccucccugcccagcacccccagcgcgccgaccaucccccaggaggugcaccacacggcccggggccuccuguccgucaccagcaccaagcccgaggaggccuccacccugacgagccccggcgaggccuccaccgaggcgagcuccccgcagcccaccaucagcgagacccccucccccccgcccacgacccaggcccccaccgagaucaacaaccccaacaccagccgccagccgaugcccuccacgcagcccgccgccccgaacagcgugaccccccccgugcagcccaccuucucccagagcgacgucuccaccgccgcgcaggacauccacccgagccccaccaaccgguccaagcgcaaccucgagauggagaucauccugacgcugagccaggggcucaagaaguacuacggcaaggugcugaagcugcucgaccugacccuggaggaggacaccgaggggcuccuggaguggugcaagcggaaccugggccucaccugcgacgacaacuucuuccagaagcgcaucgaggaguucuuccugacgggggagggccacuucaacgaggugcugcaguucaagacccccuccacccucagccccaccgagccggcccgggucgagagccccacgguggagcccuucaaguccuacuucgccaagggcuuccugagcauggacuccggguacuucagcgccaagugcuaccccaaguccagcaacuccggccugcagcucaucaacgugacccagcaccugauccgcaucaccgacaccccggggcccaagaucacgaaccugaagaccaucaacugcaucaaccucaaggcccuggucuucaaggagcaccgggagaucgagaucaacgugcugcucccccagguggcggucaaccugagcaacugccacgugcugaucaagucccacgugugcgacuacagccucgacaucgacggccccguccgccugccgcggauccaccacgagggcaccuucauccccgggaccuacaagaucgugaucgacaagaagacgaagcagaacgaccgcugcacccuggugaccaacugcgucaucaagggccgggagauccgcaaggggcaguccgugcuccggcaguaccgcaccgagaucaagaucggcaaggccagcuccgggagccggcgccugcuguccgaggagagcaacgacgacugccucucccggacgcagcugcugcgcaccgagaacgccgagauccacagcgacaacuacggcggccccggggacaagaucaccaucugcaacggcagcaccaucguggaccagcggcucggguccgagcugggcugcuacacgaucaaccgcgucaagagcuucaagcugugcgagaacuccgccaccgggaagagcugcgagaucgacuccacccccgugcgcugccggcagggcuucugccugaagaucacccaggagggcaaggggcacgucaagcucagccgcggcuccgagguggugcuggacgccugcgacagcuccugcgagaucaugaucccgaaggggacgggcgacauccuggucgacugcagcgggggccagcagcacuuccucaaggacaaccugguggaccugggcugccccaacaucccccuccuggggaagauggcgaucuacaucugccggauguccaaccaccccaagaccaccaugguguuccuguucugguucagcuucggcuacgucaucaccugcauccucugcaaggugaucuucuaccugcugaucguggucgggacgcucggcaagaaguucaagcaguaccgcgagcugaagccgcagaccugcaccaucugcgagaccaaccccgugaacgccaucgacgccgagaugcacgaccugaacugcuccuacaacaucugccccuacugcgccagccggcucacguccgacggccuggcccgccacgugaugcagugcccgaagcggaaggagaagaucgaggagaccgagcuguaccucaaccuggagcgcauccccugggucgugcggaagcugcuccaggugagcgaguccaccggggucgcgcugaagcgcagcuccuggcuggugauccuccuggugcugcucaccgucagccugagccccgugcaguccgcccccaucagccacggcgagaccguggaggucuaccagacgcgggagggguacaccuccaucugccuguucgugcucggcgggauccuguuccuggugagcugccucaugaagggccuggucgacuccgugggcaacagcuucuucccggggcuguccaucugcaagaccugcagcaucggcuccaucaacggguucgagaucgagagccacaagugcuacugcucccucuucugcugccccuacugccgccacugcagcgccgacaucgagauccacaagcugcaccuguccaucugcaagaagcggaagaccuggagcaacgugaugcucgccgucugcaagcgcaugugcuuccgggcgacgguggagguguccaacaaggcccugcugauccgcaacaucaucaacaccaccuucgucgugugcauccucauccuggccaucugcguggucagcaccuccgccguggagauggagaaccugcccgccggcacgugggagaaggaggaggaccucaccaacuucugccaccaggagugccaggugaccgagaccgagugccugugccccuacgaggcgcugguccuccggaagccgcuguuccuggacagcaucgugaaggggaugcgcaaccuccugaacuccacgagccuggagaccagccucuccaucgaggcccccuggggcgccaucaacgugcagagcaccuucaagcccaccgucuccgccgccaacaucgcgcugagcugguccagcguggagcaccggggcaacaagauccugguguccgggcgcagcgaguccaucaugaagcucgaggagcgcacgggcaucagcugggaccugggggucgaggacgccuccgagagcaagcugcucaccguguccgugauggaccugagccagauguacucccccgucuucgaguaccugagcggcgaccggcagguggaggaguggccgaaggccaccugcaccggggacugccccgagcgcugcggcugcacguccagcaccugccuccacaaggaguggccccacucccggaacuggcgcugcaaccccaccuggugcuggggcguggggaccggcugcacgugcugcgggcuggacgucaaggaccuguucaccgacuacauguucgugaaguggaagguggacuacaucaagaccgaggccaucgucugcguggagcucaccagccaggagcggcagugcagccugaucgaggccggcacgcgcuucaaccuggggccggucaccaucacccucuccgagccccggaacauccagcagaagcugccccccgagaucgugacccugcacccgcgcaucgaggagggcuucuucgaccucaugcacauccagaaggugcugagcgcguccacggucugcaagcugcagagcugcacccacggcgugcccggggaccuccagaucuaccacaucggcaaccugcugaagggggacaaggugaacggccaccucauccacaagaucgagccccacuucaacaccuccuggaugagcugggacggcugcgaccuggacuacuacugcaacaugggggacuggcccuccugcagcuacaccggcgucacgcagcacaaccacgccgccuucgugaacaugcugaacaucgagaccgacuacaccaagaacuuccacuuccacuccaagcgggugaccgcccacggggacaccccgcagcucgaccugaaggcgcgccccacguacggcgccggggagaucaccguccugguggagguggccgacauggagcuccacaccaagaagaucgagaucagcggccugaaguucgccucccugaccugcacgggcugcuacgccugcagcuccgggaucagcugcaagguccggauccacguggacgagcccgacgagcucaccgugcacgucaaguccgaggaccccgacaucguggcggccagcuccagccugauggcccgcaagcuggaguucggcaccgacuccaccuucaaggccuucagcgccaugccgaagacgagccucugcuucuacaucguggagcgggaguacugcaaguccugcagcaaggaggacacccagaagugcgucaacaccaagcuggagcagccccaguccauccugaucgagcacaaggggaccaucaucggcaagcagaacgacacgugcaccgcgcgcgccagcugcuggcucgaguccaucaagagcuucuucuacgggcugaagaacaugcuguccggcaucuucggcaacguguucaucgggaucuuccuguucuucgcccccuucaucaugcucauccuguucuucauguucggcuggcggauccuguucugcuucaagugcugccgccggacccgcgggcucuucaaguaccggcaccugaaggacgacgaggaggugggcuaccgcaagaucaucgagcggcugaacaacaagaaggggaagaacaagcuccuggacggcgagcgccuggccgaccgcaagaucgccgagcucuucagcaccaagacgcacaucggcuga

SEQ ID NO: 11917 - RNA, 5070 nt, Artificial Sequence
  derived and/or modified CDS sequence (opt1) from CCHFV(SPU 130/89)__KJ682807.1__GP
augcccuucaacaucauguacaccccgcugcucugcgccauccugugccugcagcucuggagccuggagggcaucuacgggcuguccaacaagacccagcacaacgacaacagcacgaccaaggcccccgaggagucccacaagaccagccuccccgcgaacaccgccucccccaucacgagcgacccgcccuccaccaccagcaccacguccgccagcggccccgagggguccggcgacaccagcaccuccccgcccgugaccacgcaggggcccgccagccccgagaccacccccgagccgcacaccacgaucgacaucgacaaguccagcaccgccaucgcggacaucuccacccagaccgucaaggacauccccacgcccaccacccacaccagccugcccuccacgcugagcgccccgaccaucccccaggaggcccaccacaccgcccgcggccuccugagcgugacccggcacaagcccggcgaggcguccaagcccacgagcccgggggaggccuccaccgaggccagcuccagccagcccaccaucuccgagacccccagcccgccgcccacgacccaggcccccaccgagaucaacaaccccaacaccucccgccagccgaugcccagcacgcagcccgccgcgccguccagcgugacccaccccgcccagcccacccccucccagagcgacgucccgaccgccgcccaggacauccaccccucccccaccaaccggagcaagcgcaaccuggagauggagaucauccucacgcugucccagggccugaagaaguacuacgggaaggugcucaagcugcuggaccucacccuggaggaggacaccgagggccugcucgaguggugcaagcggaaccuggggcugaccugcgacgacaacuucuuccagaagcgcaucgaggaguucuuccucacgggcgagggccacuucaacgaggugcugcaguucaagacccccagcacccuguccccgaccgagcccgcccgggucgagagccccacgguggagcccuucaagagcuacuucgcgaagggguuccucuccauggacagcggcuacuucuccgccaagugcuaccccaagagcuccaacagcgggcugcagcugaucaacgugacccagcaccucauccgcaucaccgacacccccggccccaagaucacgaaccugaagaccaucaacugcaucaaccugaaggcccucgucuucaaggagcaccgggagaucgagaucaacgugcugcugccccagguggccgucaaccucuccaacugccacgugcugaucaagagccacgugugcgacuacucccuggacaucgacggcccgguccgccuccccagcauccaccacgaggggaccuucauccccggcaccuacaagaucgugaucgacaagaagaacaagcagaacgaccggugcacgcuggugaccaacugcgucaucaaggggcgcgagauccggaagggccaguccgugcugcgccaguaccggaccgagaucaagaucgggaaggccagcuccggcagccgccggcuccuguccgaggagcccaacuacgacugccugagccgcacccagcuccugcggacggagaacgcggagauccacuccgacaacuacggcgggccgggcgacaagaucaccaucugcaacgggagcaccaucguggaccagcgccugggcagcgagcucgggugcuacaccaucaaccgggucaaguccuucaagcugugcgagaacagcgccacgggcaaguccugcgagaucgacagcacccccgugcgcugccgccagggcuucugccugaagaucacccaggaggggcggggccacgugaagcugucccgcgggagcgaggucgugcucgacgccugcgacuccagcugcgagaucaugauccccaagggcaccggggacauccuggucgacugcuccggcggccagcagcacuuccugaaggacaaccucguggaccuggggugccccaacaucccgcugcucggcaagauggccaucuacaucugccggaugagcaaccaccccaagacgaccauggccuuccuguucugguucuccuucggguacgugaucacgugcauccugugcaaggucaucuucuaccuccugaucguggugggcacccugggcaagaaguucaagcaguaccgcgagcucaagccccagaccugcaccaucugcgagaccaacccggucaacgcgaucgacgccgagaugcacgaccugaacugcagcuacaacaucugccccuacugcgccucccggcugaccagcgacgggcucgcccgccacgugaugcagugccccaagcggaaggagaagaucgaggagacggagcuguaccugaaccucgagcgcauccccugggugguccggaagcugcuccagguguccgagagcaccggcguggcgcugaagcgcuccagcuggcuggucgugcugcucgugcugcugaccgucucccucagcccggugcagagcgcccccaucucccacggggagaccguggaggucuaccagacccgggagggcuacacgagcaucugccuguucgugcugggguccauccucuuccuggugagcugccugaugaagggccucgucgacuccgugggcaacagcuucuuccccgggcuguccaucugcaagaccugcagcaucggcuccaucaacggguucgagaucgagagccacaagugcuacugcucccuguucugcugccccuacugccgccacugcagcgccgacaucgagauccacaagcuccaccuguccaucugcaagaagcggaagaccggcagcaacgugaugcuggccgucugcaagcgcaugugcuuccgggccaccguggagguguccaacaaggcgcuccugauccgcaacaucaucaacacgaccuucgucgugugcauccugauccucgccgugugcgucgugagcaccuccgccguggagauggagaaccugccggccgggaccugggagaaggaggaggaccugacgaacuucugccaccaggagugccaggucaccgagaccgagugccucugccccuacgaggcccuggugcugcggaagccccucagccuggacuccaucgugaagggcaugaagaaccugcucaacagcaccagccuggagacgucccugagcaucgaggcgcccuggggcgccaucaacguccaguccaccuucaagccgaccgugagcgccgccaacaucgcccucuccuggagcuccguggagcaccgcgggaacaagauccuggucagcggccgguccgagagcaucaugaagcuggaggagcgcaccgggaucuccugggaccucggcguggaggacgcgagcgaguccaagcugcugacggugagcgucauggaccucucccagauguacagccccguguucgaguaccuguccggggaccgccagguggaggaguggcccaaggcgaccugcaccggcgacugccccgagcggugcggcugcaccagcuccacgugccugcacaaggaguggccgcacagccgcaacuggcggugcaaccccaccuggugcuggggcgucgggaccgggugcacgugcugcggccucgacgugaaggaccuguucaccgacuacauguucgugaaguggaaggucgacuacaucaagaccgaggccaucgugugcguggagcugaccagccaggagcgccagugcucccucaucgaggccgggacccgguucaaccugggccccgucacgaucacccugagcgagccccgcaacauccagcagaagcucccgcccgagaucgugacccugcacccccggaucgaggagggcuucuucgaccugaugcacauccagaagguccucuccgccagcaccgugugcaagcugcaguccugcacgcacggggugcccggcgaccugcagaucuaccacaucgggaaccuccugaagggcgacaaggucaacggccaccugauccacaagaucgagccgcacuucaacaccagcuggauguccugggacgggugcgaccucgacuacuacugcaacaugggcgacuggcccagcugcuccuacaccggggugacccagcacaaccacgccgccuucgugaacaugcugaacaucgagacggacuacaccaagaacuuccacuuccacagcaagcgcgucaccgcccacggcgacacgccccagcuggaccucaaggcccggcccaccuacggggcgggcgagaucaccgugcugguggaggucgccgacauggagcugcacaccaagaagguggagaucuccggccucaaguucgccagccugaccugcaccgggugcuacgccugcuccagcggcaucuccugcaaggugcgcauccacgucgacgagccggacgagcugacggugcacgucaagagcgaggaccccgacaucguggccgcguccagcucccucauggcccggaagcuggaguucgggaccgacagcaccuucaaggccuucagcgccaugcccaagaccucccugugcuucuacaucguggagcgcgagcacugcaagagcugcuccaaggaggacacgcagcggugcgugaacaccaagcucgagcagccgcagagcauccugaucgagcacaagggcaccaucaucgggaagcagaacgacacgugcaccgccaaggcguccugcuggcuggagagcaucaaguccuucuucuacggccucaagaacaugcugagcggcaucuucgggaacgucuucaucggcguguuccuguuccuggcccccuucaucauccucauccuguucuucauguucggguggcgcauccuguucugcuucaagugcugccggcgcacccggggccuccugaaguaccgccaccugaaggacgacgaggagaucggguaccggaagaucaucgagcgccucaacaacaagaagggcaagaacaagcugcuggacggcgagcggcucgccgaccgcaagaucgccgagcuguucuccaccaagacccacaucggguga

SEQ ID NO: 11918 - RNA, 5070 nt, Artificial Sequence
  derived and/or modified CDS sequence (opt1) from CCHFV(SPU 383/87)__KJ682806.1__GP
augcccuucaacaucauguacacgccccugcucugcgccauccugugccugcagcucuggagccuggaggggaucuacgggcuguccaaccgcacccagcacaacgacaccuccaccaucaaggugcccgaggagucccagaagaccagccuccccgccaacaccgcgucccccaucaccagcgacccgcccuccaccaccagcaccgccuccgccagcggccccgagggguccggcgacaccagcaccagcccgcccgucaccacccaggggcccaccccgcccgagaccacccccgagccccacaccaccaucgacaucgacaagagcuccaccgccaucgccgacaucagcacccagaccgugaaggacauccccacgcccaccacccacaccucccugccgagcacgcuguccgcgcccaccaucccccaggaggcccaccacaccgcccggggccuccugagcaucaccagcacgaagcccggcgaggccuccaccccgaucagccccggggaggcguccaccgaggccagcagcccccagcccaccaucagcgagacgccgagcccgccgcccaccgcccaggccccgaccgagaucaacagccccaacaccucccgccagcccaugccgagcacgcagcccgccgcgcccaacuccgugacccaccccgcccagccgacccccagccaguccgacguccccaccgccgcccaggacauccaccccaacccgaucaaccggagcaagcgcaaccuggagauggagaucauccucacccugucccagggccugaagaaguacuacgggaaggugcucaagcugcuggaccucacgcuggaggaggacaccgagggccugcucgagagcugcaagcggaaccuggggcugaccugcgacgacaacuucuuccagaagcgcaucgaggaguucuuccucaccggcgagggccacuucaacgaggugcugcaguucaagacgcccuccacccugagccccaccgagcccgcccgggucgaguccccgaccguggagcccuucaagagcuacuucgcgaagggguuccucagcauggacuccggcuacuucagcgccaagugcuacuccaagagcuccaacagcgggcugcagcugaucaacgugacgcagcaccucauccgcaucaccgacacccccggccccaagaucaccaaccugaagacgaucaacugcaucaaccugaaggcccucgucuucaaggagcaccgggagaucgagaucaacgugcugcugccccagguggccgucaaccucuccaacugccacgugcugaucaagagccacgugugcgacuacucccuggacaucgacggccccguccgccucccccggauccaccacgaggggaccuucauccccggcaccuacaagaucgugaucgacaagaacaacaagcagaacgaccgcugcacccuggugacgaacugcgucaucaaggggcgggagauccgcaagggccagagcgugcugcggcaguaccgcaccgagaucaagaucgggaaggccuccagcggcucccggcgccuccugagcgaggaguccaacgacgacugccugagccggacccagcuccugcgcaccgagaacgcggagauccacuccgacaacuacggcgggccgggcgacaagaucacgaucugcaacgggagcaccaucguggaccagcggcugggcagcgagcucgggugcuacaccaucaaccgcgucaaguccuucaagcugugcgagaacagcgccaccggcaaguccugcgagaucgacagcacgcccgugcgcugccggcagggcuucugccugaagaucacccaggaggggcgcggccacgugaagcugucccgggggagcgaggucgugcucgacgccugcgacuccagcugcgagaucaugauccccaagggcaccggggacauccuggucgacugcuccggcggccagcagcacuuccugaaggacaaccucguggaccuggggugccccaacaucccgcugcucggcaagauggccaucuacaucugccgcaugagcaaccaccccaagaccacgauggccuuccuguucugguucuccuucggguacgugaucacgugcauccugugcaaggucaucuucuaccuccuggugguggucggcacccugggcaagaaguucaagcaguaccgggagcucaagccccagaccugcacgaucugcgagaccaacccggugaacgcgaucgacgccgagaugcacgaccugaacugcagcuacaacaucugccccuacugcgccucccgccugaccagcgacgggcucgcccggcacgugauccagugccccaagcgcaaggagaagaucgaggagaccgagcuguaccugaaccucgagcggauccccugggucgugcgcaagcugcuccagguguccgagagcacgggcgucgcgcucaagcgguccagcuggcuggugauccugcucgugcugcugaccgucucccucagcccggugcagagcgcccccaucucccacggggagaccguggaggucuaccagacccgcgagggcuacaccagcaucugccuguucgugcugggguccauccucuuccuggugagcugccugaugaagggccucgucgacuccgugggcaacagcuucuuccccgggcuguccaucugcaagacgugcagcaucggcuccaucaacggguucgagaucgagagccacaagugcuacugcucccuguucugcugccccuacugccggcacugcagcgccgacaucgagauccaccgccuccaccuguccaucugcaagaagcggaagaccggcagcaacgugaugcuggccgucugcaagcgcaugugcuuccgggccaccguggagguguccaacaaggcgcuccugauccgcaacaucaucaacaccacguucgucgugugcauccugauccucgccgugugcgucgugagcaccuccgccguggagauggagaaccugccggccgggaccugggagaaggaggaggaccugaccaacuucugccaccaggagugccaggucacggagaccgagugccucugccccuacgaggcccuggugcugcggaagccccucuuccuggacagcaucgugaagggcaugaagaaccugcucaacuccaccagccuggagaccagccuguccaucgaggcgcccuggggcgccaucaacguccagagcacguucaagccgaccguguccgccgccaacaucgcccucagcugguccagcguggagcaccgcgggaacaagauccuggucuccggccgcagcgaguccaucaugaagcuggaggagcggaccgggaucagcugggaccucggcguggaggacgcguccgagagcaagcugcugaccguguccgucauggaccucagccagauguacucccccguguucgaguaccugagcggggaccgccagguggaggaguggcccaaggccacgugcaccggcgacugccccgagcggugcggcugcaccuccuccacgugccugcacaaggaguggccgcacucccgcaacuggcggugcaaccccaccuggugcuggggcgucggcaccgggugcacgugcugcggccucgacgugaaggaccuguucaccgacuacauguucgugaaguggaaggucgacuacaucaagacggaggccaucgugugcguggagcugaccagccaggagcgccagugcagccucaucgaggccgggacccgguucaaccugggccccgucaccaucacgcuguccgagccccgcaacauccagcagaagcucccgcccgagaucgugacccugcacccccggaucgaggagggcuucuucgaccugaugcacauccagaagguccucagcgcguccaccgugugcaagcugcagagcugcacccacggggugcccggcgaccugcagaucuaccacaucgggaaccuccugaagggcgacaaggucaacggccaccugauccacaagaucgagccgcacuucaacacguccuggaugagcugggacgggugcgaccucgacuacuacugcaacaugggcgacuggcccuccugcagcuacaccggggugacccagcacaaccacgccgccuucgugaacaugcugaacaucgagaccgacuacacgaagaacuuccacuuccacuccaagcgcgucaccgcccacggcgacacgccccagcuggaccucaaggcccggcccaccuacggggcgggcgagaucaccgugcugguggaggucgccgacauggagcugcacacgaagaagaucgagaucagcggccucaaguucgccucccugaccugcaccgggugcuacgccugcagcuccggcaucagcugcaaggugcgcauccacguggacgagccggacgagcugaccguccacgugaaguccgaggaccccgacaucguggccgcgagcuccagccucauggcccggaagcuggaguucgggacggacuccaccuucaaggccuucagcgccaugcccaagaccagccugugcuucuacaucgucgagcgcgaguacugcaaguccugcagcaaggaggacacccagaagugcgugaacacgaagcucgagcagccgcaguccauccugaucgagcacaagggcaccaucuucgggaagcagaacgacacgugcaccgccaaggcgagcugcuggcuggaguccgugaaguccuucuucuacggccucaagaacaugcuguccggcaucuucgggaacgucuucaucggcguguuccuguuccuggcccccuucaucaugcucauccuguucuucauguucggguggcggauccuguucugcuucaagugcugccgccggacgcgcggccucuucaaguaccggcaccugaaggacgacgaggagaucggguaccgcaagaucaucgagcggcugaacaacaagaagggcaagaacaagcuccuggacggcgagcgccuggccgaccgcaagaucgccgagcuguucagcaccaagacccacaucggguga

SEQ ID NO: 11919 - RNA, 5070 nt, Artificial Sequence
  derived and/or modified CDS sequence (opt1) from CCHFV(SPU 44/08)__KJ682805.1__GP
augcccuucaacaucauguacaccccgcuccucugcgccauccugugccugcagcucuggagccuggagggcaucuacgggcuguccaacaacacccagcacaacgacacgagcaccaucaaggugcccgaggagucccagaagaccagccuccccgccaacaccgcgucccccaucacgagcgacccgccgcccaccacccccaccgccuccgccagcggcccggagggguccggcgacacgagcaccuccccgcccgucaccacccaggggcccacgccgcccgagaccacccccgagccccacaccacgaucgacaucgacaagagcuccaccgccaucgccgacaucagcacccagaccgugaagaacauccccacgcccaccgcgcacaccucccugcccagcacccuguccgcccccacgaugccgcaggaggcccaccacaccgcccgcggccuccugagcgugaccuccaccaagcccggcgaggcgagcacgcccaccagccccggggaggccuccaccgaggccagcuccccgcagcccaccauccgggagacgcccagcccgccgcccaccacccagacccccacggagaucaacaaccccaacaccucccgccagcccaugcccagcacccagcccgccgccccguccagcgucacccaccccgcgcagcccacccccucccagagcgacgugccgacggccgcccaggacauccaccccucccccaccaaccggagcaagcgcaaccuggagauggagaucauccucacccugucccagggccugaagaaguacuacgggaaggugcucaagcugcuggaccucacccuggaggaggacacggagggccugcucgaguggugcaagcggaaccuggggcugaccugcgacgacaacuucuuccagaagcgcaucgaggaguucuuccucaccggcgagggccacuucaacgagguccugcaguucaagacccccagcacgcuguccccgaccgagcccgcccggguggagagccccaccguggagcccuucaaguccuacuucgccaagggguuccuccugauggacagcggcuacuucuccgcgaagugcuaccccaagagcagcaacuccgggcugcagcucaucaacgucacccagcaccugauccgcaucacggacacccccggccccaagaucaccaaccugaagaccaucaacugcaucaaccucaaggcccugguguucaaggagcaccgggagaucgagaucaacgugcugcucccccaggucgccgugaaccugagcaacugccacgugcugaucaagucccacgucugcgacuacagcaucgacaucgacggcccggugcgccucccccggauccaccacgaggggacguucauccccggcaccuacaagaucgugaucgacaagaagaacaagcagaacgaccgcugcacccuggucaccaacugcgugaucaaggggcgggagauccgcaagggccaguccgugcugcggcaguaccgcacggagaucaagaucgggaaggccagcuccggcagccggcgccuccuguccgaggagagcaacgacgacugccugucccggacccagcuccugcgcaccgagaacgccgagauccacagcgacaacuacggcgggcccggcgacaagaucaccaucugcaacggguccacgaucgucgaccagcggcugggcagcgagcucgggugcuacaccaucaaccgcgugaaguccuucaagcugugcgagaacagcgcgaccggcaaguccugcgagaucgacagcaccccggugcgcugccggcagggcuucugccugaagaucacgcaggaggggcgcggccacgucaagcugagccggggguccgaggugguccucgacgccugcgacagcuccugcgagaucaugauccccaagggcaccggggacauccugguggacugcagcggcggccagcagcacuuccugaaggacaaccucguggaccuggggugccccaacaucccgcugcucggcaagauggccaucuacaucugccgcauguccaaccaccccaagaccaccauggccuuccuguucugguucagcuucggguacgucaucacgugcauccugugcaaggccaucuucuaccuccugaucguggugggcacccugggcaagaaguucaagcaguaccgggagcucaagccccagaccugcaccaucugcgagacgaaccccgucaacgcgaucgacgccgagaugcacgaccugaacugcuccuacaacaucugcccguacugcgccagccgccugaccuccgacgggcucgcccggcacgugaugcagugccccaagcgcaaggagaagaucgaggagaccgagcuguaccugaaccucgagcggauccccugggugguccgcaagcugcuccaggugagcgaguccaccggcguggcgcucaagcggagcuccuggcuggucauccugcucgugcugcugaccgugagccucucccccguccagagcgccccgaucucccacggggagacgguggagguguaccagacccgcgagggcuacaccagcaucugccuguucguccugggguccauccucuuccuggugagcugccugaugcggggccucguggacagcgucuccaacagcuucuuccccggccuguccaucugcaagaccugcagcaucggguccaucaacggcuucgagaucgagagccacaagugcuacugcucccuguucugcugccccuacugccgccacugcagcgccgacaucgagauccacaagcuccaccuguccaucugcaagaagcggaagacggggagcaacgugaugcuggccgugugcaagcgcaugugcuuccgggccaccgucgagguguccaacaaggcgcuccugauccgcaacaucaucaacaccaccuucguggucugcauccugauccucgccgugugcguggucagcacguccgccguggagauggagaaccugcccgccggcaccugggagaaggaggaggaccugaccaacuucugccaccaggagugccaggugaccgagacggagugccucugcccguacgaggcccugguccugcggaagccccucuuccuggacagcaucgugaaggggaugaagaaccugcucaacuccaccagccuggagaccucccugagcaucgaggcgcccuggggcgccaucaacgugcaguccaccuucaagcccacggucagcgccgccaacaucgcccucagcugguccagcguggagcaccgcggcaacaagauccugguguccgggcgcagcgaguccaucaugaagcuggaggagcggaccggcaucagcugggaccucggggucgaggacgcguccgagagcaagcugcugaccguguccgugauggaccucagccagauguacuccccggucuucgaguaccugagcggcgaccgccagguggaggaguggcccaaggcgaccugcacgggggacugccccgagcggugcggcugcaccuccagcacgugccugcacaaggaguggccccacucccgcaacuggcggugcaacccgaccuggugcuggggcguggggaccggcugcacgugcugcgggcucgacgucaaggaccuguucaccgacuacauguucgugaaguggaagguggacuacaucaagaccgaggccaucgucugcguggagcugaccagccaggagcgccagugcucccucaucgaggccggcacccgguucaaccuggggcccgugaccaucacccugagcgagccccgcaacauccagcagaagcugcccccggagaucgucacgcugcacccccggaucgaggagggcuucuucgaccugaugcacauccagaaggugcucuccgccagcaccgucugcaagcugcagagcugcacccacggcgugcccggggaccugcagaucuaccacaucggcaaccuccugaagggggacaaggugaacggccaccugauccacaagaucgagccccacuucaacaccuccuggaugagcugggacggcugcgaccucgacuacuacugcaacaugggggacuggccguccugcagcuacacgggcgucacccagcacaaccacgccgccuucgugaacaugcugaacaucgagaccgacuacaccaagaacuuccacuuccacuccaagcgcgugaccgcccacggggacacgccccagcuggaccucaaggcccggcccaccuacggcgcgggggagaucaccguccugguggagguggccgacauggagcugcacaccaagaagaucgagaucagcggccucaaguucgccucccugacgugcaccggcugcuacgccugcagcuccgggaucagcugcaagguccgcauccacguggacgagccggacgagcugaccgugcacgucaaguccgaggaccccgacaucguggccgcgagcuccagccucauggcccggaagcuggaguucggcaccgacuccacguucaaggccuucagcgccaugcccaagaccucccugugcuucuacaucguggagcgcgaguacugcaagagcugcuccaaggaggacacccagaagugcgucaacaccaagcucgagcagccccagagcauccugaucgagcacaaggggacgaucaucggcaagcagaacgacacgugcaccgccaaggcgagcugcuggcuggaguccaucaagagcuucuucuacgggcucaagaacaugcuguccggcaucuucggcaacguguucaucgggaucuuccuguuccuggccccguucaucaugcucauccuguucuucauguucggcuggcggauccuguucugcuucaagugcugccgccggacccgcggccucuucaaguaccggcaccugaaggacgacgaggagaucggguaccgcaagaucaucgagcggcugaacaacaagaaggggaagaacaagcuccuggacggcgagcgccuggccgaccgcaagaucgccgagcuguucagcaccaagacccacaucggcuga

SEQ ID NO: 11920 - RNA, 5070 nt, Artificial Sequence
  derived and/or modified CDS sequence (opt1) from CCHFV(Matin)__AF467769.2__GP
augagcuucaacaucauguacacccugcugcugugcgccauccugugcucccagcucuggagcuccgaggggauccacgggcugagcaacgagacccagcacggcaacgccuccaccaucaaggcccccgaggugagccaggggcugggccuccccgucuccaccgcgccgcccaucaccagcgacccgcccuccaucaccagcgccgccuccgugagcgggcccgagggcuccggcgacaccaacaccuccccgcccgugaccacccaggggcugacccugcccgagaccacccucgagcugcugaccaccaccaacaccggcgccuccagcaccgucaucguggacguguccacccagaccgucaaggacacccccgugagcaccgcccacaccagcccgcccgggacccccagcgcccccaccacgccccagggcacgcaccacaccgcccgcgggcuccugagcgugaccuccaccaagagcgaggaggccuccacgcagaccaaccccaagaagaccagcauggagaccaacuccccgggccccgcgacgagcgagacccccucccccagccccaccacccaggcccccacggagaacaacaaccccaacacgccccggcagccgacgccgcccacccagcccgccaccccgucccccgucacgagccccgcccugcucgccuccagccagggcgacaccuccaccgcggugcaggacgugcacccgagccccaccaaccgcuccaagcggaaccuggagauggagaucauccugacgcucagccaggggcugaagaaguacuacggcaagauccugaagcuccuggaccugacccucgaggaggacaccgaggggcugcuggaguggugcaagcgcaaccucggccuggucugcgacgacuccuucuuccagaagcggaucgaggaguucuuccugaccggcgaggggcacuucaacgaggugcuccaguucaagacgcccagcacccugucccccaccgagccggcccgcgccggcagccccaccguggagcccuucaagagcuacuucgcccgggggcugcucuccauggacagcggcuacuucuccgccaagugcuacccccgcgcgagcaacuccgggcugcagcugaucaacaucacgcagcacagcgcccggaucaccgacaccccgggccccaagaucaccaaccucaagacgaucaacugcaucaaccugaaggccuccaccuucaaggagcaccgcgagaucgagaucaacguccugcucccccagguggccgugaaccugagcuccugccacguccugaucaagagccacgugugcgacuacucccucgacaucgacggccccgugcggcugccgcgcauccaccacgaggggaccuucauccccggcaccuacaagaucgucaucgacaagaagaacaagcagaacgaccggugcacgaucgugaccaacugcgugaucaaggggcgcgagauccggaagggccagagcguccugcgccaguacaagaccgagaucaagaucgggaaggccuccagcggcucccggcgccuccugagcgaggaguccggcgacgacugcaucagccggacccagcugcuccgcacggagaccgcggagauccacagcgacuccuacgggggccccggggacaagaucaccaucugcaacggcagcaccguggucgaccagcggcugggguccgagcugggcugcuacacgaucaaccgcgugaaguccuucaagcugugcgagaacuccgccaccggcaagagcugcgagaucgacuccacccccgugaagugccgccagggguucugccucaagaucacccaggagggccgggggcacgucaagcugagccgcggcuccgagguggugcuggacgccugcgacagcuccugcgagaucaugauccccaagggcacgggggacauccucgucgacugcagcggcgggcagcagcacuuccugaaggacaaccugaucgaccucggcugccccaacaucccccugcuggggaagauggccaucuacaucugccggauguccaaccaccccaagaccaccaugguguuccucuucugguucagcuucggcuacgugaucacgugcauccugugcaaggucaucuucuaccugcucaucguggugggcacgcuggggaagaaguucaagcaguaccgcgagcugaagccgcagaccugcaccaucugcgagaccacccccgucaacgccaucgacgcggagaugcacgaccucaacugcuccuacaacaucugccccuacugcgccagccggcugacguccgacggccuggcccgccacgugaugcagugccccaagcggaaggagaagaucgaggagaccgagcucuaccugaaccuggagcgcaucccgugggugguccggaagcuccuccaggugagcgaguccaccgggguggcccugaagcgcagcagcuggcucgucgugcugcuggugcuccugaccgucucccugagccccgugcaguccgcgcccaucggccacgggaagacgguggagaccuaccagauccgggagggcuacaccagcgucugccucuucgugcugggcuccauccuguucaucgugagcugccucaugaaggggcuggucgacuccgacggcaacagcuucuucccggggcuguccaucugcaagaccugcagcaucggcuccaucaacggguucgagaucgagagccacaagugcuacugcucccucuucugcugccccuacugccgccacugcagcacggaccgggagauccacaagcugcaccuguccaucugcaagaagcgcaagaccggcagcaacgugaugcucgccgugugcaagcggaugugcuuccgcgccaccgucgagguguccaacaaggcccugcugauccggagcaucaucaacaccacguucguggucugcauccucauccuggccgugugcguggucuccaccagcgcgguggagauggagagccugcccgccggcaccugggagcgcgaggaggaccucaucaacuucugccaccaggagugccaggugaccgagacggagugccugugccccuacgaggcccugguccuccggaagccgcuguuccuggacuccaucaucaaggggaugaagaaccuccugaacagcaccucccuggagaccagccucuccaucgaggcccccuggggcgccaucaacgugcagagcaccuucaagcccacgauguccgcggccaacaucgcccugagcugguccagcguggagcaccgcgggaacaagauccuggucuccggccgcagcgaguccaucaugaagcucgaggagcggaccgggaucagcugggaccugggcguggaggacgccuccgagagcaagcugcucaccguguccgucauggaccugagccagauguacucccccguguucgaguaccugagcggcgaccgccagguggaggaguggccgaaggcgaccugcacgggggacugccccgagcggugcggcugcaccagcagcacgugccuccacaaggaguggccccacagccgcaacuggcggugcaaccccaccuggugcuggggcgugggcaccggcugcacgugcugcgggcuggacgugaaggaccuguucaccgacuacauguucgugaaguggaaggucgaguacaucaagaccgaggugaucgucugcguggagcucacgucccaggagcgccagugcagccugaucgaggcgggcacccgguucaaccuggggccggugaccaucacccucuccgagccccgcaacauccagcagaagcugccgcccgagaucgucacgcugcacccgcggaucgaggagggcuucuucgaccucaugcacgugcagaaggugcugagcgccuccaccgucugcaagcugcagagcugcacccacggggugcccggcgaccuccagguguaccacaucggcaaccugcugaagggggacaaggucaacggccaccucauccacaagaucgagccccacuucaacaccuccuggaugagcugggacgggugcgaccuggacuacuacugcaacaugggcgacuggcccuccugcagcuacaccggggugacgcagcacaaccacgccgccuucgugaacaugcuguccaucgagaccgacuacaccaagaacuuccacuuccacagcaagcgcgucaccgcgcacggcgacacgccgcagcucgaccugaaggcccggcccaccuacggcgccggggagaucaccgugcugguggaggucgccgacauggagcuccacaccaagaagaucgagaucuccggccugaaguucgccagccugacgugcaccgggugcuacgcgugcuccagcggcaucuccugcaaggugcgcauccacguggacgagcccgacgagcucaccguccacgucaaguccgaggaccccgacaucguggccgccagcuccagccugauggcccggaagcuggaguucgggaccgacuccacguucaaggccuucagcgcgaugccgaagaccucccucugcuucuacaucgucgagcgcgaguacugcaagagcugcuccaaggaggacacccagaagugcgugaacaccaagcuggagcagccccagagcauccugaucgagcacaagggcacgaucaucggcaagcagaacgacacgugcaccgccaaggccuccugcuggcucgagagcgugaaguccuucuucuacgggcugaagaacaugcugagcggcaucuucgggaacgucuucaucggcaucuuccuguuccucgcccccuucgcccugcugauccucuucuucauguucggcuggcggauccuguucugcuucaagugcugccgccggacccgcgggcuguucaaguaccggcaccucaaggacgacgaggagacgggcuaccgcaagaucaucgagcggcugaacaacaagaaggggaagaacaagcugcucgacggcgagcgccuggcggaccgcaagaucgccgagcuguucuccaccaagacccacgugggguga

SEQ ID NO: 11921 - RNA, 5070 nt, Artificial Sequence
  derived and/or modified CDS sequence (opt1) from CCHFV(TADJ/HU8966)__AY179962.1__GP
augcccgugagcaucaugcacaugcugcucaugugcgccguccugugccugcagcucuacggccucgggggcacccugcgcuccaacaacgggaccgagcacaacaagacgaacgugcucaccaccccgggcgacaagcugagccccgagccgcccguguccaccgcccugcccgucacgcccgacagcuccaccgugacccccaccacgcccgcgagcgggcucgagggcuccggcgagguguacaccagcccgcccaucaccaccaaggggcugucccccagcgaggccacguccgagcccccggccaccaccggcauggggaucagcuccgccagcggcgucgacuucuccacccaggccgcgcgggacacgagcacccugaccgugcucaccuccccgcccaacagccccaacacgccgcccaccucccaggacacccaccaccccgugcgcagccugcugagcgucaccagcccccggcccgaggagacgaccgcccccuccaaguccgggaaggagagccccgccgccaacuccagccaccccgugaccucccgcccgagcagcccccucaucaccgugcggggccccacggagaacuccucccacaacaccaccggccagcuggagagcaugacccaguccacgacccugguccccauggcgagcccgacccagaccgugcucucccagagcgugacguccaucgccguccaggacgcccaccccagcuccaccaaccgcagcaagcggaaccuggagauggagaucauccugacccucccccaggggcugaagaaguacuacggcaaggugcugcgccuccugcagcugacccucgaggaggacaccgaggggcugcuggaguggugcaagcggaaccucggccuggacugcgacgacacguucuuccagaagcgcaucgaggaguucuucaucaccggcgaggggcacuucaacgaggugcugcaguuccggaccccgggcacccucagcacgaccgaguccacccacgccgggagccccaccgccgagcccuucaaguccuacuucgcgaagggcuuccugagcaucgacuccggguacuucagcgccaagugcuacucccgcacgagcaacuccggccugcggcucaucaacgucacccgccacagcacccggaucgccgacacccccggcccgaagaucacgaaccugaagaccaucuccugcaucaaccugcgcgccagcaucuucaaggagcaccgggagguggagaucaacgugcuccugccccaggucgccgugaaccuguccaacugccacguggcgaucaagagccacgucugcgacuacucccucgacguggacgggaccguccgccugccccacauccaccacggcgggaccuucauccccggcacguacaagaucgugaucgacaagaagaacaagcugaacgaccggugcacccucuucaccaacugcgugaucaaggggcgcgagguccggaagggccagagcauccugcgccaguacaagaccgagauccgcaucggcaaggccuccacggggagccggcgccugcucagcgaggaguccggcgacgacugcaucagccggacccagcugcugcgcaccgagaccgccgagauccacggggacgacuacggcgggccgggcgacaagaucacgaucugcaacggcuccaccaucguggaccagcggcuggggagcgagcucggcugcuacaccaucaaccgcgugaaguccuucaagcugugcgagaacagcgccaccgggaagaacugcgagaucgacuccguccccgugaagugccggcagggcuacugccugaagaucacgcaggagggccgcgggcacgugaagcucagccggggcuccgaggucgugcuggacgccugcgacagcuccugcgaggugaugauccccaaggggaccggcgacaucagcgucgacugcuccgggggccagcagcacuuccugaaggacaaccucaucgaccugggcugccccaagaucccgcugcucgggaagauggcgaucuacaucugccgcaugagcaaccaccccaagaccaccauggccuuccuguucugguucuccuucggcuacgugaucacgcggauccugugcaaggccaucuucuaccuccugaucaucguggggacccugggcaagcgcuucaagcaguaccgggagcucaagccccagaccugcaccaucugcgagacgacccccgccaacgccaucgacgcggagaugcacgaccugaacugcagcuacaacaucugcccguacugcgccucccgccugaccagcgacgggcucgcccggcacgucacccagugccccaagcgcaaggagcggguggaggagaccgagcuguaccugaaccucgagcgcauccccuggaucgugcggaagcugcugcaggucuccgagagcacgggcguggcccucaagcgcagcuccuggcugaucgugcugcucguccuguucaccgugagccugucccccgugcagagcgcgccgaucggcuacgggaacaccaucgagaccuaccaggcccgcgaggaguacacguccaucugccucuucguccugggcagcauccuguucaucguguccugccucaugaaggggcugguggacagcaucggcaacaucuucuuccccgggcugaccaucugcaagaccugcuccaucggcagcaucaacggcuucgagaucgagucccacaagugcuacugcagccuccugugcugccccuacugccggcacugcuccgccgaccgcgagauccaccagcugcaccucagcaucugcaagaagcggaagaccggguccaacgucaugcuggccgugugcaagcgcaugugcuuccgggccacgauggaggugagcaacaaggcgcugcucauccgcuccaucaucaacaccaccuucgucgugugcauccugauccuggccgugugcaucgucagcaccuccgccguggagauggagagccuccccgccggcacgugggagcgggaggaggaccugaccaacuucugccaccaggagugccaggugaccgagaccgagugccugugcccguacgaggcccucguccugcgccggccccuguuccucgacagcaucgugaaggggaugaagaacccccugaacuccacgagccuggagaccucccucagcaucgaggcgccguggggcgccaucaacgugcaguccaccuacaagcccaccgucagcacggccaacaucgcccuguccuggagcuccaucgagcaccgcgggaacaacauccuggugagcggccgguccgagagcaucaugaagcucgaggagcgcaccggcaucuccggggaccugggcguggaggacgccagcgaguccaagcugcucaccgucagcgugauggaccugucccagauguacagccccguguucgaguaccuguccggggaccggcaggucgaggaguggcccaaggcgaccugcacgggcgacugcccggagcgcugcggcugcaccagcagcacgugccuccacaaggaguggccccacucccggaacuggcgcugcaaccccaccuggugcuggggcguggggaccgggugcacgugcugcggccuggacgugaaggaccuguucaucgacuacauguucgucaaguggaagguggacuacaucaagaccgaggccaucgugugcgucgagcucaccagccaggagcggcagugcucccugguggaggccgggacccgcuucaaccugggccccgucaccaucacccucagcgagccgcggaacauccagcagaagcugccgcccgagaucaucacccugcacccccgcaucgaggagggcuucuucgaccucaugcacgugcagaaggugcuguccgccagcacggucugcaagcugcaguccugcacccacggggugcccggcgaccuccagguguaccacaucgggaaccugcugaagggcgacaaggagaacgggcaccucauccacaagaucgagccccacuucaacaccagcuggauguccugggacggcugcgaccuggacuacuacugcaacaugggcgacuggcccagcugcaccuacaccggggucacgcagcacaaccacgcguccuucgugaaccugcucaacaucgagaccgacuacaccaagagcuuccacuuccacuccaagcgggugaccgcccacggcgacacgccccagcuggaccugaaggcccgcccgaccuacggggccggcgagaucaccguccucguggagguggccgacauggagcugcacaccaagaagaucgagaucacggggcugaaguucgcgagccugaccugcaccggcugcuacgccugcuccagcggcaucuccugcaagguccgcauccacguggacgagcccgacgagcugaccgugcacgucaagagcgacgaccccgacgugguggccgccuccagcagccugauggcccggaagcucgaguucgggacggacuccaccuucaaggcguucagcgccaugcccaagaccucccugugcuucuacaucgucgagcgcgaguaccgcaagagcugcuccaaggaggacacccagaagugcgugaacacgaagcuggagcagccgcagagcauccucaucgagcacaagggcaccaucaucgggaagcagaacaacacgugcaccgccaaggccuccugcuggcuggagagcgugaaguccuucuucuacggccugaagaacaugcugagcggcaucuucgggaacgucuucgugggcaucuuccucuuccuggcccccuucauccugcucauccuguucuucauguucggguggcggauccuguccugcuucaagugcugccggcgcacccggggccuccugaagcaccgccaccugaaggacgacgaggagaccggguaccggcgcaucaucgagcggcucaacaacaagaagggcaagaacaagcugcuggacggcgagcgccucgcggaccggcgcaucgccgagcuguucagcaccaagacccacaucggguga

SEQ ID NO: 11922 - RNA, 5070 nt, Artificial Sequence
  derived and/or modified CDS sequence (opt1) from CCHFV(88166)__AB069675.1__GP
augagcuucuccgugauguacacgccccugcucugcgccguccugugccugcagcucuggagccuggagggcucccacgggcugagcaacaagacccagcacuccaacaccagcaccaccaaggccccggaggugucccaggagcucggccugcccgugagcaccgucuccacgaucaccagcgacccgcccuccaucaccagcgcgguguccgugagcggguccgagggcagcggggacaccaacacgucccccagcgucaccacccagggccccacccugcccgagacgacccucgagccccugaccaccacggacaccgacgccuccagcaccgugguggucgacgugagcacccagacggugaaggacaccccgaucuccaccaccuacacgagccugcccuccacccccagcgagcccaccaccccgcagggcacgcaccacaccgcccgcgggcuccuguccgucaccagcaccaagcccgaggaggccuccacgcaggccaaccccggcaagaucagcauggagaccaacagcccccggcuggcgaucagcgagaccccguccuucagccccaccacgcaggcccccaccgagaacuccaaccccaucaccagcaagcagcucaugcuguccgcccagccggugacccccaaccccaugaccagccccgugcagccggcccugucccagagcgacacguccaccgcgauccaggacauccaccccagccccaccgggcgcagcaagcggaaccucgagauggagaucauccugacccugucccagggccucaagaaguacuacgggaagauccugaagcugcucgaccugacgcuggaggaggacaccgagggccuccuggaguggugcaagcgcaaccugggccucgucugcgacgacaacuucuuccagaagcggaucgaggaguucuuccugaccgggaagggccacuucaacgaggugcugcaguucaagacccccagcacgcucuccccgaccgggcccgcccgcaccggcagccccaccguggagccguucaaguccuacuucgccaagggcuuccugagcauggacuccggguacuucagcgccaagugcuacccccgggccuccaacagcggccugcagcucaucaacgucacgcagcacuccacccgcaucaccgacacccccgggcccaagaucacgaaccugaagaccaucaacugcaucaaccugaaggcgagcguguucaaggagcaccgggagaucgagaucaacgugcuccugccgcaggucgccgugaaccuguccagcugccacgugcucaucaagucccacgucugcgacuacagccuggacaucgacggccccgugcgccugccccggauccaccacgaggggaccuucauccccggcaccuacaagaucgucaucgacaagaagaacaagcagaacgaccgcugcacgcucgugaccaacugcgugaucaagggccgggagauccgcaaggggcaguccguccugcggcaguaccgcaccgagaucaagaucggcaaggccagcagcgggucccggcgccugcucagcgaggaguccggcgacgacugcaucagccggacccagcugcugcgcacggagaccgccgagauccacuccgacaacuacgggggcccgggcgacaagaucaccaucugcaacgggagcaccgugguggaccagcggcugggcuccgagcucgggugcuacacgaucaaccgcgucaagagcuucaagcugugcgagaacuccgccaccggcaagagcugcgagaucgacuccacccccgugaagugccgccagggguucugccugaagaucacccaggagggccggggccacgugaagcucagccgcggguccgaggucgugcuggacgcgugcgacagcuccugcgagaucaugauccccaagggcacgggggacauccugguggacugcagcggcggccagcagcacuuccucaaggacaaccugaucgaccuggggugccccaacaucccgcuccugggcaagauggccaucuacaucugccggauguccaaccaccccaagaccaccaugggguuccuguucugguucagcuucggcuacgucgugaccugcauccucugcaaggugaucuucuaccugcugaucgucguggggacgcucggcaagaaguucaagcaguaccgcgagcugaagccccagaccugcaccaucugcgagaccacccccgugaacgccaucgacgccgagaugcacgaccugaacugcuccuacaacaucugcccguacugcgccagccggcucacgagcgacggccuggcgcgccacgucaugcagugccccaagcggaaggagaagaucgaggagaccgagcuguaccucaaccuggagcgcauccccuggguggugcggaagcugcuccaggucuccgagagcaccgggguggcccugaagcgcuccagcuggcuggugguccuccuggugcugcucaccgugucccugagccccguccaguccgccccgaucggccacgggaagacgguggagaccuaccagacccgggagggcuacaccagcaucugccuguucgugcucggguccauccuguucaucgucagcugccugaugaagggccucguggacuccgugggcaacagcuucuuccccgggcuguccaucugcaagacgugcagcaucggcuccgucaacggguucgagaucgagagccacaagugcuacugcucccuguucugcugccccuacugccgccacugcagcgccgaccgggagauccaccgccuccaccuguccaucugcaagaagcggaagaccuggagcaacgugaugcuggccgugugcaagcgcaugugcuuccgggcgaccgucgaggugagcaacaaggcccuccugauccgcaacaucaucaacaccacguucgugcugugcauccucauccuggccgucugcgugguguccaccagcgccgucgagauggagucccugcccgcgggcaccugggagcgggaggaggaccucaccaacuucugccaccaggagugccaggugacggagaccgagugccugugcccguacgaggcccuggugcuccgcaagccccuguucagcgacuccaucgucaaggggaugaagaaccugcucaacagcaccucccuggagaccagccuguccaucgaggcccccuggggcgccaucaacgugcagagcacguucaagccgaccauguccgccgcgaacaucgcccucagcugguccagcguggagcaccgcggcaacaagauccuggucuccgggcggagcgaguccaucaugaagcuggaggagcgcaccggcaucagcuggaaccucgggguggaggacgccuccgagagcaagcugcugaccgugagcgucauggaccucucccagauguacagccccguguucgaguaccuguccggcgaccggcaggucgaggaguggcccaaggccacgugcaccggggacugccccgagcgcugcggcugcaccagcuccacgugccugcacaaggaguggccgcacagccggaacuggcgcugcaaccccaccuggugcuggggcguggggaccggcugcacgugcugcgggcucgacgugaaggaccuguucaccgacuacauguucaucaaguggaaggucgaguacaucaagaccgaggccaucgugugcguggagcugaccucccaggagcggcagugcacccucaucgaggcgggcacccgcuucaaccugggccccgucacgaucacccugagcgagccccggaacauccagcagaagcucccgcccgagaucgugacccugcacccccgcaucgaggagggguucuucgaccugaugcacgugcagaagguccucuccgccagcaccgugugcaagcugcaguccugcacccacggcgugcccggggaccugcaggucuaccacaucggcaaccuccugaagggggacaaggugaacggccaccugauccacaagaucgagccgcacuucaacacgagcuggauguccugggacggcugcgaccucgacuacuacugcaacaugggggacuggcccagcugcaccuacaccggcgugacccagcacaaccacgccgccuucgucaacaugcugaacaucgagacggacuacaccaagaacuuccacuuccacuccaagcgggugaccgcccacggggacacgccccagcuggaccucaaggcgcgccccaccuacggcgccggggagaucaccgugcuggucgagguggccgacauggagcugcacaccaagaagaucgagaucagcggccucaaguucgccucccugaccugcacgggcugcuacgcgugcagcuccgggaucagcugcaaggugcggauccacgucgacgagccggacgagcugaccgugcacgugaaguccgaggaccccgaccucgucgccgccuccagcucccugauggcccgcaagcuggaguucggcaccgacagcaccuucaaggccuucuccgcgaugcccaagacgagccucugcuucuacaucguggagcgggaguacugcaaguccugcagcaaggaggacacccagaagugcgugaacaccaagcuggagcagccccaguccauccugaucgagcacaaggggaccaucaucggcaagcagaacaacacgugcaccgccaaggccagcugcuggcuggaguccgucaagagcuucuucuacgggcucaagaacaugcuguccggcaucuucggcaacguguucaucgggguguuccuguucuucgccccguucauccuccugauccuguucuucauguucggcuggcgcauccucuucugcuucaagugcugccggcgcacccgggggcuguucaaguaccgccaccugaaggacgacgaggagaccggcuaccggaagaucaucgagcgccucaacaacaagaagggcaagaacaagcugcuggacggggagcgccucgccgaccggaagaucgcggagcuguucagcacgaagacccacaucggcuga

SEQ ID NO: 11923 - RNA, 5070 nt, Artificial Sequence
  derived and/or modified CDS sequence (opt1) from CCHFV(8402)__AB069674.1__GP
augagcuucuccgugauguacacgccccugcucugcgccguccugugccugcagcucuggagccuggagggcucccacgggcugagcaacaagacccagcacuccaacaccagcaccaccaaggccccggaggugucccaggagcucggccugcccgugagcaccgucuccacgaucaccagcgacccgcccuccaucaccagcgcgguguccgugagcggguccgagggcagcggggacaccaacacguccccgagcgucaccacccagggccccacccugcccgagacgacccucgagccccugaccaccacggacaccgacgccuccagcaccgugguggucgacgugagcacccagacggugaaggacaccccgaucuccaccaccuacacgagccugcccuccacccccagcgagcccaccaccccgcagggcacgcaccacaccgcccgcgggcuccuguccgucaccagcaccaagcccgaggaggccuccacgcaggccaaccccggcaagaucagcauggagaccaacgggccccggcuggcgaucuccgagaccccgagcuucucccccaccacgcaggcccccaccgagaacagcaaccccaucaccuccaagcagcucaugcugagcgcccagccggugacccccaaccccaugaccucccccgugcagccggcccugagccaguccgacacgagcaccgcgauccaggacguccaccccucccccaccggccgcagcaagcggaaccucgagauggagaucauccugacccugagccaggggcucaagaaguacuacggcaagauccugaagcugcucgaccugacgcuggaggaggacaccgagggccuccuggaguggugcaagcgcaaccuggggcucgugugcgacgacaacuucuuccagaagcggaucgaggaguucuuccugaccggcaaggggcacuucaacgaggugcugcaguucaagacccccuccacgcucagcccgaccggccccgcccgcaccggcucccccaccgucgagccguucaagagcuacuucgccaagggguuccuguccauggacagcggcuacuucuccgccaagugcuacccccgggccagcaacuccgggcugcagcucaucaacgugacgcagcacagcacccgcaucaccgacacccccggccccaagaucacgaaccugaagaccaucaacugcaucaaccugaaggcguccguguucaaggagcaccgggagaucgagaucaacguccuccugccccagguggccgugaaccugagcuccugccacguccucaucaagagccacgugugcgacuacucccuggacaucgacgggcccguccgccugccccggauccaccacgagggcaccuucauccccggcaccuacaagaucgugaucgacaagaagaacaagcagaacgaccgcugcacgcucgugaccaacugcgucaucaaggggcgggagauccgcaagggccagagcgugcugcggcaguaccgcaccgagaucaagaucgggaaggccuccagcggcagccggcgccugcucuccgaggagagcggggacgacugcaucucccggacccagcugcugcgcacggagaccgccgagauccacaacgacaacuacggcggcccgggggacaagaucaccaucugcaacggcagcaccguggucgaccagcggcugggguccgagcucggcugcuacacgaucaaccgcgucaagagcuucaagcugugcgagaacuccgccaccggcaagagcugcgagaucgacuccacccccgugaagugccgccagggguucugccugaagaucacccaggagggccgggggcacgugaagcucagccgcggcuccgagguggugcuggacgcgugcgacagcuccugcgagaucaugauccccaaggggacgggcgacauccuggucgacugcagcggcgggcagcagcacuuccucaaggacaaccugaucgaccugggcugccccaacaucccgcuccuggggaagauggccaucuacaucugccggauguccaaccaccccaagaccaccauggccuuccuguucugguucagcuucggcuacguggugaccugcauccucugcaaggucaucuucuaccugcugaucgugguggggacgcucggcaagaaguucaagcaguaccgcgagcugaagccccagaccugcaccaucugcgagaccacccccgucaacgccaucgacgccgagaugcacgaccugaacugcuccuacaacaucugcccguacugcgcgagccggcucacguccgacggccuggcccgccacgugaugcagugccccaagcggaaggagaagaucgaggagaccgagcuguaccucaaccuggagcgcauccccugggugguccggaagcugcuccaggugagcgagagcaccgggguggcccugaagcgcuccagcuggcuggucgugcuccuggugcugcucaccgucucccugagccccgugcaguccgccccgaucggccacgggaagacgguggagaccuaccagacccgggagggcuacaccagcaucugccuguucguccucggguccauccuguucaucgugagcugccugaugaagggccucguggacuccgucggcaacagcuucuuccccgggcuguccaucugcaagacgugcagcaucggcuccgugaacggguucgagaucgagagccacaagugcuacugcucccuguucugcugccccuacugccgccacugcagcgccgaccgggagauccaccgccuccaccuguccaucugcaagaagcggaagaccggcagcaacgugaugcuggcggucugcaagcgcaugugcuuccgggccaccguggagguguccaacaaggcccuccugauccgcaacaucaucaacaccacguucguccugugcauccucauccuggccgugugcguggucagcaccagcgcgguggagauggagucccugcccgccgggaccugggagcgggaggaggaccucaccaacuucugccaccaggagugccaggugacggagaccgagugccugugcccguacgaggcccugguccuccgcaagccccuguucagcgacuccaucgugaagggcaugaagaaccugcucaacagcaccucccuggagaccagccuguccaucgaggcccccuggggcgccaucaacgugcagagcacguucaagccgaccgucuccgcggccaacaucgcccucagcugguccagcguggagcaccgcgggaacaagauccugguguccggccggagcgaguccaucaugaagcuggaggagcgcaccgggaucagcugggaccucggcgucgaggacgccuccgagagcaagcugcugaccguguccgucauggaccucagccagauguacagccccguguucgaguaccuguccggggaccgccagguggaggaguggcccaaggccacgugcaccggcgacugccccgagcggugcggcugcaccagcuccacgugccugcacaaggaguggccgcacagccggaacuggcgcugcaaccccaccuggugcuggggcgucgggaccgggugcacgugcugcggccucgacgugaaggaccuguucaccgacuacauguucaucaaguggaagguggaguacaucaagaccgaggcgaucgucugcguggagcugaccucccaggagcggcagugcacccucaucgaggccggcacccgcuucaaccuggggcccgugacgaucacccugagcgagccccggaacauccagcagaagcucccgcccgagaucgucacccugcacccccgcaucgaggagggcuucuucgaccugaugcacgugcagaaggugcucuccgccagcaccgucugcaagcugcaguccugcacccacggggugcccggcgaccuccagguguaccacaucgggaaccuccugaagggcgacaaggucaacggccaccugauccacaagaucgagccgcacuucaacacgagcuggauguccugggacgggugcgaccucgacuacuacugcaacaugggcgacuggcccagcugcaccuacaccggggugacccagcacaaccacgccgccuucgugaacaugcugaacaucgagacggacuacaccaagaacuuccacuuccacuccaagcgggucaccgcgcacggcgacacgccccagcuggaccucaaggcccgccccaccuacggggccggcgagaucaccgugcugguggaggucgccgacauggagcugcacaccaagaagaucgagaucagcggccucaaguucgcgucccugaccugcacggggugcuacgccugcagcuccggcaucagcugcaaggugcggauccacguggacgagccggacgagcugaccguccacgugaaguccgaggaccccgacaucguggccgccagcagcucccucauggcccgcaagcuggaguucgggaccgacagcaccuucaaggcguucuccgccaugcccaagacgagccugugcuucuacaucgucgagcgggaguacugcaaguccugcagcaaggaggacacccagaagugcgugaacaccaagcucgagcagccccaguccauccugaucgagcacaagggcaccaucaucgggaagcagagcaacacgugcaccgccaaggccuccugcuggcuggagagcgugaaguccuucuucuacggccugaagaacaugcucagcggcaucuucgggaacgucuucaucggcguguuccuguucuucgccccguucauccugcucauccuguucuucauguucggguggcgcauccuguucugcuucaagugcugccggcgcacccggggccucuucaaguaccgccaccugaaggacgacgaggagaccggcuaccggaagaucaucgagcgccugaacaacaagaaggggaagaacaagcuccuggacggcgagcgccuggcggaccggaagaucgccgagcuguucuccacgaagacccacaucggguga

SEQ ID NO: 11924 - RNA, 5070 nt, Artificial Sequence
  derived and/or modified CDS sequence (opt1) from CCHFV(7803)__AB069672.1__GP
augcccgugagcaucaugcacaucucccugaugugcgccguccucugccugcagcuguacggccucggggagacccacggcagcuccaacgagaccgagcacaacaagacgaacguggugaccaccccgggggacagccagucccccgagccccuggucagcaccacgcugcccgugacccucgacuccagcaccgugaccccgacgacccccgccuccgagcccgagggcagcggggaggucuacaccuccccgcccaucaccacggagggccugagccccuccgaggcgaccagcgagcugcccgugaccaccggcaucgggaucuccagcgccuccgacguggacagcuccacgcaggccgccggcgacaccagcacccccaccguccgcacgagcccgcccaacucccccagcacgcccccgaccucccaggacacccaccaccccaugcggaaccuccugagcgugaccucccucaagagcgaggagaccuccgcccccagcaaguccgggaaggagagccccgcggccuccagcccgcaccccguggccucccgcccgcccacccaccccaucaccgcccagggccccacggagaacaacagccacaacaccaccgggcagcucgaguccgucacccagagcgcgacgcugggccccauggccucccccacccagaccgugcugagccagaacgugaccuccaucgccauccaggacacgcacccgagccccaccaaccggagcaagcgcaaccucgagauggagaucauccugacccugccccagggccucaagaaguacuacgggaagguccugcggcugcuccagcugacccuggaggaggacaccgagggccuccuggaguggugcaagcgcaaccuggggcucgacugcgacgacacguucuuccagaagcggaucgaggaguucuucaucaccggcgagggccacuucaacgaggugcugcaguuccgcaccccggggacccuguccacgaccgagagcacccacgccgagucccccaccgccgagcccuucaagagcuacuucgcgaagggcuuccucuccaucgacagcggguacuucuccgccaagugcuacagccggacguccgacagcggccugcagcugaucaacgugacccgccacuccacccggaucgccgacacccccgggccgaagaucacgaaccucaagaccaucagcugcaucaaccugaaggccuccgucuucaaggagcaccgcgagguggagaucaacgugcugcucccccaggucgccgugaaccugagcaacugccacgugaccaucaagucccacgucugcgacuacagccuggacaucgacggcaccgugcggcucccccacauccaccacgagggcacguucauccccgggaccuacaagaucgucaucgacaagaagaacaagcugaacgaccgcugcacccuguucaccaacugcgugaucaagggccgggaggugcgcaaggggcaguccguccuccggcaguacaagacggagauccgcaucggcaaggcgagcaccgggagccggcgccugcuguccgaggagagcggcgacgacugcaucucccggacccagcuccugcgcaccgagacggccgagauccacggcgacaacuacgggggcccgggggacaagaucaccaucugcaacggcagcaccaucguggaccagcgccugggguccgagaugggcugcuacaccaucaaccgggugaaguccuucaagcugugcgagaacuccgccacgggcaagagcugcgagaucgacuccauccccgugaagugccgccagggguacugccugaagaucacccaggagggccgggggcacgugaagcugagccgcggcuccgaggugauccuggacgccugcgacagcuccugcgaggucaugauccccaagggcaccggggacauccucguggacugcagcggcgggcagcagcacuuccugaaggacaaccugaucgaccucggcugccccuccaucccgcugcuggggaagauggccaucuacaucugccggaugagcaaccaccccaagaccacgauggcguuccucuucugguucuccuucggcuacgugaucacgugcauccugugcaaggccaucuucuaccugcucaucaucgucggcacccuggggaagcgcuucaagcaguaccgggagcugaagccccagaccugcaccaucugcgagaccacccccgccaacgccaucgacgccgagaugcacgaccucaacugcagcuacaacaucugcccguacugcgcgucccgccugaccagcgacggccuggcccggcacgugacccagugccccaagcgcaaggagaagguggaggagacggagcucuaccugaaccuggagcggauccccugggucgugcgcaagcuccuccaggugagcgaguccaccggggucgcccugaagcggagcuccuggcugaucgugcugcugguccucuucgccaucagccugucccccgugcagagcgcgccgaucucccacggcaagaccaucgagaccuaccaggcccgcgaggaguacacgagcaucugccuguucgugcucggguccauccuguucaucgugagcugccugaugaagggccucgucgacuccaucggcaacaucuucuuccccgggcugagcaucugcaagaccugcuccaucggcagcaucaacggguucgagaucgagucccacaagugcuacugcagccugcucugcugccccuacugccggcacugcuccgccgaccgcgagauccaccagcugcaccugagcaucugcaagaagcggaagaccggcuccaacgugaugcucgccgccugcaagcgcaugugcuuccgggcgaccauggaggugagcaacaaggcccugcugauccgcagcaucaucaacacgaccuucgucguguacauccucauccuggccgugugcgucguguccaccagcgccguggagauggagucccugcccgccgggaccugggagcgcgaggaggaccucacgaacuucugccaccaggagugccaggucaccgagaccgagugccugugcccguacgaggcgcuggugcuccggcgcccccuguuccuggacagcaucgugcggggcaugaagaacccccucaacuccaccagccuggagacgucccugagcaucgaggccccguggggcgccaucaacguccaguccaccuacaagcccaccgugagcaccgccaacaucgcccucuccuggagcuccguggagcaccgcgggaacaagauccuggucagcggccgguccgagagcaucaugaagcuggaggagcgcacggggaucuccugggaccucggcguggaggacgcgagcgaguccaagcugcugaccgugagcgucauggaccucagccagauguacucccccguguucgaguaccugagcggggaccgccagguggaggaguggcccaaggcgaccugcaccggcgacugcccggagcggugcggcugcacgaccagcacgugccugcacaaggaguggccccacagccggaacuggcgcugcaaccccaccuggugcuggggcgucgggaccgggugcacgugcugcggccucgacgugaaggaccuguucaccgacuacaugaucgugaaguggaaggucgaguacaucaagacccggggcaucgugugcguggagcugaccucccaggagcgccagugcagccucaucgaggccgggacccgguucaaccugggcuccgucaccaucacccugagcgagccccgcaacauccagcagaagcucccgcccgagaucaucacgcugcacccccggaucgaggagggguucuucgaccugaugcacgugcagaagguccucuccgccagcaccgugugcaagcugcaguccugcacccacggcgugcccggggaccugcaggucuaccacgugggcaaccuccugaagggcgacaaggugaacgggcaccugauccacaagaucgagccgcaccucaacaccagcuggauguccugggacggcugcgaccuggacuacuacugcaacaugggggacuggcccagcugcaccuacacgggcgucacccagcacaaccacgccuccuucgugaaccugcucaacaucgagaccgacuacaccaagagcuuccacuuccacuccaagcgcgugacggcccacggggacacgccccagcuggaccugaaggcccggcccaccuacggcgccggcgagaucaccguccucguggagguggccgacauggaguucaccccgaagaagaucgagaucagcgggcugaaguucgcgucccugaccugcaccggcugcuacgccugcagcagcgggaucuccugcaagguccgcauccacguggacgagcccgacgagcucaccgugcacgucaagagcgacgaccccgacgugguggccgccuccagcucccugauggcccggaagcuggaguucggcacggacagcaccuucaaggcguucuccgccaugcccaagaccagccucugcuucuacaucgucgagcgcgaguacugcaaguccugcagcaaggaggacacccagaagugcgugaacacgaagcuggagcagccgcaguccauccugaucgagcacaaggggaccaucaucggcaagcagaacaacacgugcaccgccaaggccagcugcuggcucgaguccgucaagagcuucuucuacggccugaagaacaugcuguccgggaucuucggcaacuucuucauggggaucuuccucuuccuggcccccuucauccugcugauccucuucuucauguucggcuggcggauccuguucugcuucaagugcugccgccgcacccggggccuguucaaguaccgccaccucaaggacgacgaggagaccggguaccggcgcaucaucgagcggcugaacaacaagaagggcaagaacaagcugcucgacggggagcgccuggcggaccggcgcaucgccgagcuguucagcaccaagacccacaucggcuga

SEQ ID NO: 11925 - RNA, 5070 nt, Artificial Sequence
  derived and/or modified CDS sequence (opt1) from CCHFV(75024)__AB069671.1__GP
augcccgugagcaucaugcacaucagccugaugugcgccgugcucugccugcagcuguacgggcucggggagacccacgggagcuccaacgagaccgagcacaacaagaccaacguggugaccacccccggggacagccagucccccgagccccuggucagcaccacccugcccgugacccucgacuccagcaccgugaccccgaccacccccgccuccggccccgaggggagcggcgaggucuacaccagcccgcccaucaccaccgagggccugagccccuccgaggccaccagcgagcugcccgccaccaccgggaucggcaucuccagcgccuccgacguggacagcuccacccaggccgccggggacaccagcacccccaccgugcgcacgagcccgcccaacuccagcuccacgccgcccaccagccaggacacccaccacccgaugcgcaaccuccuguccgucacgagccugaagcccgaggagaccuccgcgcccagcaaguccggcaaggagagccccgccgccuccagcccgcaccccguggccucccggccgcccaccccgcccaccacggcgcaggggcccaucgagaacaacagccacaacaccaccggccagcucgaguccgugacccagagcgccacgcugggccccauggccuccccgacccagaccguccugagccagaacgugaccuccaucgccauccaggacacgcaccccagccccaccaaccggagcaagcgcaaccucgagauggagaucauccugacccugccgcaggggcucaagaaguacuacggcaaggugcugcggcugcuccagcugacccuggaggaggacaccgaggggcuccuggaguggugcaagcgcaaccugggccucgacugcgacgacacguucuuccagaagcggaucgaggaguucuucaucaccggcgaggggcacuucaacgagguccugcaguuccgcacccccggcacccuguccacgaccgagagcacccacgccgagucccccaccgcggagcccuucaagagcuacuucgccaagggguuccucuccaucgacagcggcuacuucuccgccaagugcuacagccggacguccaacagcgggcugcagcugaucaacgugacccgccacuccacccggaucgccgacaccccgggccccaagaucacgaaccucaagaccaucagcugcaucaaccugaaggccuccguguucaaggagcaccgcgaggucgagaucaacgugcugcucccccagguggcggucaaccugagcaacugccacgugaccaucaagucccacgugugcgacuacagccuggacaucgacggcaccguccggcucccccacauccaccacgaggggacguucaucccgggcaccuacaagaucgugaucgacaagaagaacaagcugaacgaccgcugcacccuguucaccaacugcgucaucaaggggcgggaggugcgcaagggccaguccgugcuccggcaguacaagacggagauccgcaucgggaaggccagcaccggcagccggcgccugcuguccgaggagagcggcgacgacugcaucucccggacccagcuccugcgcaccgagacggccgagauccacggggacaacuacggcgggcccggcgacaagaucaccaucugcaacgggagcaccaucgucgaccagcgccugggcuccgagaugggcugcuacaccaucaaccgggucaagagcuucaagcucugcgagaacuccgccacggggaaguccugcgagaucgacuccauccccgugaagugccgccagggcuacugccugaagaucacccaggaggggcggggccacgugaagcugagccgcggcuccgagguggugcuggacgccugcgacagcuccugcgaggucaugauccccaaggggaccggcgacauccucguggacugcagcgggggccagcagcacuuccugaaggacaaccugaucgaccucgggugccccuccaucccccugcugggcaagauggcgaucuacaucugccggaugagcaaccaccccaagaccacgauggccuuccucuucugguucuccuucggcuacgugaucacgugcauccugugcaaggccaucuucuaccugcucaucaucgucgggacccugggcaagcgcuucaagcaguaccgggagcugaagccccagaccugcacgaucugcgagaccaccccggccaacgccaucgacgcggagaugcacgaccucaacugcagcuacaacaucugccccuacugcgccucccgccugaccagcgacgggcuggcccggcacgugacccagugccccaagcgcaaggagaagguggaggagacggagcucuaccugaaccuggagcggauccccugggucgugcgcaagcuccuccaggugagcgaguccaccggcgucgcccugaagcggagcuccuggcucaucgugcugcugguccuguucgcgaucagccuguccccgguccagagcgcccccaucgggcacggcaagaccaucgagaccuaccaggcccgcgaggaguacacguccaucugccuguucgugcucggcagcauccuguucaucguguccugccugaugaaggggcucgucgacagcaucggcaacaucuucuuccccgggcuguccaucugcaagaccugcagcaucggcuccaucaacggguucgagaucgagagccacaagugcuacugcucccugcucugcugccccuacugccggcacugcagcgccgaccgcgagauccaccagcugcaccuguccaucugcaagaagcggaagaccggcagcaacgugaugcucgccgugugcaagcgcaugugcuuccgggcgaccauggaggucuccaacaaggcccugcugauccgcagcaucaucaacacgaccuucguggugugcauccucauccuggccgucugcguggugagcaccuccgccgucgagauggagagccugccggccggcaccugggagcgcgaggaggaccucacgaacuucugccaccaggagugccaggugaccgagaccgagugccugugccccuacgaggcgcuggugcuccggcgcccccuguuccuggacuccaucguccgggggaugaagaaccagcucaacagcaccucccuggagacgagccuguccaucgaggccccguggggcgccaucaacgugcagagcaccuacaagcccaccguguccaccgccaacaucgcccucagcugguccagcgucgagcaccgcgggaacaagauccugguguccggccggagcgaguccaucaugaagcuggaggagcgcacggggaucagcugggaccucggcguggaggacgcguccgagagcaagcugcugaccgucuccgugauggaccucagccagauguacagccccguguucgaguaccuguccggcgaccggcaggucgaggaguggcccaaggcgaccugcaccggggacugcccggagcgcugcggcugcacgaccuccacgugccugcacaaggaguggccccacucccggaacuggcgcugcaaccccaccuggugcuggggcgugggcaccggcugcacgugcugcgggcucgacgugaaggaccuguucaccgacuacaugaucgucaaguggaagguggaguacaucaagaccgaggccaucgugugcgucgagcugacgagccaggagcggcagugcucccucaucgaggccggcacccgcuucaaccuggggagcgugaccaucacccuguccgagccccggaacauccagcagaagcucccgcccgagaucaucacgcugcacccccgcaucgaggagggcuucuucgaccugaugcacguccagaaggugcucagcgcguccaccgugugcaagcugcagagcugcacccacgggguccccggcgaccuccagguguaccacgugggcaaccuccugaagggggacaaggucaacggccaccugauccacaagaucgagccgcaccucaacaccuccuggaugagcugggacgggugcgaccuggacuacuacugcaacaugggcgacuggcccuccugcaccuacacgggggugacccagcacaaccacgccagcuucgugaaccugcucaacaucgagaccgacuacaccaaguccuuccacuuccacagcaagcgggucacggcccacggcgacacgccccagcuggaccugaaggcccgccccaccuacggcgccggggagaucaccgugcucguggaggucgcggacauggaguucacgccgaagaagaucgagaucuccggccugaaguucgccagccugaccugcaccgggugcuacgccugcuccagcggcaucagcugcaaggugcggauccacguggacgagcccgacgagcucaccguccacgugaaguccgacgaccccgacguggucgccgccagcuccagccugauggcgcgcaagcuggaguucgggacggacuccaccuucaaggccuucagcgccaugcccaagaccucccucugcuucuacaucguggagcgggaguacugcaagagcugcuccaaggaggacacccagaagugcgugaacacgaagcuggagcagccgcagagcauccugaucgagcacaagggcaccaucaucggcaagcagaacaacacgugcaccgccaaggccuccugcuggcucgagagcgucaaguccuucuucuacgggcugaagaacaugcugagcggcaucuucgggaaccucuucaugggcaucuuccuguuccuggcgcccuucauccugcucauccuguucuucauguucggcuggcgcauccuguucugcuucaagugcugccggcgcacgcgcggccucuucaaguaccggcaccugaaggacgacgaggagaccggcuaccgccggaucaucgagcgccugaacaacaagaaggggaagaacaagcuccuggacggcgagcggcuggccgaccgccggaucgccgagcuguucuccaccaagacccacaucggguga

SEQ ID NO: 11926 - RNA, 5070 nt, Artificial Sequence
  derived and/or modified CDS sequence (opt1) from CCHFV(66019)__AB069669.1__GP
augcccgccaacaucauguacacccugcucgugugcgccguccugugcccgcagcuguggagccucgagggcacccacgugccccacaacgagacgaagcacaacgggaccggcaucaccgcggcccccggggagucccagggccccaugagcccggccuccaccgccgugccccugacgcccgagcccccgaacaccaagcccgccgcgagcgccuccgagcuggagagcuccggggagggccacaccagccuccuggccaccacgcagggccugaccucccccgaggccacccccgagcucccgaccacgaccgacaccggggucagcuccaccagcgugguggacaucggcacgcagauggcgaaggacacccccaccuccaccgcccacacgagccugcccuccaaccccagcgccccguccaccgcccaggggacccaccacaccauccgcggccugcucagcgucacguccaccaagcccgaggaggccagcacccccaccgaccccgggaaggcgggcgccgagacgggcagcccgcggcccgccaucucccgcaagcccacccugagccccaccgccgaggccccgaccgagaucaacaacuccagcacgcccaagcagcccgagcccuccauccagccggcgacccccagccuggugaucucccccgcccagccggccuucccccagagcgccaccuccaccgccgcgcaggacaucuacagcucccccacgaaccggagcaagcgcaaccucaagauggagaucauccugacccugucccaggggcucaagaaguacuacggcaagauccagaagacccuggggcugacccucgaggaggacaccgagggccugcuggaguggugcaagcggaaccucggccugacgugcgacgacaacuucuuccagaagcgcaucgaggaguucuuccugaccggggagggcuacuucaacgaggugcuccaguucaagacccccagcaccccgggguccacggagcccacccacaccgaggcccccaccgucaagcccuucaagagcuacuucgcccggggcuuccugacgaucgacuccggguacuucagcgccaagugcuacucccgcaccagcaacagcggccugcagcucaucaacgugacccagcacccggcccggaucgcggacacccccggccccaagaucacgaaccugaagaccaucaacugcaucaaccugaaggccuccguguucaaggagcaccgcgagaucgagaucaacguccuccugccccagguggccgugaaccugagcaacugccacguccucaucaagucccacgugugcgacuacagccuggacaucgacgggaccauccggcugccgcgcaucuaccacgagggcaccuucauccccgggacguacaagaucgugaucgacaagcgggacaagcagaacgaccgcugcacccucgucaccaacugcgugaucaagggccgggaggugcgccgggggcaguccgcccugcgccaguaccggaccgagauccgcaucggcaaggcgagcgccggcucccggcgccugcucagcgaggaguccggggacgacugcaucagccgcacgcagcugcugcggaccgagaccgccgagguccacggcgacaacuacgggggccccggggacaagaucaccaucugcaacggcuccacgaucguggaccagcgccucggcagcgagcuggggugcuacaccaucaaccgggugaaguccuucaagcugugcgagaacagcggcaccgggaaguccugcaagaucgacaacacccccgucaagugccgccagggcuucugccucaagaucacgcaggagggccgggggcacgugaagcugagccgcggcuccgaggucgugcuggacgccugcgacagcagcugcgagaucaugaucccgaaggggaccggcgacauccugguggacugcuccgggggccagcagcacuuccucaaggacaaccuggucgaccugggcugccccaacaucccccuccuggggaagauggccaucuacaucugccggaugagcaaccaccccaagaccaccauggcguuccuguucugguucuccuucggcuacgugaucacgugcaucuucugcaagaucaucuucuaccuccugaucguggucgggacccugggcaagaaguucaagcaguaccgcgagcucaagccgcagaccugcaccaucugcgagacgacccccaccaacgccaucgacgccgagaugcacgaccugaagugcagcuacaacaucugccccuacugcgccucccggcugaccagcgacgggcucgcccgccacgugacccagugccccaagcggaaggagaagguggaggagacggagcuguaccugaaccucgagcgcaucccguggaucguccggaagcugcugcagguguccgagagcaccggcguggcgcucaagcgcuccagcuggcugaucguccugcucgugcugcugaccgugucccucagccccguccaguccgcccccaucggccacgggaagaccaucgaggccuaccagacgcgggagggcuacaccagcgugugccuguucaugcuggggggcauccucuucguggucuccugccugaugaaggggcugguggacagcguguccaacagcuucuucccgggccucuccaucugcaagaccugcagcaucggcagcgucaacggguucgagaucgagucccacaagugcuacugcagccugcugugcugccucuacugccgccacugcuccgccgaccgggagauccaccagcugcaccugagcaucugcaagaagcgccgggccggcgggaacgugaugcucgcggugugcaagcgcaugugccugcgcgccaccauggaggucuccaacaaggugcuguucauccggagcaucaucaacacgaccuucgugaucugcauccucguccuggccgugugcaucguguccaccagcgccgucgagauggagucccugcccgcgggcaccugggagcgcgaggaggaccucacgaacuucugccaccaggagugccaggugaccgagaccgagugccugugccccuacgaggcccuggugcuccggaagccccuguucagcgacuccaucgucaaggggaugaagaaccugcucaacagcaccucccuggagacgagccuguccaucgaggccccguggggcgccaucaacgugcagagcaccuucaagcccaccguguccaccgccaacaucgcgcucagcugguccagcgucgagcaccgcggcaacaagauccuggugagcgggcgguccgagagcaucaugaagcuggaggagcgcacgggcaucuccugggaccucgggguggaggacgccagcgaguccaagcugcugaccgucagcgugauggaccucucccagauguacagccccguguucgaguaccuguccggcgaccggcaggucgaggaguggcccaaggccaccugcaccggcaacugcccggaccgcugcgggugcacgagcuccaccugccugcacaaggaguggccccacagccggaacuggcgcugcaaccccaccuggugcuggggcguggggaccggcugcacgugcugcgggcucgacgugaaggaccuguucaccgacuacauguucgucaaguggaagguggaguacaucaagaccgaggccaucgugugcgucgagcugaacucccaggagcggcagugcagccucaucgaggccggcacccgcuucaaccugggccccgugacgaucacccuguccgagccgcggaacauccagcagaagcuccccagcgagaucaucacccugcacccccgcaucgaggagggguucuucgaccugaugcacgugcagaagguccucuccgcgagcaccgugugcaagcugcaguccugcacgcacggcguccccggggaccugcagaucuaccacaucggcaaccuccugaagggggaccgggugaacggccaccugauccacaagaucgagccgcacuucaacaccagcuggaugagcugggacggcugcgaccucgacuacuacugcaacaugggggacuggcccuccugcaccuacaccggcgugacccagcacaaccacgccgccuucgucaaccugcugaacaucgagacggacuacaccaagaacuuccacuuccacagcaagcgcgugaccgcccacggggacaccccccagcucgaccugaaggcccggcccacguacggcgcgggggagaucaccgugcuggucgagguggccgacauggagcuccacaccaagaagaucgccaucuccggccugaaguucgccagccugaccugcacgggcugcuacgcgugcuccagcgggaucuccugcaaggugcgcauccacgucgacgagccggacgagcucaccgugcacgugaagagcgaggaccccgacaucgucgccgccuccagcucccugauggcccggaagcuggaguucggcaccgacagcaccuucaaggccuucuccgcgaugcccaagacgagccucugcuucuacaucguggagcgcgaguacugcgaguccugcagcaaggaggacacccagaagugcgugaacaccaagcuggagcagccccaguccauccugaucgagcacaaggggaccaucaucggcaagcagaacgacacgugcaccgccaaggccagcugcuggcucgaguccgucaagagcuucuucuacggccugaagaacaugcugagcgggaucuucggcaacguguucaucgggaucuuccucuuccuggccccguucauccugcugauccucuucuucauguucggcuggcggauccuguucugcuucaagugcugccgccgcacccgggggcuguucaaguaccgcuaccucaaggacgacgaggaguccggcuaccggcgcaucaucgagcggcugaacaacaagaagggcaagaacaagcugcucgacggggagcgccuggccgaccggcgcaucgcggagcuguucagcaccaagacgcacaucggcuga

SEQ ID NO: 11927 - RNA, 5070 nt, Artificial Sequence
  derived and/or modified CDS sequence (opt1) from CCHFV(BA8402)__AF350449.1__GP
augagcuucuccgugauguacacgccccugcucugcgccguccugugccugcagcucuggagccuggagggcucccacgggcugagcaacaagacccagcacuccaacaccagcaccaccaaggccccggaggugucccaggagcucggccugcccgugagcaccgucuccacgaucaccagcgagccgcccuccaucaccagcgcgguguccgugagcggguccgagggcagcggggacaccaacacguccccgagcgucaccacccagggccccacccugcccgagacgacccucgagccccugaccaccacggacaccgacgccuccagcaccgugguggucgacgugagcacccagacggugaaggacaccccgaucuccaccaccuacacgagccugcccuccacccccagcgagcccaccaccccgcagggcacgcaccacaccgcccgcgggcuccuguccgucaccagcaccaagcccgaggaggccagcccccaggccaaccccggcaagaucagcauggagacgaacgggccgcggcuggcgaucuccgagacccccagcuucucccccaccacccaggcccccacggagaacagcaacccgaucaccuccaagcagcucaugcugagcgcccagcccgugacccccaaccccaugaccuccccggugcagcccgcccugagccaguccgacaccagcacggcgauccaggacguccaccccucccccaccggccgcagcaagcggaaccucgagauggagaucauccugacccugagccaggggcucaagaaguacuacggcaagauccugaagcugcucgaccugacccuggaggaggacacggagggccuccuggaguggugcaagcgcaaccuggggcucgugugcgacgacaacuucuuccagaagcggaucgaggaguucuuccugaccggcaaggggcacuucaacgaggugcugcaguucaagaccccguccacccucagccccacgggccccgcccgcaccggcuccccgaccgucgagcccuucaagagcuacuucgccaagggguuccuguccauggacagcggcuacuucuccgccaagugcuacccccgggccagcaacuccgggcugcagcucaucaacgugacccagcacagcacgcgcaucaccgacacccccggcccgaagaucaccaaccugaagacgaucaacugcaucaaccugaaggcguccguguucaaggagcaccgggagaucgagaucaacguccuccugccccagguggccgugaaccugagcuccugccacguccucaucaagagccacgugugcgacuacucccuggacaucgacgggcccguccgccugccccggauccaccacgagggcaccuucaucccgggcaccuacaagaucgugaucgacaagaagaacaagcagaacgaccgcugcacccucgugacgaacugcgucaucaaggggcgggagauccgcaagggccagagcgugcugcggcaguaccgcaccgagaucaagaucgggaaggccuccagcggcagccggcgccugcucuccgaggagagcggggacgacugcaucucccggacccagcugcugcgcaccgagacggccgagauccacaacgacaacuacggcggccccggggacaagaucaccaucugcaacggcagcaccguggucgaccagcggcugggguccgagcucggcugcuacaccaucaaccgcgugaacagcuucaaccugugcgagaacacggccaccgggaaguccugcgagaucgacagcacccccgugaagugccgccagggcuucugccugaagaucacccaggagggccgggggcacgucaagcucucccgcggcagcgagguggugcuggacgcgugcgaguccagcugcgagaucaugauccccaaggggacgggcgacauccuggucgacugcuccggcgggcagcagcacuuccucaaggacaaccugaucgaccugggcugcccgaacaucccccuccuggggaagauggccaucuacaucugccggaugagcaaccaccccaagaccaccauggccuuccuguucugguucuccuucggcuacguggugaccugcauccucugcaaggucaucuucuaccugcugaucgugguggggacgcucggcaagaaguucaagcaguaccgcgagcugaagccccagaccugcaccaucugcgagaccaccccggucaacgccaucgacgccgagaugcacgaccugaacugcagcuacaacaucugccccuacugcgcgucccggcccacgagcgacggccucgcccgccacgugaugcagugccccaagcggaaggagaagaucgaggagaccgcccuguaccugaaccucgagcgcaucccgugggugguccggaagcugcuccagguguccgagagcaccgggguggcccucaagcgcagcuccuggcuggucgugcugcucgugcugcugaccgucagccucucccccgugcagagcgcccccaucggccacgggaagacgguggagaccuaccagacccgggagggcuacaccuccaucugccuguucguccuggggagcauccucuucaucguguccugccugaugaagggccugguggacagcgucggcaacuccuucuuccccgggcucagcaucugcaagacgugcuccaucggcagcgugaacggguucgagaucgagucccacaagugcuacugcagccuguucugcugcccguacugccgccacugcuccgcggaccgggagauccaccgccugcaccucagcaucugcaagaagcggaagaccggcuccaacgugaugcuggccgucugcaagcgcaugugcuuccgggccaccguggaggugagcaacaaggcccugcucauccgcaacaucaucaacaccacguucguccugugcauccugauccucgcggugugcguggucuccaccagcgccguggagauggagagccugcccgccgggaccugggagcgggaggaggaccugaccaacuucugccaccaggagugccaggugacggagaccgagugccucugccccuacgaggcccugguccugcgcaagccccucuucuccgacagcaucgugaagggcaugaagaaccugcugaacuccaccagccucgagaccucccugagcaucgaggcccccuggggcgcgaucaacgugcaguccacguucaagcccaccgucagcgccgccaacaucgcccuguccuggagcuccguggagcaccgcgggaacaagauccucgugagcggccgguccgagagcaucaugaagcuggaggagcgcaccgggaucuccugggaccugggcgucgaggacgccagcgaguccaagcuccugaccgugagcgucauggaccugucccagauguacagccccguguucgaguaccucagcggggaccgccagguggaggaguggccgaaggcgacgugcaccggcgacugccccgagcggugcggcugcaccuccagcacgugccugcacaaggaguggccccacucccggaacuggcgcugcaaccccaccuggugcuggggcgucgggaccgggugcacgugcugcggccuggacgugaaggaccucuucaccgacuacauguucaucaaguggaagguggaguacaucaagaccgaggccaucgucugcguggagcugaccagccaggagcggcagugcacccugaucgaggccggcacccgcuucaaccucgggccggugacgaucacccuguccgagccccggaacauccagcagaagcugccgcccgagaucgucacccuccacccccgcaucgaggagggcuucuucgaccugaugcacgugcagaaggugcugagcgccuccaccgucugcaagcuccagagcugcacccacggggugcccggcgaccuccagguguaccacaucgggaaccugcugaagggcgacaaggucaacggccaccugauccacaagaucgagccccacuucaacacguccuggaugagcugggacgggugcgaccugcacuacuacugcaacaugggcgacuggcccuccugcaccuacaccggggugacccagcacaaccacgccgcguucgugaacaugcucaacaucgagacggacuacaccaagaacuuccacuuccacagcaagcgggucaccgcccacggcgacaccccgcagcuggaccugaaggcccgccccacguacggggccggcgagaucaccgugcucguggaggucgcggacauggagcugcacaccaagaagaucgagaucuccggccugaaguucgccagccugaccugcacggggugcuacgccugcuccagcggcaucuccugcaaggugcggauccacguggacgagcccgacgagcugaccguccacgugaaguccgaggaccccgacaucguggccgccuccagcagccugauggcgcgcaagcucgaguucgggaccgacuccaccuucaaggccuucagcgccaugccgaagacgucccugugcuucuacaucgucgagcgggaguacugcgagagcugcuccaaggaggacacccagaagugcgugaacaccaagcuggagcagccccagagcauccucaucgagcacaagggcaccaucaucgggaagcaguccaacacgugcaccgccaaggccagcugcuggcuggaguccgucaagagcuucuucuacggccugaagaacaugcuguccggcaucuucgggaacguguucaucggcguguuccucuucuucgcgcccuucauccugcugauccucuucuucauguucggguggcgcauccuguucugcuucaagugcugccggcgcacccggggccuguucaaguaccgccaccucaaggacgacgaggagaccggcuaccggaagaucaucgagcgccugaacaacaagaaggggaagaacaagcugcucgacggcgagcgccuggccgaccggaagaucgccgagcuguucagcacgaagacccacaucggguga

SEQ ID NO: 11928 - RNA, 5070 nt, Artificial Sequence
  derived and/or modified CDS sequence (opt1) from CCHFV(BA66019)__AF350448.1__GP
augcccgccaacaucauguacacccugcucgugugcgccguccugugcccgcagcuguggagccucgagggcacccacgugccccacaacgagacgaagcacaacgggaccggcaucaccgcggcccccggggagucccagggccccaugagcccggccuccaccgccgugccccugacgcccgagcccccgaacaccaagcccgccgcgagcgccuccgagcuggagagcuccggggagggccacaccagccuccuggccaccacgcagggccugaccucccccgaggccacccccgagcucccgaccacgaccgacaccggggucagcuccaccagcgugguggacaucggcacgcagauggcgaaggacacccccaccuccaccgcccacacgagccugcccuccaaccccagcgccccguccaccgcccaggggacccaccacaccauccgcggccugcucagcgucacguccaccaagcccgaggaggccagcacccccaccgaccccgggaaggcgggcgccgagacgggcagcccgcggcccgccaucucccgcaagcccacccugagccccaccgccgaggccccgaccgagaucaacaacuccagcacgcccaagcagcccgagcccuccauccagccggcgacccccagccuggugaucucccccgcccagccggccuucccccagagcgccaccuccaccgccgcgcaggacaucuacagcucccccacgaaccggagcaagcgcaaccucaagauggagaucauccugacccugucccaggggcucaagaaguacuacggcaagauccagaagacccuggggcugacccucgaggaggacaccgagggccugcuggaguggugcaagcggaaccucggccugacgugcgacgacaacuucuuccagaagcgcaucgaggaguucuuccugaccggggagggcuacuucaacgaggugcuccaguucaagacccccagcaccccgggguccacggagcccacccacgccgaggcccccaccgucaagcccuucaagagcuacuucgcccggggcuuccugaccaucaacuccggguacuucagcgccaagugcuacuccuggacgagcaacagcggccugcagcucaucaacgugacccagcacccggcgcgcaucgccgacacccccggccccaagaucaccaaccugaagacgaucaacugcaucaaccugaaggccuccguguucaaggagcaccgggagaucgagaucaacguccuccugccccagguggccgugaaccugagcaacugccacguccucaucaagucccacgugugcgacuacagccuggacaucgacgggaccauccgccugccgcggaucuaccacgagggcaccuucauccccgggaccuacaagaucgugaucgacaagcgcgacaagcagaacgaccggugcacgcucgucaccaacugcgugaucaagggccgcgaggugcggaaggggcaguccgcgcugcgccaguaccggaccgagauccgcaucggcaaggccagcgccggcucccggcgccugcucagcgaggaguccggggacgacugcaucagccggacccagcugcugcgcacggagaccgccgagguccacggcgacaacuacgggggccccggggacaagaucaccaucugcaacggcuccaccaucguggaccagcgccucggcagcgagcuggggugcuacacgaucaaccgggugaaguccuucaagcugugcgagaacagcggcaccgggaaguccugcaagaucgacaagcaccccgucaagugccgccagggcuucugccucaagaucacccaggagggccgggggcacgugaagcugagccgcggcuccgaggucgugcuggacgccugcgacagcagcugcgagaucaugaucccgaaggggaccggcgacauccugguggacugcuccgggggccagcagcacuuccucaaggacaaccuggucgaccugggcugccccaacaucccccuccuggggaagauggcgaucuacaucugccggaugagcaaccaccccaagacgaccauggccuuccuguucugguucuccuucggcuacgugaucacgugcaucuucugcaagaucaucuucuaccuccugaucguggucgggacccugggcaagaaguucaagcaguaccgcgagcucaagccgcagaccugcaccaucugcgagaccacccccacgaacgccaucgacgccgagaugcacgaccugaagugcagcuacaacaucugccccuacugcgccucccggcugaccagcgacgggcucgcgcgccacgugacccagugccccaagcggaaggagaagguggaggagaccgagcuguaccugaaccucgagcgcaucccguggaucguccggaagcugcuccagguguccgagagcaccggcguggcccugaagcgcuccagcuggcugaucguccugcucgugcugcugacggugucccucagccccguccaguccgcccccaucggccacgggaagaccaucgaggccuaccagacccgggagggcuacaccagcgugugccuguucaugcucgggggcauccuguucguggucuccugccugaugaaggggcugguggacagcguguccaacagcuucuucccgggccucuccaucugcaagacgugcagcaucggcagcgucaacggguucgagaucgagucccacaagugcuacugcagccugcugugcugccucuacugccgccacugcuccgccgaccgggagauccaccagcugcaccugagcaucugcaagaagcgccgggcgggcgggaacgugaugcucgccgugugcaagcgcaugugccugcgggccaccauggaggucuccaacaaggugcuguucauccgcagcaucaucaacaccaccuucgugaucugcauccucguccuggccgugugcaucguguccacgagcgcggucgagauggagucccugcccgccggcaccugggagcgcgaggaggaccucaccaacuucugccaccaggagugccaggugaccgagacggagugccugugccccuacgaggcccuggugcuccggaagccccuguucagcgacuccaucgucaaggggaugaagaaccugcucaacagcaccucccuggagaccagccuguccaucgaggccccguggggcgccaucaacgugcagagcaccuucaagcccacgguguccaccgcgaacaucgcccucagcugguccagcgucgagcaccgcggcaacaagauccuggugagcgggcgguccgagagcaucaugaagcuggaggagcgcaccggcaucuccugggaccucgggguggaggacgccagcgaguccaagcugcugaccgucagcgugauggaccucucccagauguacagccccguguucgaguaccuguccggcgaccggcaggucgaggaguggcccaaggccacgugcaccggcgacugcccggaccgcugcgggugcaccagcuccacgugccugcacaaggaguggccccacagccggaacuggcgcugcaaccccaccuggugcuggggcguggggaccggcugcacgugcugcgggcucgacgugaaggaccuguucaccgacuacauguucgucaaguggaagguggaguacaucaagaccgaggccaucgugugcgucgagcugaacucccaggagcggcagugcagccucaucgaggcgggcacccgcuucaaccugggccccgugaccaucacccuguccgagccgcggaacauccagcagaagcucccgcccgagaucaucacgcugcacccccgcaucgaggagggguucuucgaccugaugcacgugcagaagguccucagcgccuccaccgugugcaagcugcagagcugcacccacggcguccccggggaccugcagaucuaccacaucggcaaccuccugaagggggaccgggugaacggccaccugauccacaagaucgagccccacuucaacaccuccuggaugagcugggacggcugcgaccucgacuacuacugcaacaugggggacuggcccagcugcacguacaccggcgugacccagcacaaccacgccgccuucgucaaccugcugaacaucgagaccgacuacaccaagaacuuccacuuccacuccaagcgcgugacggcccacggggacacgccccagcucgaccugaaggcgcggccgaccuacggcgccggggagaucaccgugcuggucgagguggccgacauggagcuccacaccaagaagaucgccaucagcggccugaaguucgcgucccugaccugcaccggcugcuacgccugcagcuccgggaucagcugcaaggugcgcauccacgucgacgagcccgacgagcucaccgugcacgugaaguccgaggaccccgacaucgucgccgccagcuccagccugauggcccggaagcuggaguucggcacggacuccaccuucaaggcguucagcgccaugcccaagaccucccucugcuucuacaucguggagcgcgaguacugcgagagcugcuccaaggaggacacccagaagugcgugaacacgaagcuggagcagccgcagagcauccugaucgagcacaaggggaccaucaucggcaagcagaacgacacgugcaccgccaaggccuccugcuggcucgagagcgucaaguccuucuucuacggccugaagaacaugcugagcgggaucuucggcaacguguucaucgggaucuuccucuuccuggcccccuucauccugcugauccucuucuucauguucggcuggcggauccuguucugcuucaagugcugccgccggacccgcgggcuguucaaguaccgcuaccucaaggacgacgaggagagcggcuaccggcgcaucaucgagcggcugaacaacaagaagggcaagaacaagcugcucgacggggagcgccuggcggaccggcgcaucgccgagcuguucuccaccaagacccacaucggcuga

SEQ ID NO: 11929 - RNA, 5070 nt, Artificial Sequence
  derived and/or modified CDS sequence (opt1) from CCHFV(BA88166)__AF338470.1__GP
augagcuucuccgugauguacacgccccugcucugcgccguccugugccugcagcucuggagccuggagggcucccacgggcugagcaacaagacccagcacuccaacaccagcaccaccaaggccccggaggugucccaggagcucggccugcccgugagcaccgucuccacgaucaccagcgacccgcccuccaucaccagcgcgguguccgugagcggguccgagggcagcggggacaccaacacgucccccagcgucaccacccagggccccacccugcccgagacgacccucgagccccugaccaccacggacaccgacgccuccagcaccgugguggucgacgugagcacccagacggugaaggacaccccgaucuccaccaccuacacgagccugcccuccacccccagcgagcccaccaccccgcagggcacgcaccacaccgcccgcgggcuccuguccgucaccagcaccaagcccgaggaggccuccacgcaggccaaccccggcaagaucagcauggagaccaacagcccccggcuggcgaucagcgagaccccguccuucagccccaccacgcaggcccccaccgagaacuccaaccccaucaccagcaagcagcucaugcuguccgcccagccggugacccccaaccccaugaccagccccgugcagccggcccugucccagagcgacacguccaccgcgauccaggacauccaccccagccccaccgggcgcagcaagcggaaccucgagauggagaucauccugacccugucccagggccucaagaaguacuacgggaagauccugaagcugcucgaccugacgcuggaggaggacaccgagggccuccuggaguggugcaagcgcaaccugggccucgucugcgacgacaacuucuuccagaagcggaucgaggaguucuuccugaccgggaagggccacuucaacgaggugcugcaguucaagacccccagcacgcucuccccgaccgggcccgcccgcaccggcagccccaccguggagccguucaaguccuacuucgccaagggcuuccugagcauggacuccggguacuucagcgccaagugcuacccccgggccuccaacagcggccugcagcucaucaacgucacgcagcacuccacccgcaucaccgacacccccgggcccaagaucacgaaccugaagaccaucaacugcaucaaccugaaggcgagcguguucaaggagcaccgggagaucgagaucaacgugcuccugccgcaggucgccgugaaccuguccagcugccacgugcucaucaagucccacgucugcgacuacagccuggacaucgacggccccgugcgccugccccggauccaccacgaggggaccuucauccccggcaccuacaagaucgucaucgacaagaagaacaagcagaacgaccgcugcacgcucgugaccaacugcgugaucaagggccgggagauccgcaaggggcaguccguccugcggcaguaccgcaccgagaucaagaucggcaaggccagcagcgggucccggcgccugcucagcgaggaguccggcgacgacugcaucagccggacccagcugcugcgcacggagaccgccgagauccacuccgacaacuacgggggcccgggcgacaagaucaccaucugcaacgggagcaccgugguggaccagcggcugggcuccgagcucgggugcuacacgaucaaccgcgucaagagcuucaagcugugcgagaacuccgccaccggcaagagcugcgagaucgacuccacccccgugaagugccgccagggguucugccugaagaucacccaggagggccggggccacgugaagcucagccgcggguccgaggucgugcuggacgcgugcgacagcuccugcgagaucaugauccccaagggcacgggggacauccugguggacugcagcggcggccagcagcacuuccucaaggacaaccugaucgaccuggggugccccaacaucccgcuccugggcaagauggccaucuacaucugccggauguccaaccaccccaagaccaccaugggguuccuguucugguucagcuucggcuacgucgugaccugcauccucugcaaggggaucuucuaccugcugaucguggucggcacgcucggcaagaaguucaagcaguaccgcgagcugaagccccagaccugcaccaucugcgagaccacccccgugaacgccaucgacgccgagaugcacgaccugaacugcuccuacaacaucugcccguacugcgccagccggcucacgagcgacgggcuggcgcgccacgugaugcagugccccaagcggaaggagaagaucgaggagaccgagcuguaccucaaccuggagcgcauccccugggucgugcggaagcugcuccagguguccgagagcaccggcgucgcccugaagcgcuccagcuggcugguggugcuccugguccugcucaccgugucccugagccccgugcaguccgccccgaucgggcacggcaagacggucgagaccuaccagacccgggagggguacaccagcaucugccuguucgugcucggcuccauccuguucaucgugagcugccugaugaagggccucgucgacuccguggggaacagcuucuuccccggccuguccaucugcaagacgugcagcaucggguccgugaacggcuucgagaucgagagccacaagugcuacugcucccuguucugcugccccuacugccgccacugcagcgccgaccgggagauccaccgccuccaccuguccaucugcaagaagcggaagaccuggagcaacgucaugcuggccgugugcaagcgcaugugcuuccgggcgaccguggaggucagcaacaaggcccuccugauccgcaacaucaucaacaccacguucgugcugugcauccucauccuggccgugugcgucguguccaccagcgccguggagauggagucccugcccgcggggaccugggagcgggaggaggaccucaccaacuucugccaccaggagugccaggucacggagaccgagugccugugcccguacgaggcccuggugcuccgcaagccccuguaccuggacagcaucgugaagggcaugaagaaccuccugaacuccaccagccuggagaccucccucagcaucgaggcccccuggggcgccaucaacguccaguccacguucaagccgaccaugagcgccgcgaacaucgcccuguccuggagcuccguggagcaccgcgggaacaagauccuggugagcggccgguccgagagcaucaugaagcucgaggagcgcaccgggaucuccuggaaccugggcgucgaggacgccagcgaguccaagcugcucaccgugagcgugauggaccugagccagauguacucccccgucuucgaguaccugagcggggaccgccagguggaggaguggcccaaggccacgugcaccggcgacugccccgagcggugcggcugcaccuccagcacgugccuccacaaggaguggccgcacucccggaacuggcgcugcaaccccaccuggugcuggggcgucgggaccgggugcacgugcugcggccuggacgugaaggaccuguucaccgacuacauguucaucaaguggaagguggaguacaucaagaccgaggccaucgucugcguggagcucaccagccaggagcggcagugcacccugaucgaggcgggcacccgcuucaaccuggggcccgugaucaucacgcucuccgagccccggaacauccagcagaagcugccgcccgagaucgucacccugcacccccgcaucgaggagggcuucuucgaccucaugcacgugcagaaggugcugagcgccuccaccgucugcaagcugcagagcugcacccacggggugcccggcgaccuccagguguaccacaucgggaaccugcugaagggcgacaaggucaacggccaccucauccacaagaucgagccgcacuucaacaccuccuggaugagcugggacgggugcgaccuggacuacuacugcaacaugggcgacuggcccuccugcacguacaccggggugacccagcacaaccacgccgccuucgugaacaugcugaacaucgagaccgacuacacgaagaacuuccacuuccacagcaagcgggucaccgcccacggcgacacgccccagcucgaccugaaggcgcgccccaccuacggggccggcgagaucaccgugcugguggaggucgccgacauggagcuccacaccaagaagaucgagaucuccggccugaaguucgccagccugaccugcaccgggugcuacgcgugcuccagcggcaucuccugcaaggugcggauccacguggacgagccggacgagcucacgguccacgugaaguccgaggaccccgacaucguggccgccagcuccagccugauggcccgcaagcuggaguucgggaccgacuccaccuucaaggccuucagcgcgaugcccaagaccucccucugcuucuacaucgucgagcgggaguacugcaagagcugcuccaaggaggacacgcagaagugcgugaacaccaagcuggagcagccccagagcauccugaucgagcacaagggcaccaucaucgggaagcagaacaacacgugcaccgccaaggccuccugcuggcuggagagcgugaaguccuucuucuacggccucaagaacaugcugagcggcaucuucgggaacgucuucaucggcguguuccuguucuucgccccguucauccuccugauccuguucuucauguucggguggcgcauccucuucugcuucaagugcugccggcgcacccggggccuguucaaguaccgccaccugaaggacgacgaggagaccggcuaccggaagaucaucgagcgccucaacaacaagaaggggaagaacaagcugcuggacggcgagcgccucgccgaccggaagaucgcggagcuguucuccaccaagacgcacaucggguga

SEQ ID NO: 11930 - RNA, 5070 nt, Artificial Sequence
  derived and/or modified CDS sequence (opt1) from CCHFV(UCCR4459)__KY484032.1__GP
augagcuucuccaucauguacacgccccuccucugcgccgugcugugccugcagcucuggagccuggagggcucccacgggcugagcaacaagacccagcacuccaacaccagcaccaccaaggccccggaggucucccaggaguucggccuccccgugagcaccguguccacgaucaccagcgacccgcccuccaucaccagcgcggucuccgugagcggguccgagggcagcggggacaccaacacgucccccagcgugaccacccagggccugacccugcccgagacgacccucgagcugcugaccaccacggacaccgacgccuccagcaccgucgugguggacgucagcacccagacggugaaggacacccccaucuccaccacccacacgagccuccccuccaccccgagcgccaccaccacgccccagggcacccaccacaccgcccgcgggcugcuguccgugaccagcacgaagcccgagggcgccuccacccaggcgaaccccgagaagaucagcauggagaccaacuccccgcggcucgccaucagcgagacccccuccuucagccccacgacccaggcccccaccgagaacuccaacccgaucaccagcaagcagcugaucuucuccgcccagcccgucacccccaaccccgugacgccgcccgugcagcccgcgcugagccaguccgacaccagcaccgccauccaggacauccaccccuccccgaccagccgcagcaagcggaaccucgagauggagaucauccugacgcugucccaggggcucaagaaguacuacggcaagauccugaagcugcucgaccugacccuggaggaggacaccgaggggcuccuggaguggugcaagcgcaaccugggccucgucugcgacgacgacuucuuccagaagcggaucgaggaguucuuccugaccggcgaggggcacuucaacgaggugcugcaguucaagacgcccagcacccucucccccaccggccccgcccgcaccgggagcccgacgguggagcccuucaaguccuacuucgccaagggcuuccugagcauggacuccggcuacuucagcgccaagugcuacccccgggcguccaacagcgggcugcagcucaucaacgucacccagcacuccacccgcaucaccgacacgccgggccccaaggugaccaaccugaagaccaucaacugcaucaaccugaaggccagcguguucaaggagcaccgggagaucgagaucaacguccuccugccccagguggccgugaaccuguccagcugccacguccucaucaagucccacgugugcgacuacagccuggacaucgacgggcccguccgccugccgcggauccaccacgagggcaccuucauccccgggacguacaagcucgugaucgacaagaagaacaagcagaacgaccgcugcacccugaucaccaacugcgugaucaagggccgggagauccgcaagggccaguccguccugcggcaguaccgcaccgagaucaagaucgggaaggccagcagcggcucccggcgccuccugagcgaggaguccggggacgacugcaucagccggacgcagcugucccgcaccgagaccgccgagauccacagcgacaacuacggcgggcccggcgacaagaucaccaucugcaacggcuccacgaucguggaccagcggcuggggagcgagcucggcugcuacaccaucaaccgcgugaaguccuucaagcugugcgagaacagcgcgaccgggaaguccugcgagaucgacagcacccccaucaagugccgccagggcuucugccugaagaucacgcaggaggggcggggccacgucaagcucucccgcggcagcgagguggugcuggacgccugcgacuccagcugcgagaucaugaucccgaaggggaccggcgacauccuggucgacugcuccgggggccagcagcacuuccucaaggacaaccugaucgaccugggcugccccaacaucccccuccuggggaagauggccaucuacaucugccggaugagcaaccaccccaagaccaccauggccuuccuguucugguucuccuucggcuacgugaucacgugcauccucugcaaggugaucuucuaccugcugaucgucguggggacccucggcaagaaguucaagcaguaccgcgagcugaagccgcagaccugcaccaucugcgagaccacgcccgugaacgccaucgacgcggagaugcacgaccugaacugcagcuacaacaucugccccuacugcgccagccggcucaccuccgacgggcuggcccgccacgucaugcagugccccaagcggaaggagaagguggaggagaccgagcuguaccucaaccuggagcgcaucccgugggugguccggaagcugcuccaggugagcgaguccaccggcguggcccugaagcgcagcuccuggcuggucgugcuccuggugcugcucacggucagccugucccccgugcagagcgcccccaucggccacgggaagaccguggagaccuaccagacccgggagggcuacacguccaucugccuguucguccucgggagcauccuguucaucguguccugccugaugaagggccucguggacagcgucgggaacuccuucuuccccggccugagcaucugcaagaccugcuccaucggcagcaucaacggguucgagaucgagucccacaagugcuacugcagccuguucugcugcccguacugccgccacugcuccgcggaccgggagauccacaagcuccaccugagcaucugcaagaagcgcaagaccggcagcaacgugaugcuggccgugugcaagcggaugugcuuccgcgccaccgucgagguguccaacaaggcccuccugauccggaacaucaucaacacgaccuucguggucugcauccugauccucgcggugugcguggucagcaccuccgccguggagauggagagccugcccgccgggaccugggagcgcgaggaggaccugacgaacuucugccaccaggagugccaggugaccgagaccgagugccucugccccuacgaggcccugguccugcggaagccccucuucuccgacagcaucgugaagggcaugaagaaccugcugaacuccaccagccucgagacgucccugagcaucgaggccccguggggcgcgaucaacgugcaguccaccuucaagcccaccgucagcgccgccaacaucgcccuguccuggagcuccguggagcaccgcgggaacaagauccucgugagcggccgcuccgagagcaucaugaagcuggaggagcggaccgggaucuccugggaccugggcgucgaggacgccagcgagagcaagcuccugacgguguccaucauggaccugagccagauguacucccccguguucgaguaccucagcggggaccgccaggucgaggaguggccgaaggcgaccugcaccggcgacugccccgagcggugcgggugcaccuccagcacgugccugcacaaggaguggccccacucccgcaacuggcggugcaaccccaccuggugcuggggcgugggcaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggcccggugacgaucacccugagcgagccccgcaacauccagcagaagcugccgcccgagaucgucacccuccacccccggaucgaggagggcuucuucgaccugaugcacgugaagaaggugcuguccgccagcaccgucugcaagcuccaguccugcacccacggggugcccggcgaccuccagguguaccacaucgggaaccugcucaagggcgacaaggucaacgggcaccugauccacaagaucgagccccacuucaacacgagcuggauguccugggacggcugcgaccuggacuacuacugcaacaugggcgacuggcccagcugcuccuacaccggggugacccagcacaaccacgccgcguucgugaacaugcucaacaucgagaccgacuacacgaagaucuuccacuuccacagcaagcgcgucaccgcccacggcgacaccccgcagcuggaccugaaggcccggcccaccuacggggccggcgagaucacggugcucguggaggucgcggacauggagcugcacaccaagaagaucgagaucuccgggcugaaguucgccagccugaccugcaccggcugcuacgccugcagcuccggcaucagcugcaaggugcgcauccacguggacgagcccgacgagcugacgguccacgugaaguccgaggaccccgacaucguggccgccagcuccagccugauggcgcggaagcucgaguucgggaccgacuccaccuucaaggccuucagcgccaugccgaagaccucccugugcuucuacaucgucgagcgcgaguacugcaagagcugcuccaaggaggacacgcagaagugcgugaacaccaagcuggagcagccccagagcauccucaucgagcacaagggcaccaucaucgggaagcagaacgacacgugcaccuccaaggccggcugcuggcuggagagcgugaaguccuucuucuacgggcugaagaacaugcugagcggcaucuucggcaacgucuucaucgggaucuuccucuuccuggcccccuucauccugcucauccuguucuucauguucggcuggcggauccuguucugcuucaagugcugccgccggacccgcggccucuucaaguaccggcaccugaaggacgacgaggagaccggguaccgcaagaucaucgagcggcugaacaacaagaagggcaagaacaagcuccuggacggggagcgccuggcggaccgcaagaucgccgagcuguucuccaccaagacgcacaucggcuga

SEQ ID NO: 11931 - RNA, 5070 nt, Artificial Sequence
  derived and/or modified CDS sequence (opt1) from CCHFV(K168_125)__KX013460.1__GP
augcccaucagcaccaugcacaucucccugaugugcgccgugcucugccugcagcuguacggccucgggggcacccacgggcugcacaacggcacggagcacaacaagaccaacgccgucaccaccagcuccaacagccaguccagcgaguccccggcgcgcacggccccgcccgugacccccgacagccccaccgugacccccacgacccccgccuccgcccccgaggggagcggcgaggcccacuccagcccgcccaacaacaccgagggccccucccugcccgagagcaccuccgagccgcccgcggccacgagcaccgggauccccuccgccagcgacgucaacuccagcacccaggccgcgcgggacaccagcacgcccaccgugcgcaccuccccgcccaacagccccuccaccccgcccacgccccaggagacccaccaccccgugcggaaccuccugagcgucaccucccacaagcccgaggagaccagcgccccguccgagagcggcaaggagucccccgccgccaacagcccccaccccguggccucccgcccgcccacgcccagcaccaccgcgcaggggccgaccgagaacaacaacuacaacacgaccggccagcuggagucccucacccagagcaccacgcuggggcccaugaccucccugacccagaccgaccucccccagagcgugacguccaucgccguccaggacacccaccccagcccgaccaaccgguccaagcgcaaccuggagauggagaucauccugacccucccccagggccugaagaaguacuacggcaaggugcugcggcuccugcagcugacccucgaggaggacacggaggggcugcuggaguggugcaagcgcaaccucggccuggacugcgacgacaccuucuuccagaagcggaucgaggaguucuucaucaccggggagggccacuucaacgaggugcugcaguuccgcacccccggcacgcucagcaccaccgagagcacccacgccgggcugcccacggccgagccguucaaguccuacuucgccaagggcuuccugagcaucgacuccggguacuucagcgcgaagugcuacucccggaccagcaacuccggccuccagcugaucaacgucacccgccacagcacccggaucgccgacacgcccgggcugaagaucaccaaccucaagaccaucuccugcaucaaccugaaggccagcguguucaaggagcaccgcgagguggagaucaacguccugcucccccagguggccgugaaccuguccaacugccacgucaccaucaagagccacgugugcgacuacucccuggacaucgacggcacggugcggcucccccacauccaccacgacggcaccuucaucccggggaccuacaagaucgucaucgaccgcaagaacaagcugaacgaccggugcacccuguucacgaacugcgugaucaagggccgcgaggugcggaaggggcagagcguccuccgccaguacaagaccgagauccggaucggcaaggccuccaccgggagccgccgccugcuguccgacgagagcggcgacgacugcaucagccggacccagcuccugcgcacggagaccgcggagauccacggcgacaacuacgggggccccggggacaagaucaccaucugcaacggcuccaccaucguggaccagcggcuggggagcgagcucggcugcuacacgaucaaccgcgucaaguccuucaagcugugcgagaacagcgccaccggcaaguccugcgagguggacagcauccccgugaagugccggcagggguacugccugaagaucacccaggagggccgcgggcacgucaagcugucccggggcagcgagguggugcucgacgccugcgacuccagcugcgaggucaugauccccaagggcaccggggacauccugguggacugcuccggcgggcagcagcacuuccugaaggacaaccucaucgaccugggcugcccgaaggugccccugcucgggaagauggccaucuacaucugccgcaugagcaaccaccccaagacgaccauggccuuccuguucugguucuccuucggcuacgucaucacgugcaucgugugcaaggcgaucuucuaccugcucaucaucgugggcacccuggggaagcgguucaagcaguaccgcgagcugaagccccagaccugcaccaucugcgagaccaccccgaccaacgccaucgacgccgagaugcacgaccucaacugcagcuacaacaucugccccuacugcgccucccggcugacgagcgacggccuggcgcgccacgucacccacugccccaagcggaaggagaagguggaggagaccgagcucuaccugaaccuggagcgcauccccugggugguccggaagcuccuccagguguccgagagcaccgggguggcccugaagcgcuccagcuggcugaucguccugcugguccucuucgccgugagccuguccccggugcagagcgcccccaucggccacgggaagacgaucgagaccuaccaggugcgggaggaguacaccuccaucugccuguucgugcucggcagcauccuguucaucgucuccugccugaugaagggccucgugaacagcguggggaacaucuucuuccccggccuguccaucugcaagaccugcagcaucggguccaucaacggcuucgagaucgagagccacaagugcuacugcucccugcucugcugcccguacugccgccacugcagcgccgaccgggagauccaccagcugcaccuguccaucugcaagaagcgcaagacggggagcaacgucaugcucgcggugugcaagcgcaugugcuuccgggccaccguggaggucuccaacaaggcccugagcauccgcuccaucaucaacaccaccuucguggugugcauccugauccucgccgucugcguggugagcacguccgccgucgagauggagagccugcccgcgggcaccugggagcgggaggaggaccugaccaacuucugccaccaggagugccaggugaccgagacggagugccucugccccuacgaggcccuggugcugcgccggccccucuuccuggacagcaucgucaagggcaagaagaaccugcucaacuccaccagccuggagaccucccugagcaucgaggccccguggggcgccaucaacgugcaguccaccuacaagcccacggugagcgccgcgaacaucgcccucuccuggagcuccgucgagcaccgcgggaacaagauccuggugagcgggcgguccgagagcaucaugaagcuggaggagcgcaccggcaucuccugggaccucgggguggaggacgccagcgaguccaagcugcugaccgucagcgugauggaccucucccagauguacagccccguguucgaguaccuguccggcgaccggcaggucgaggaguggcccaaggcgaccugcacgggcgacugcccggagcgcugcgggugcaccagcuccacgugccugcacaaggaguggccccacagccggaacuggcgcugcaaccccaccuggugcuggggcguggggaccggcugcacgugcugcggccucgacgugaaggaccuguucaccgacuacauguucgucaaguggaagguggaguacaucaagaccgaggccaucgucugcguggagcugaccagccaggagcggcagugcucccucaucgaggccgggacccgcuucaaccugggccccgugaccaucacccugagcgagccgcggaacauccagcagaagcucccgcccgagaucaucacgcugcacccccgcaucgaggagggguucuucgaccugaugcacguccagaaggugcucuccgccagcaccgugugcaagcugcaguccugcacccacggcguccccggggaccuccagguguaccacaucggcaaccugcugaagggcgacaaggugaacgggcaccugauccacaagaucgagccccacuucaacaccagcuggauguccugggacggcugcgaccucgacuacuacugcaacaugggggacuggcccagcugcaccuacacgggcgucacccagcacaaccacgccuccuucaucaaccugcugaacaucgagaccgacuacaccaagagcuuccacuuccacuccaagcgggugacggcccacggggacacgccccagcucgaccugaaggcgcgcccgaacuacggcgccggcgagaucaccgugcuggucgagguggccgacauggagcuccacaccaagaagaucgagaucagcgggcugaaguucgccucccugaccugcaccggcugcuacgccugcagcuccgggaucagcugcaaggugcggauccacgucgacgagcccgacgagcucaccgugcacgugaaguccgacgaccccgacgucguggcggccagcagcucccugauggcccgcaagcuggaguucggcaccgacagcacguucaaggccuucuccgccaugcccaagaccagccucugcuucuacaucguggagcgggaguacugcaaguccugcagcaaggaggacacccagaagugcgucaacaccaagcuggagcacccgcaguccauccugaucgagcacaaggggacgaucaucggcaagcagaacaacacgugcaccgcgaagaccagcugcuggcucgaguccgucaagagcuucuucuacggccugaagaacaugcuguccgggaucuucggcaacguguucguggggaucuuccucuuccuggcccccuucauccugcugauccucuucuucauguucggcuggcgcauccuguucugcuucaagugcugccgccggacccgcggccuguuccgguacaagcaccucgaggacgacgaggagaccggguaccgccggaucaucgagcgccugaacaacaagaagggcaagaacaagcugcucgacggggagcggcuggccgaccgccggaucgccgagcuguucagcaccaagacccacaucggcuga

SEQ ID NO: 11932 - RNA, 5070 nt, Artificial Sequence
  derived and/or modified CDS sequence (opt1) from CCHFV(K168_40)__KX013457.1__GP
augcccaucagcaccaugcacaucucccugaugugcgccgugcucugccugcagcuguacggccucgggggcacccacgggcugcacaacggcacggagcacaacaagaccaacgccgucaccaccagcuccaacagccaguccagcgaguccccggcgcgcacggccccgcccgugacccccgacagccccaccgugacccccacgacccccgccuccgcccccgaggggagcggcgaggcccacuccagcccgcccaacaacaccgagggccccucccugcccgagagcaccuccgagccgcccgcggccacgagcaccgggauccccuccgccagcgacgucaacuccagcacccaggccgcgcgggacaccagcacgcccaccgugcgcaccuccccgcccaacagccccuccaccccgcccacgccccaggagacccaccaccccgugcggaaccuccugagcgucaccucccacaagcccgaggagaccagcgccccguccgagagcggcaaggagucccccgccgccaacagcccccaccccguggccucccgcccgcccacgcccagcaccaccgcgcaggggccgaccgagaacaacaacuacaacacgaccggccagcuggagucccucacccagagcaccacgcuggggcccaugaccucccugacccagaccgaccucccccagagcgugacguccaucgccguccaggacacccaccccagcccgaccaaccgguccaagcgcaaccuggagauggagaucauccugacccucccccagggccugaagaaguacuacggcaaggugcugcggcuccugcagcugacccucgaggaggacacggaggggcugcuggaguggugcaagcgcaaccucggccuggacugcgacgacaccuucuuccagaagcggaucgaggaguucuucaucaccggggagggccacuucaacgaggugcugcaguuccgcacccccggcacgcucagcaccaccgagagcacccacgccgggcugcccacggccgagccguucaaguccuacuucgccaagggcuuccugagcaucgacuccggguacuucagcgcgaagugcuacucccggaccagcaacuccggccuccagcugaucaacgucacccgccacagcacccggaucgccgacacgcccgggcccaagaucaccaaccugaagaccaucuccugcaucaaccucaaggccagcguguucaaggagcaccgcgagguggagaucaacguccugcugccccagguggccgugaaccucuccaacugccacgucaccaucaagagccacgugugcgacuacucccuggacaucgacggcacggugcggcugccgcacauccaccacgacggcaccuucauccccgggaccuacaagaucgucaucgaccgcaagaacaagcucaacgaccggugcacccuguucacgaacugcgugaucaagggccgcgaggugcggaaggggcagagcguccugcgccaguacaagaccgagauccggaucggcaaggccuccaccgggagccgccgccuccuguccgacgagagcggcgacgacugcaucagccggacccagcugcuccgcacggagaccgcggagauccacggcgacaacuacgggggccccggggacaagaucaccaucugcaacggcuccaccaucguggaccagcggcuggggagcgagcugggcugcuacacgaucaaccgcgucaaguccuucaagcucugcgagaacagcgccaccggcaaguccugcgagguggacagcauccccgugaagugccggcagggguacugccugaagaucacccaggagggccgcgggcacgucaagcugucccggggcagcgagguggugcuggacgccugcgacuccagcugcgaggucaugaucccgaagggcaccggggacauccucguggacugcuccggcgggcagcagcacuuccugaaggacaaccugaucgaccucggcugccccaagaucccccugcuggggaagauggccaucuacaucugccgcaugagcaaccaccccaagacgaccauggccuuccucuucugguucuccuucggcuacgugaucacgugcaucgucugcaaggcgaucuucuaccugcugaucaucgugggcacccucgggaagcgguucaagcaguaccgcgagcugaagccgcagaccugcaccaucugcgagaccacccccaccaacgccaucgacgccgagaugcacgaccugaacugcagcuacaacaucugccccuacugcgccucccggcucacgagcgacggccuggcgcgccacgugacccacugccccaagcggaaggagaaggucgaggagaccgagcuguaccucaaccuggagcgcaucccguggguggugcggaagcugcuccaggucuccgagagcaccgggguggcccugaagcgcuccagcuggcugaucgugcuccugguccuguucgccgugagccucucccccgugcagagcgcccccaucggccacgggaagacgaucgagaccuaccagguccgggaggaguacaccuccaucugccuguucgugcugggcagcauccucuucaucguguccugccugaugaagggccuggucaacagcguggggaacaucuucuucccgggccucuccaucugcaagaccugcagcaucggguccaucaacggcuucgagaucgagagccacaagugcuacugcucccugcugugcugccccuacugccgccacugcagcgccgaccgggagauccaccagcuccaccuguccaucugcaagaagcgcaagacggggagcaacgugaugcuggcggucugcaagcgcaugugcuuccgggccaccguggagguguccaacaaggcccucagcauccgcuccaucaucaacaccaccuucgucgugugcauccugauccuggccgugugcgucgugagcacguccgccguggagauggagagccuccccgcgggcaccugggagcgggaggaggaccugaccaacuucugccaccaggagugccaggucaccgagacggagugccugugccccuacgaggcccucgugcugcgccggccgcuguuccucgacggcaucgugaaggggaugaagaaccugcugaacagcaccucccucgagaccagccuguccaucgaggcccccuggggcgccaucaacguccagagcaccuacaagcccacgguguccgccgcgaacaucgcccugagcugguccagcguggagcaccgcgggaacaagauccucgucuccggccggagcgaguccaucaugaagcuggaggagcgcaccgggaucagcugggaccugggcguggaggacgccuccgagagcaagcuccugaccguguccgucauggaccugagccagauguacucccccguguucgaguaccucagcggcgaccgccagguggaggaguggccgaaggcgaccugcacgggggacugccccgagcggugcggcugcaccuccagcacgugccugcacaaggaguggccccacagccggaacuggcgcugcaaccccaccuggugcuggggcgucgggaccggcugcacgugcugcgggcuggacgugaaggaccucuucaccgacuacauguucgugaaguggaaggucgaguacaucaagaccgaggccaucgugugcgucgagcugaccucccaggagcggcagugcagccugaucgaggccggcacccgcuucaaccucgggccggugaccaucacccuguccgagccccggaacauccagcagaagcugccgcccgagaucaucacgcuccacccccgcaucgaggagggcuucuucgaccugaugcacgugcagaagguccugagcgccuccaccgugugcaagcuccagagcugcacccacggggugcccggcgaccugcaggucuaccacaucggcaaccugcucaagggggacaaggugaacggccaccugauccacaagaucgagccccacuucaacaccuccuggaugagcugggacgggugcgaccuggacuacuacugcaacaugggcgacuggcccuccugcaccuacacgggggugacccagcacaaccacgccagcuucaucaaccuccugaacaucgagaccgacuacaccaaguccuuccacuuccacagcaagcgggucacggcccacggcgacaccccgcagcuggaccucaaggcgcgccccaacuacggcgccggggagaucaccgugcugguggaggucgccgacauggagcugcacaccaagaagaucgagaucuccggccucaaguucgccagccugacgugcaccgggugcuacgccugcuccagcggcaucuccugcaaggugcggauccacguggacgagcccgacgagcugaccguccacgucaagagcgacgaccccgacgugguggcggccuccagcagccucauggcccgcaagcuggaguucgggaccgacuccacguucaaggccuucagcgccaugccgaagaccucccugugcuucuacaucguggagcgggaguacugcaagagcugcuccaaggaggacacccagaagugcgugaacaccaagcucgagcacccccagagcauccugaucgagcacaagggcacgaucaucggcaagcagaacaacacgugcaccgcgaagaccuccugcuggcuggagagcgucaaguccuucuucuacgggcucaagaacaugcugagcggcaucuucgggaacguguucgugggcaucuuccuguuccucgcccccuucauccugcugauccuguucuucauguucggcuggcgcauccucuucugcuucaagugcugccgccggacccgcgggcuguuccgguacaagcaccuggaggacgacgaggagaccggcuaccgccggaucaucgagcgccucaacaacaagaaggggaagaacaagcugcuggacggcgagcggcucgccgaccgccggaucgccgagcuguucuccaccaagacccacaucggguga

SEQ ID NO: 11933 - RNA, 5070 nt, Artificial Sequence
  derived and/or modified CDS sequence (opt1) from CCHFV(K128_76)__KX013454.1__GP
augcccaucagcgugaugcacaucucccugaugugcgccguccucugccugcagcuguacggccucgggggcacccacgggagccacaacgagaccgagcacaacaagacgaacgccgugaccaccuccagcgacucccagagcccggagccccccacccgcacgacccugcccgugaccccggacucccccaccgucacgcccaccacccccgcgagcgccccggagggcuccggggaggugcacaccagcccccccaacacgaccgagggccccucccugccggagagcacccccgagccccccaccgccacguccaccggcaucccgagcgccuccgacgugaacagcuccacccaggccgcgcgggacaccagcacgcccaccguccacaccuccccccccaacagcccgagcaccccccccacgcuccaggagacccaccaccccaugcgcaaccugcuguccgugaccagccacaagccggaggagaccuccgcccccagcgaguccgggaaggagagccccgccgccaacuccccccacccgguggcggaccggcccagcacguccagcaccaccgcccagggccccaccgagaacaacuccuacaacacgaccgagcagcucgagagccugacccaguccaccacgcuggggccgaugaccagccucacccagaccguccugucccagagcgugaccuccaucgccgugcaggacacgcaccugagccccaccaaccgcuccaagcggaaccucgagauggagaucauccugacccugccccagggccucaagaaguacuacgggaagguccugcgccugcuccagcugacccuggaggaggacacggagggccuccuggaguggugcaagcggaaccuggaccucgacugcgacgacaccuucuuccagaagcgcaucgaggaguucuucaucaccggcgagggguacuucaacgaggugcugcaguuccggacccccggcacgcugagcaccaccgagagcacccacgccgggcucccgacggccgagcccuucaaguccuacuucgcgaagggcuuccugagcaucgacuccggcuacuucagcgccaagugcuacucccgcaccagcaacuccgggcugcagcucaucaacgugacccggcacagcacccgcaucgccgacacgcccggccccaagaucaccaaccugaagaccaucuccugcaucaaccugaaggccagcgucuucaaggagcaccgggagguggagaucaacgugcuccugccgcaggucgccgugaaccuguccaacugccacgugaccaucaagagccacgucugcgacuacucccucgacaucgacgggacggugaagcugccccacauccaccacgacggcaccuucauccccgggaccuacaagaucgugaucgaccgcaagaacaagcugaacgaccggugcacccucuucacgaacugcgucaucaagggccgcgaggugcggaagggccagagcguccugcgccaguacaagaccgagauccggaucgggaaggcguccaccggcagccgccggcugcucuccgacgagagcggggacgacugcaucagccgcacccagcugcugcgcacggagaccgccgagauccacggcgacaacuacgggggccccggcgacaagaucaccaucugcaacggguccaccaucguggaccagcggcucggcagcgagcuggggugcuacacgaucaaccgcgugaaguccuucaagcugugcgagaacagcgccaccggcaaguccugcgagaucgacagcaucccggucaagugccggcagggguacugccugaagaucacccaggagggccgcggccacgugaagcucucccgggggagcgaggugguccuggacgccugcgacuccagcugcgaggugaugauccccaagggcaccggggacauccugguggacugcuccggcggccagcagcacuuccucaaggacaaccugaucgaccuggggugccccaagaucccccuccugggcaagauggccaucuacaucugccgcaugagcaaccacccgaagacgaccauggcguuccuguucugguucuccuucggguacgucaucaccugcaucgugugcaaggccaucuucuaccuccugaucaucgugggcacccuggggaagcgguucaagcaguaccgcgagcucaagccccagaccugcacgaucugcgagaccacccccaccaacgccaucgacgccgagaugcacgaccugaacugcagcuacaacaucugccccuacugcgccucccggcugacgagcgacggccucgcgcgccacgucacccacugcccgaagcggaaggagaagguggaggagaccgagcuguaccugaaccucgagcgcauccccugggugguccggaagcugcugcagguguccgagagcaccggcguggcccucaagcgcuccagcuggcugaucguccugcucgugcuguucgccgugagccugucccccguccagagcgcccccaucucccacgggaagacgaucgagaccuaccaggugcgggaggaguacaccagcaucugccucuucgugcugggcuccauccuguucaucgucagcugccucaugaaggggcuggugaacuccgugggcaacaucuucuucccggggcugagcaucugcaagaccugcuccaucggcagcaucaacggcuucgagaucgagucccacaagugcuacugcagccuccugugcugccccuacugccgccacugcuccgcggaccgggagauccaccagcugcaccucagcaucugcaagaagcgcaagacgggguccaacgucaugcuggccgugugcaagcggaugugcuuccgcgccaccauggaggugagcaacaaggcccuguucauccgcuccaucaucaacaccaccuucgucgugugcauccucauccuggccgugugcgucgugagcacguccgcgguggagauggagagccugcccgccggcaccugggagcgggaggaggaccucaccaacuucugccaccaggagugccaggucaccgagacggagugccugugcccguacgaggcccuggugcuccgccggccccuguuccaggacagcaucgugaaggggaugaagaaccugcucaacuccaccagccuggagaccucccugagcaucgaggcccccuggggcgccaucaacguccaguccaccuacaagcccgcggugagcgccgccaacaucgcccucuccuggagcuccguggagcaccgcgggagcaagauccuggucuccggccggagcgaguccaucaugaagcuggaggagcgcacgggcaucagcugggaccucgggguggaggacgccuccgagagcaagcugcugaccguguccgucauggaccucagccagauguacuccccgguguucgaguaccugagcggcgaccggcagguggaggaguggcccaaggcgaccugcaccggggacugccccgagcgcugcggcugcacgagcuccaccugccugcacaaggaguggccccacagccggaacuggcgcugcaacccgaccuggugcuggggggucggcaccggcugcacgugcugcgggcucgacgugaaggaccuguucaccgacuacauguucgugaaguggaaggucgaguacaucaagaccgaggccaucgugugcgucgagcugaccucccaggagcggcagugcagccucaucgaggccggcacgcgcuucaaccuggggcccgugaccaucacccuguccgagccccggaacauccagcagaagcuccccccggagaucaucacccugcacccccgcaucgaggagggcuucuucgaccugaugcacgugcagaagguccucagcgccuccaccgugugcaagcugcagagcugcacgcacggcgugcccggggaccugcaggucuaccacaucggcaaccuccugaagggggaccgggugaacggccaccugauccacaagaucgagccccacuucaacaccuccuggaugagcugggacgggugcgaccucgacuacuacugcaacaugggcgacuggccguccugcaccuacaccggcgugacgcagcacaaccacgcgagcuucgucaaccugcugaacaucgagaccgacuacaccaaguccuuccacuuccacagcaagcgcgugaccgcccacggggacacgccccagcucgaccugaaggcccggcccaacuacggcgccggggagaucaccgugcuggucgagguggccgacauggagcuccacaccaagaagaucgagaucuccggccugaaguucgcgagccugaccugcacggggugcuacgccugcuccagcggcaucuccugcaaggugcgcauccacgucgacgagcccgacgagcucaccgugcacgugaagagcgacgacccggacgucguggccgccagcuccagccugauggcccggaagcuggaguucggcaccgacuccaccuucaaggcguucagcgccaugcccaagacgucccucugcuucuacaucguggagcgcgaguacugcaagagcugcuccaaggaggacacccagaagugcgucaacaccaagcuggagcagccccagagcauccugaucgagcacaaggggaccaucaucggcaagcagaacaacacgugcaccgccaagaccuccugcuggcucgagagcgugaaguccuucuucuacgggcugaagaacaugcugagcggcaucuucgggaacguguucgucggcaucuuccucuuccuggcccccuucauccugcugauccucuucuucauguucggcuggcggauccuguucugcuucaagugcugccgccgcacccgggggcuguuccgcuacaagcaccucgagaacgacgaggagacgggcuaccggcgcaucaucgagcggcugaacaacaagaaggggaagaacaagcugcucgacggcgagcgccuggccgaccggcgcaucgcggagcuguucuccaccaagacccacaucggcuga

SEQ ID NO: 11934 - RNA, 5070 nt, Artificial Sequence
  derived and/or modified CDS sequence (opt1) from CCHFV(Hodzha)__KX013448.1__GP
augcccgugagcaucaugcacauccugcucaugugcgccguccugugccugcagcaguacggccucggggagacccaccgcccgaacaacggcaccgagcacaacaagacgaacgugcugaccacccccuccgacaagcugagccccgagcccccgguguccaccgcccucagcgucacgcccgacuccagcaccgugacccccaccacgcccguguccgggcuggagggcagcggggaggucuacaccuccccgcccgugaccaccaagggccugagccccuccaaggcgacgagcgagcuccccgccaccaccggcaucgacaccuccagcgccuccgacguggacagcuccacgcaggccgcccgggacaccagcacccugaccguccgcacguccccgcccagcagccccuccacgcccccgaccagccaggacaccuaccaccuggugcggaaccuccuguccgugacgagcccccgccccgaggagaccaccgcgcccuccaagagcgggaaggaguccccggucgccaacagcccccaccccgugaccucccggcccagcuccccgcccaucacggugcagggccccaccgagaacagcucccacaacaccaccgggcagcuggagagcauggcccaguccacgacccucguccccauggccagcccgacccagaccgugcugucccagagcgugacgucccuggcgguccaggacgcccaccccagccccaccaaccgcagcaagcggaaccucgagauggagaucauccugacccugccgcagggccucaagaaguacuacgggaaggugcugcgccugcuccagcugacccuggaggaggacaccgagggccuccuggaguggugcaagcggaaccugggccucgacugcgacgacacguucuuccagaagcgcaucgaggaguucuucaucaccggggagggccacuucaacgaggugcugcaguucaagacccccuccacccugagcacgaccgaguccacccacgccgucagccccaccgccgagcccuucaaguccuacuucgccaagggguuccucagcaucgacuccggcuacuucagcgcgaagugcuacuccaagacgagcaacuccggccugcagcugaucaacgugacccggcacagcacccgcaucgccgacaccccggggcccaagaucacgaaccucaagaccaucuccugcaucaaccugaaggccagcguguucaaggagcaccgggaggucgagaucaacgugcugcucccccaggucgccgugaaccuguccaacugccacgugaccaucaagagccacgucugcgacuacucccuggacguggacggcaccgugcgccucccccacauccaccacgggggcacguucaucccggggaccuacaagaucgucaucgacaagaagaacaagcugaacgaccggugcacccuguacaccaacugcgugaucaagggccgcgaggugcggaagggccagagcauccuccgccaguacaagacggagauccggaucgggaaggccagcaccggcucccgccggcugcugagcgaggaguccggggacgacugcaucagccgcacccagcuccugcgcaccgagacggcggagauccacggcgacgacuacgggggccccggcgacaagaucaccaucugcaacggguccaccaucgucgaccagcggcugggcagcgagcuggggugcuacaccaucaaccgcgugaaguccuucaagcucugcgagaacagcgccacgggcaaguccugcgagaucgacagcacccccgugaagugccggcagggguacugccugaagaucacccaggagggccgcggccacgucaagcugucccgggggagcgagguggugcucgacgccugcgacuccagcugcgaggucaugauccccaagggcaccggggacauccugguggacugcuccggcggccagcagcacuuccugaaggacaaccucaucgaccuggggugcccgcgcaucccccugcucggcaagauggccaucuacaucugccggaugagcaaccaccccgagacgaccauggccuuccuguucugguucuccuucggguacgugaucacgugcauccugugcaaggcgaucuucuaccuccugaucaucgucggcacccuggggaagcgcuucaagcaguaccgggagcucaagccccagaccugcaccaucugcgagaccaccccggccaacgccaucgacgccgagaugcacgaccugaacugcagcuacaacaucugccccuacugcgccucccgccugaccagcgacggccucgcgcggcacgugacgcagugccccaagcgcaaggagaagguggaggagaccgagcuguaccugaaccucgagcggauccccuggaucguccgcaagcugcuccaggugagcgaguccaccggcguggcccugaagcggagcuccuggcugaucguccugcucgugcuguucgccgugagccuguccccgguccagagcgcccccaucgggcacggcaagaccaucgagacguaccaggcgcgcgaggaguacaccuccaucugccucuucgugcuggggagcauccuguucaucguguccugccucaugaagggccuggucgacagcaucgggaacaucuucuuccccggccugaccaucugcaagaccugcuccaucggcagcaucaacggguucgagaucgagucccacaagugcuacugcagccuccugugcugccccuacugccggcacugcccggccgaccgcgagauccaccagcugcaccucuccaucugcaagaagcggaagacgggcagcaacgugaugcuggccgugugcaagcgcaugugcuuccgcgccaccauggaggucuccaacaaggcccugcucauccggagcaucaucaacaccaccuucguggugugcauccugauccuggcggucugcgugguguccacgagcgccgucgagauggagagccuccccgccgggaccugggagcgcgaggaggaccugaccaacuucugccaccaggagugccaggugaccgagacggagugccugugccccuacgaggcccucgugcugcggcgcccgcuguuccucgacuccaucgucaagggcaagaagaaccugcugaacagcaccucccucgagaccagccuguccaucgaggcccccuggggcgcgaucaacgugcagagcaccuacaagcccacgguguccaccgccaacaucgcccugagcugguccagcgucgagcaccgggggaacaagauccucguguccggccgcagcgaguccaucaugaagcuggaggagcggaccgggaucagcugggaccugggcguggaggacgccuccgagagcaagcuccugaccgucuccgugauggaccugagccagauguacucccccguguucgaguaccucagcggggaccgccaggucgaggaguggccgaaggccacgugcaccggcgacugcagcgagcggugcgggugcaccuccagcacgugccugcacaaggaguggccccacucccgcaacuggcggugcaaccccaccuggugcuggggcgugggcaccgggugcacgugcugcggccuggacgucaaggaccucuucaccgacuacauguucgugaaguggaagguggacuacaucaagaccgaggcgaucgucugcguggagcugaccagccaggagcgccagugcucccugguggaggccgggacccgguucaaccucggccccgucaccaucacgcugagcgagccgcgcaacauccagcagaagcugccgcccgagaucaucacccuccacccccggaucgaggagggcuucuucgaccugaugcacgugcagaaggugcuguccgccagcaccgucugcaagcuccaguccugcacccacggggugcccggcgaccuccagguguaccacaucgggaaccugcugaagggcgacaaggucaacgggcaccugauccacaagaucgagccccacuucaacaccagcuggauguccugggacggcugcgaccuggacuacuacugcaacaugggcgacuggcccagcugcacguacaccggggugacccagcacaaccacgccuccuucgugaaccuccugaacaucgagaccgacuacaccaagagcuuccacuuccacuccaagcgcgucaccgcgcacggcgacacgccccagcuggaccucaaggcccggccgaccuacggggccggcgagaucaccgugcugguggaggucgccgacauggagcugcacaccaagaagaucgagaucaccgggcucaaguucgccagccugaccugcacgggcugcuacgcgugcuccagcggcaucuccugcaaggugcgcauccacguggacgagcccgacgagcugaccguccacgucaagagcgacgaccccgacgugguggccgccagcuccagccucauggcccggaagcuggaguucgggaccgacuccaccuucaaggccuucagcgcgaugcccaagacgucccugugcuucuacaucguggagcgcgaguacugcaagagcugcuccaaggaggacacccagaagugcgugaacaccaagcucgagcagccgcagagcauccugaucgagcagaagggcaccaucaucgggaagcagaacaacacgugcaccgccaaggccuccugcuggcuggagagcgucaaguccuucuucuacggccugaagaacaugcucagcgggaucuucggcaacguguucgugggcaucuuccuguuccuggcccccuucauccuccugauccuguucuucauguucggguggcggauccucuucugcuucaagugcugccgccgcacccggggccuguucaaguacaagcaccugaaggacgacgaggagaccggguaccgccggaucaucgagcgccucaacaacaagaagggcaagaacaagcugcuggacggcgagcggcucgccgaccgccggaucgcggagcuguucuccacgaagacccacaucggguga

SEQ ID NO: 11935 - RNA, 5070 nt, Artificial Sequence
  derived and/or modified CDS sequence (opt1) from CCHFV(Hy13)__AY900145.1__GP
augagcuucuccaucauguacacgccccugcucugcgccgugcugugccugcagcucuggagccuggagggcucccacgggcugagcaacaagacccagcacuccaacaccagcaccaccaaggccccggaggugucccaggaguucggccuccccgugagcaccguguccacgaucaccagcgacccgcccuccaucaccagcgcggucuccgugagcggguccgagggcagcggggacaccaacacgucccccagcgugaccacccagggccugacccugcccgagacgacccucgagcugcugaccaccacggacaccgacgccuccagcaccgucgugguggacgucagcacccagacggugaaggacacccccaucuccaccacccacacgagccuccccuccaccccgagcgccaccaccacgccccagggcacccaccacaccgcccgcgggcugcuguccgugaccagcacgaagcccgagggcgccuccacccaggcgaaccccgagaagaucagcauggagaccaacuccccgcggcucgccaucagcgagacccccuccuucagccccacgacccaggcccccaccgagaacuccaacccgaucaccagcaagcagcugaucuucuccgcccagcccgucacccccaaccccgugacgccgcccgugcagcccgcgcugagccaguccgacaccagcaccgccauccaggacauccaccccuccccgaccagccgcagcaagcggaaccucgagauggagaucauccugacgcugucccaggggcucaagaaguacuacggcaagauccugaagcugcucgaccugacccuggaggaggacaccgaggggcuccuggaguggugcaagcgcaaccugggccucgucugcgacgccgacuucuuccagaagcggaucgaggaguucuuccugaccggcgaggggcacuucaacgaggugcugcaguucaagacgcccagcacccucucccccaccggccccgcccgcaccgggagcccgacgguggagcccuucaaguccuacuucgccaagggcuuccugagcauggacuccggcuacuucagcgcgaagugcuacccccgggccuccaacagcgggcugcagcucaucaacgucacccagcacuccacccgcaucaccgacacgccgggccccaaggugaccaaccugaagaccaucaacugcaucaaccugaaggccagcguguucaaggagcaccgggagaucgagaucaacguccuccugccccagguggccgugaaccuguccagcugccacguccucaucaagucccacgugugcgacuacagccuggacaucgacgggcccguccgccugccgcggauccaccacgagggcaccuucauccccgggacguacaagcucgugaucgacaagaagaacaagcagaacgaccgcugcacccugaucaccaacugcgugaucaagggccgggagauccgcaagggccaguccguccugcggcaguaccgcaccgagaucaagaucgggaaggccagcagcggcucccggcgccuccugagcgaggaguccggggacgacugcaucagccggacgcagcugucccgcaccgagaccgcggagauccacagcgacaacuacggcgggcccggcgacaagaucaccaucugcaacggcuccacgaucguggaccagcggcuggggagcgagcucggcugcuacaccaucaaccgcgugaaguccuucaagcugugcgagaacagcgccaccgggaaguccugcgagaucgacagcacccccaucaagugccgccagggcuucugccugaagaucacgcaggaggggcggggccacgucaagcucucccgcggcagcgagguggugcuggacgccugcgacuccagcugcgagaucaugaucccgaaggggaccggcgacauccuggucgacugcuccgggggccagcagcacuuccucaaggacaaccugaucgaccugggcugccccaacaucccccuccuggggaagauggccaucuacaucugccggaugagcaaccaccccaagaccaccauggccuuccuguucugguucuccuucggcuacgugaucacgugcauccucugcaaggugaucuucuaccugcugaucgucguggggacccucggcaagaaguucaagcaguaccgcgagcugaagccgcagaccugcaccaucugcgagaccacgcccgugaacgcgaucgacgccgagaugcacgaccugaacugcagcuacaacaucugccccuacugcgccagccggcucaccuccgacgggcuggcccgccacgucaugcagugccccaagcggaaggagaagguggaggagaccgagcuguaccucaaccuggagcgcaucccgugggugguccggaagcugcuccaggugagcgaguccaccggcguggcccugaagcgcagcuccuggcuggucgugcuccuggugcugcucacggucagccugucccccgugcagagcgcgcccaucggccacgggaagaccguggagaccuaccagacccgggagggcuacacguccaucugccuguucguccucgggagcauccuguucaucguguccugccugaugaagggccucguggacagcgucgggaacuccuucuuccccggcagcuccaucugcaagaccugcagcaucggcuccaucaacggguucgagaucgagagccacaagugcuacugcucccuguucugcugcccguacugccgccacugcagcgccgaccgggagauccacaagcugcaccucagcaucugcaagaagcgcaagaccggcuccaacgugaugcuggccgugugcaagcggaugugcuuccgcgccaccgucgaggugagcaacaaggcgcugcucauccggaacaucaucaacacgaccuucguggucugcauccugauccuggccgugugcguggucuccaccagcgccguggagauggagucccuccccgccgggaccugggagcgcgaggaggaccugacgaacuucugccaccaggagugccaggccaccgagaccgagugccugugccccuacgaggcgcucgugcugcggaagccccuguucagcgacuccaucgucaagggcaugaagaaccuccugaacagcaccucccuggagacgagccucuccaucgaggccccguggggcgccaucaacgugcagagcaccuucaagcccaccguguccgccgccaacaucgcgcugagcugguccagcgucgagcaccgcgggaacaagauccugguguccggccgcagcgaguccaucaugaagcucgaggagcggaccgggaucagcugggaccugggcguggaggacgccagcgaguccaagcugcucacggucagcaucauggaccugucccagauguacagccccguguucgaguaccuguccggggaccgccagguggaggaguggccgaaggcgaccugcaccggcgacugccccgagcggugcgggugcaccagcuccacgugccuccacaaggaguggccccacagccgcaacuggcggugcaaccccaccuggugcuggggcgucggcaccgggugcacgugcugcggccuggacgugaaggaccuguucaccgaccacauguucgucaaguggaagguggaguacaucaagaccgaggccaucgugugcgucgagcucaccucccaggagcgccagugcagccugaucgaggccgggacccgguucaaccugggcccggugacgaucacccucuccgagccccgcaacauccagcagaagcugccgcccgagaucgugacccugcacccccggaucgaggagggcuucuucgaccucaugcacgucaagaaggugcugagcgccuccaccgugugcaagcugcagagcugcacccacgggguccccggcgaccuccagguguaccacaucgggaaccugcugaagggcgacaaggugaacgggcaccucauccacaagaucgagccccacuucaacacguccuggaugagcugggacggcugcgaccuggacuacuacugcaacaugggcgacuggcccuccugcagcuacaccggggucacccagcacaaccacgccgccuucgugaacaugcugaacaucgagaccgacuacacgaagaucuuccacuuccacuccaagcgcgugaccgcccacggcgacaccccgcagcucgaccugaaggcgcggcccaccuacggggccggcgagaucacgguccugguggagguggccgacauggagcuccacaccaagaagaucgagaucagcgggcugaaguucgccagccugaccugcaccggcugcuacgccugcuccagcggcaucuccugcaagguccgcauccacguggacgagcccgacgagcucacggugcacgucaagagcgaggaccccgacaucguggcggccuccagcucccugauggcccggaagcuggaguucgggaccgacagcaccuucaaggccuucuccgccaugccgaagaccagccucugcuucuacaucguggagcgcgaguacugcaaguccugcagcaaggaggacacgcagaagugcgucaacaccaagcuggagcagccccaguccauccugaucgagcacaagggcaccaucaucgggaagcagaacgacacgugcaccagcaaggcgggcugcuggcucgaguccgucaagagcuucuucuacgggcugaagaacaugcuguccggcaucuucggcaacguguucaucgggaucuuccuguuccucgcccccuucauccugcugauccucuucuucauguucggcuggcggauccuguucugcuucaagugcugccgccggacccgcgggcuguucaaguaccggcaccucaaggacgacgaggagaccggcuaccgcaagaucaucgagcggcugaacaacaagaagggcaagaacaagcugcucgacggggagcgccuggccgaccgcaagaucgccgagcuguucagcaccaagacgcacaucggcuga

SEQ ID NO: 11936 - RNA, 5070 nt, Artificial Sequence
  derived and/or modified CDS sequence (opt1) from CCHFV(SPU415/85)__DQ211635.1__GP
augcccgugaacaucauguacaccccgcuggucugcgccgugaucugccuccagcuguggaaccugggcgggacccucguguucaucaaccgcacgcagcacaacgagaccggcaccgucgccacccccgaggggacgcugcggccccgccugcccgugagcaccgcgcucccgaccaaguccgaccggcccagcgugggccccgccgccuccagcuccgggcuggagggcagcggcgagcccaacaccuccccgagcaucacgaccaaggggcugaccccccccgagaccacgcccgcccucccgaccgccaccgacaccgacgcguccagcacgggcgucguggacguguccacccagaugaccaaggacauccccaugagcaccgccuacacgaacccccccuccaccccgagcgcccccuccaccccccaggggacccaccacacggcccgcggccugcugagcgucgcguccaccaagagcgaggagguguccaugagcaccagccccgccaagaccuccacggagaccagcuccccgccccccgccaccagcgagacccccacgccgucccccaccacccaggugcccaccgggaacaacaaccccaacacgagccggcagccgacccccuccgcccagcccgccaugagcaacccggcgaccucccccgcccagcccaaccucagccaguccgcccccccgaccgccgaccagggcguccaccccagccccaccaaccgcuccaagcggaaccuggagaucgagaucauccugacgcucagccagggccugcgcaaguacuacgggaagauccugaagcuccuggaccugacccucgaggaggacaccgagggccugcuggaguggugcaagcggaaccucgggcugaccugcgacgacaacuucuuccagaagcgcaucgaggaguucuuccugacgggcgagggcuacuucaacgaggugcuccaguucaaggugcccuccacccugagcuccaccgagccgacccacacgcggccccccaccgucgagcccuucaagagcuacuucgccaagggguuccuguccaugaacagcggcuacuucagcgcgaagugcuacccgcgcaccuccaacagcgggcuccagcugaucaacgugaccaagcacuccgccaagaucgccgacacgcccggccccaagaucaccaaccugaagaccaucaacugcaucaaccuccgggccagcguguucaaggagcaccgcgaggucgagaucaacgugcugcugccccagguggccgucaaccucuccaacugccacgcgcagaucaagagccacgugugcgacuacucccuggccaccgacgggauggugcggcugccgcacauccaccacgagggcacguucauccccggcaccuacaagaucgucaucgacaagaagaacaagcagaacgaccgcugcacccucgugaccaacugcgucaucaaggggcgggaggugcgcaagggccagagcgcccugcggcaguacaagacggagauccgcaucgggaaggccuccagcggcucccggcgccugcucagcgaggaguccgacggggacugcaucagccgcacccagcugcugcggaccgagaccacggagauccacuccgacaacuacggcggccccggggacaagaucaccaucugcaacggcagcaccaucguggaccagcgccucggguccgagcugggcugcuacaccaucaaccgggucaagagcuucaagcugugcgagaacagcgccacggggaaguccugcgagaucgacagcacccccgugaagugccgccagggcuucugccucaagaucacccaggagggccgggggcacgugaagcugucccgcggcagcgagaucguccuggacgcgugcgacuccaacugcgagaucaugaucccgaaggggaccggcgacauccugguggacugcagcggcgggcagcagcacuuccucaaggacaaccugaucgaccugggcugccccaacaucccccuccuggggaagauggccaucuacaucugccggauguccaaccaccccaagacgaccauggccuuccuguucugguucagcuucggcuacgugaucaccugcauccucugcaaggucaucuucuaccugcugaucguggccgggaccgugggcaagaaguucaagcaguaccgcgagcuccggccgcagacgugcaccaucugcgagaccauccccgucaacgcgaucgacgccgagaugcacgaccugaacugcuccuacaacaucugccccuacugcgccagccgccugaccuccgacggccucgcccggcacgugaugcagugcccgaagcgcaaggagaagguggaggagaccgagcuguaccugaaccucgagcggauccccugggucgugcgcaagcugcugcaggugagcgaguccacgggggucgcccucaagcggagcuccuggcugaccgugcugcucgugcugcugaucgucagccucucccccgugcagagcgcgcccaucggccacgggaagaccaucgagaccuaccaggcccgcgagggcuacacguccuucugccuguucauccuggggagcauccucuucguggucagcugccuggugaagggccugaucgacuccgugggcaacagcuucuucccggggcucuccaucugcaagaccugcagcaucggcuccaucaacggguucgagaucgagagccacaagugcuacugcucccuguucugcugccccuacugccggcacugcagcgccgaccgcgagauccacaagcugcaccucuccaucugcaagaagcggaagaccggcagcaacgucaugcuggccgugugcaagcgcaugugcuuccgcgccaccaucgagguguccaaccgggcgcugcucauccgcaacaucaucaacacgaccuucgucgugugcauccugacccuggccgugugcgucgugagcaccuccgccguggagauggagagccuccccgccgggacgugggagaaggaggaggaccugaccaacuucugccaccaggagugccaggucaccgagaccgagugccugugccccuacgaggcccucgugcugcggaagccgcuguuccucgacuccaucgugaagggcaugaagaaccugcugaacagcacgucccucgagaccagccuguccaucgaggcgcccuggggcgccaucaacguccagagcaccuucaagcccaccgugagcgccgccaacaucgcgcuguccuggagcuccguggagcaccgcgggaacaagauccucgucagcggccgguccgagagcaucaugaagcuggaggagcgcacggggaucuccugggaccugggcguggaggacgccagcgaguccaagcuccugaccgugagcgucauggaccugucccagauguacagccccguguucgaguaccucuccggggaccggcagguggaggaguggccgaaggccaccugcaccggcgacugccccgagcgcugcggcugcacgagcuccaccugccugcacaaggaguggccccacagccggaacuggcgcugcaaccccaccuggugcuggggggucggcaccgggugcacgugcugcggccuggacgugaaggaccucuucaccgacuacauguucgugaaguggaaggucgaguacaucaagaccgaggccaucgugugcgucgagcugaccucccaggagcggcagugcagccugaucgaggccggcacgcgcuucaaccucgggccggugaccaucacccuguccgagccccggaacauccagcagaagcugccccccgagaucaucacccuccacccgcgcaucgaggagggcuucuucgaccugaugcacgugcagcggguccugagcgcgagcacggugugcaagcuccaguccugcacccacggggugcccggcgaccugcaggucuaccacaucgggaaccugcucaagggcgacaaggugaacggccaccugauccacaagaucgagccccacuucaacaccagcuggauguccugggacgggugcgaccuggacuacuacugcaacaugggcgacuggcccagcugcaccuacaccggggugacgcagcacaaccacgccgccuucgucaaccuccugaacaucgagaccgacuacaccaagaacuuccacuuccacuccaagcgcgugaccgcccacggcgacacgccgcagcuggaccucaaggcccggcccaccuacggggcgggcgaggugaccguccugguggagguggccgacauggagcugcacaccaagaagaucgagaucagcggccucaaguucgccucccugacgugcaccgggugcuacgccugcagcuccggcaucagcugcaaggucaagauccacguggacgagcccgacgagcugaccgugcacgucaaguccgaggaccccgacaucguggccgcggggagcucccucauggcccgcaagcuggaguucggcgccgacagcaccuucaaggccuucuccgcgaugccgaagacgagccugugcuucuacaucguggagcgggaguacugcaaguccugcagccgcgaggacacccggaagugcgucaacaccaagcucgaccgcccccaguccauccugaucgagcacaaggggaccaucaucggcaagcagaacaacacgugcaccgccaaggccagcugcuggcuggagagcgugaaguccuucuucuacggccucaagaacaugcugagcgggaucuucggcaacguguucaucgggaucuuccuguucaucgcccccuucguccuccugauccuguucuucauguucggcuggcgcauccuguucugcuucaagugcugccggcgcacccggggccucuucaaguaccgccaccugaaggacgacgaggagaccggguaccggaagaucaucgagcgccugaacaacaagaagggcaagaacaagcuccuggacggggagcggcuggccgaccgcaagaucgcggagcucuucuccacgaagagccacaucggcuga

SEQ ID NO: 11937 - RNA, 5070 nt, Artificial Sequence
  derived and/or modified CDS sequence (opt1) from CCHFV(SPU97/85)__DQ211633.1__GP
augaccgugaacaccgucugcacgccccucgugugcgccguguucugccuccagcuguggaaccugggcgggacccucgucccgaccaaccgcacccagcacaacaagacgggcaccauggccacccccgaggggacccugggcccccggcugcccgugagcacggcgcucccgaccaaguccgaccgccccagcguggggcccgccgcccccuccagcggccuggagggcuccggggagccgaacaccagccccuccaucaccacgaagggccuggcccuccccgagaccacccccgccccgcccaccgcgacggacaccgacgccagcuccaccggggucgugaacgugagcacccagaugacgaaggacauccccauguccaccgccuacaccaacccgcccagcacccccuccgcccccagcacgccccagggcacccaccacaccgcgcgggggcugcuguccgucgccagcaccaaguccgaggaggugagcauguccacgagcccgggcaagaccagcaccgagaccuccagcccgccgcccgccacguccgagacccccgcccccagccccaccacccaggcccccacgggcaacaacaaccccaacaccucccgccagcccacccccagcgcgcagccggccauguccaaccccaccaccagccccgcccagcccaaccuccugcagaacgccccgcccacggccgaccagggggugcaccccggccccaccaaccgguccaagcgcaaccuggagauggagaucauccucacccugagccaggggcugcggaaguacuacggcaagauccucaaguuccuggaccugacccucgaggaggacacggagggccugcuggaguggugcaagcgcaaccucgggcugaccugcgacgacaacuucuuccagaagcggaucgaggaguucuuccugaccggcgagggguacuucaacgagguccuccaguucaaggugccguccacccugagcuccacggagcccacccacaccggcagccccaccguggagcccuucaaguccuacuucgcgaagggguuccugagcaugaacuccggcuacuucagcgccaagugcuacccgcgcacguccaacagcggccuccagcugaucaacgucaccaagcacagcgccaagaucgccgacacccccgggcccaagaucaccaaccugaagacgaucaacugcaucaaccuccgggccuccguguucaaggagcaccgcgagguggagaucaacguccugcugccccagguggcggugaaccucagcaacugccacgcccagaucaagucccacgucugcgacuacagccuggccaccgacggcauggugcggcugccgcgcauccaccacgaggggaccuucauccccggcaccuacaagaucgugaucgacaagaagaacaagcagaacgaccggugcacgcucgucaccaacugcgugaucaaggggcgcgagguccggaagggccaguccgcccugcgccaguacaagaccgagauccggaucggcaaggccagcuccgggagccgccggcugcucuccgaggagagcgacggcgacugcaucucccgcacccagcugcugcgcacggagaccgcggagauccacagcgacaacuacgggggccccggggacaagaucaccaucugcaacggcuccaccaucguggaccagcggcucggcagcgagcuggggugcuacacgaucaaccgcgugaaguccuucaagcugugcgagaacagcgccaccggcaaguccugcgagaucgacagcacccccgucaagugccggcagggguucugccucaagaucacccaggagggccgcggccacgugaagcugagccggggguccgagaucgugcuggacgccugcgacagcuccugcgagaucaugaucccgaagggcacgggggacauccuggucgacugcagcggcgggcagcagcacuuccucaaggacaaccugaucgaccugggcugccccaacaucccccuccugggccgcauggccaucuacaucugccggauguccaaccaccccaagaccaccauggcguuccuguucugguucagcuucggguacgugaucacgugcauccucugcaaggugaucuucuaccugcugaucgucgccggcaccguggggaagaaguucaagcaguaccgcgagcuccggccgcagaccugcaccaucugcgagaccacccccgugaacgccaucgacgccgagaugcacgaccugaacugcuccuacaacaucugccccuacugcgccagccgccugacguccgacggccucgcgcggcacgucaugcagugcccgaagcgcaaggagaagaucgaggagaccgagcuguaccugaaccucgagcggauccccuggguggugcgcaagcugcugcaggucagcgaguccaccgggguggcccucaagcggagcuccuggcugaccgugcugcucguccugcugaucgugagccucucccccgugcagagcgcccccaucggccacggcaagacgaucgagaccuaccaggcccgcgagggguacaccuccuucugccuguucauccugggcagcauccucuucaucgucuccugccuggugaaggggcugaucgacagcgugggcaacagcuucuucccggggcucuccaucugcaagaccugcagcaucggcuccgucaacggcuucgagaucgagagccacaagugcuacugcucccuguucugcugccccuacugccggcacugcagcgccgaccgcgagauccacaagcugcaccucuccaucugcaagaagcggaagacggggagcaacgugaugcuggcggugugcaagcgcaugugcuuccgcgccaccaucgaggucuccaaccgggcccugcucauccgcagcaucaucaacaccaccuucgccgugugcauccugacgcuggccgugugcgucguguccaccagcgcgguggagauggagucccuccccgccggcaccugggagcgggaggaggaccugaccaacuucugccaccaggagugccaggucacggagaccgagugccugugccccuacgaggcccucgugcugcgcaagccgcuguuccucgacagcaucgugaaggggaagaagaaccugcugaacuccaccagccucgagaccucccugagcaucgaggcccccuggggcgcgaucaacguccaguccacguucaagcccaccgugagcgccgccaacaucgcccugagcugguccagcguggagcaccgggggaacaagauccucgucuccggccgcagcgaguccaucaugaagcuggaggagcggaccggcaucagcugggaccuggggguggaggacgccuccgagagcaagcuccugaccguguccgucauggaccugagccagauguacucccccguguucgaguaccucagcggcgaccgccagguggaggaguggccgaaggcgacgugcaccggggacugccccgagcggugcggcugcaccuccagcacgugccugcacaaggaguggccccacucccgcaacuggcggugcaaccccaccuggugcuggggcgucgggaccggcugcacgugcugcgggcuggacgugaaggaccucuucaccgacuacauguucgugaaguggaaggucgaguacaucaagaccgaggccaucgugugcguggagcugaccagccaggagcgccagugcucccugaucgaggccggcacccgguucaaccucgggccggucaccaucacgcugagcgagccccgcaacauccagcagaagcugccgcccgagaucaucacccuccacccccggaucgaggagggcuucuucgaccugaugcacgugcagaagguccuguccgccagcaccgugugcaagcuccagagcugcacccacggcgugcccggggaccugcaggucuaccacaucggcaaccugcucaagggggacaaggugaacggccaccugauccacaagaucgagccccacuucaacaccuccuggaugagcugggacgggugcgaccuggacuacuacugcaacaugggcgacuggcccuccugcacguacaccggcgugacccagcacaaccacgccgcguucgucaaccuccugaacaucgagaccgacuacacgaagaacuuccacuuccacagcaagcgcgugaccgcccacggggacaccccgcagcuggaccucaaggcccggcccaccuacggcgccggggaggugacgguccugguggagguggccgacauggagcugcacaccaagaagaucgagaucuccggccucaaguucgcgagccuguccugcaccgggugcuacgccugcagcuccggcaucagcugcaagguccgcauccacguggacgagcccgacgagcugaccgugcacgucaaguccgaggaccccgacaucguggccgccggcagcucccucauggcgcggaagcuggaguucggggccgacagcacguucaaggccuucuccgccaugccgaagaccagccugugcuucuacaucguggagcgcgaguacugcaaguccugcagccgggaggacacccagaagugcgucaacaccaagcucgagcgcccccaguccauccugaucgagcacaagggcacgaucaucgggaagcagaacgacacgugcaccgccaaggcgagcugcuggcuggagagcgugaaguccuucuucuacggccucaagagcaugcuguccggcaucuucgggaacguguucaucggcaucuuccuguucaucgcccccuucguccuccugauccuguucuucauguucggguggcgcauccuguucugcuucaagugcugccggcgcacccggggccucuucaaguaccgccaccugaaggacgacgaggagaccggguaccggaagaucaucgagcgccugaacaacaagaagggcaagaacaagcuccuggacggcgagcggcuggccgaccgcaagaucgccgagcuguucagcaccaagucccacaucggguga

SEQ ID NO: 11938 - RNA, 5070 nt, Artificial Sequence
  derived and/or modified CDS sequence (opt1) from CCHFV(C-68031)__DQ211629.1__GP
augagcuucuccaucauguacacgccccugcucugcgccgugcugugccugcagcucuggagccuggagggcucccacgggcugagcaacaagacccagcacuccaacaccagcaccaccaaggccccggaggucucccaggaguucggccuccccgugagcaccguguccacgaucaccagcgacccgcccuccaucaccagcgcggucuccgugagcggguccgagggcagcggggacaccaacacgucccccagcgugaccacccagggccugacccugcccgagacgacccucgagcugcugaccaccacggacaccgacgccuccagcaccgucgugguggacgucagcacccagacggugaaggacacccccaucuccaccacccacacgagccuccccuccaccccgagcgcccccaccacgccccagggcacccaccacaccgcccgcgggcugcuguccgugaccagcaccaagcccgagggcgccuccacgcaggcgaacccggagaagaucagcauggagaccaacagcccccggcucgccaucuccgagacccccuccuucagccccaccacgcaggccccgaccgagaacuccaaccccaucaccagcaagcagcugauccuguccgcccagcccgucacccccaacccggugaccccgcccgugcagcccgcgcucagccaguccgacacgagcaccgccauccaggacauccaccccucccccaccagccgcagcaagcggaaccuggagauggagaucauccugacccucucccaggggcugaagaaguacuacggcaagauccugaagcuccuggaccugacgcucgaggaggacaccgaggggcugcuggaguggugcaagcgcaaccucggccuggucugcgacgacgacuucuuccagaagcggaucgaggaguucuuccugaccggcgaggggcacuucaacgaggugcuccaguucaagacccccagcacgcugucccccaccggcccggcccgcaccgggagccccaccguggagcccuucaaguccuacuucgccaagggcuuccugagcauggacuccggcuacuucagcgccaagugcuacccgcgggcguccaacagcgggcuccagcugaucaacgucacgcagcacuccacccgcaucaccgacacccccggccccaaggugacgaaccugaagaccaucaacugcaucaaccucaaggccagcguguucaaggagcaccgggagaucgagaucaacguccugcugccccagguggccgugaaccucuccagcugccacguccugaucaagucccacgugugcgacuacagccuggacaucgacgggccgguccgccucccccggauccaccacgagggcaccuucauccccgggaccuacaagcuggugaucgacaagaagaacaagcagaacgaccgcugcacgcugaucaccaacugcgugaucaagggccgggagauccgcaagggccaguccguccuccggcaguaccgcaccgagaucaagaucgggaaggccagcagcggcucccggcgccugcugagcgaggaguccggggacgacugcaucagccggacccagcugucccgcacggagaccgccgagauccacagcgacaacuacggcgggcccggcgacaagaucaccaucugcaacggcuccaccaucguggaccagcggcucgggagcgagcugggcugcuacacgaucaaccgcgugaaguccuucaagcugugcgagaacagcgcgaccgggaaguccugcgagaucgacagcaccccgaucaagugccgccagggcuucugccucaagaucacccaggaggggcggggccacgucaagcugucccgcggcagcgagguggugcuggacgccugcgacuccagcugcgagaucaugauccccaaggggacgggcgacauccucgucgacugcuccgggggccagcagcacuuccugaaggacaaccugaucgaccucggcugccccaacaucccccugcuggggaagauggccaucuacaucugccggaugagcaaccacccgaagaccaccauggccuuccucuucugguucuccuucggcuacgugaucacgugcauccugugcaaggugaucuucuaccugcucaucgucguggggacccugggcaagaaguucaagcaguaccgcgagcugaagccccagaccugcaccaucugcgagaccacccccgugaacgccaucgacgcggagaugcacgaccucaacugcagcuacaacaucugccccuacugcgccagccggcugacguccgacgggcuggcccgccacgucaugcagugcccgaagcggaaggagaagguggaggagaccgagcucuaccugaaccuggagcgcauccccugggugguccggaagcuccuccaggugagcgaguccaccggcguggcccugaagcgcagcuccuggcucgucgugcugcuggugcuccugaccgucagccugucccccgugcagagcgcccccaucggccacgggaagacgguggagaccuaccagacccgggagggcuacaccuccaucugccucuucguccuggggagcauccuguucaucguguccugccucaugaagggccugguggacagcgucgggaacuccuucuucccgggccugagcaucugcaagacgugcuccaucggcagcaucaacggguucgagaccgagucccacaagugcuacugcagccucuucugcugccccuacugccgccacugcuccgcggaccgggagauccacaagcugcaccugagcaucugcaagaagcgcaagaccggcagcaacgugaugcucgccgugugcaagcggaugugcuuccgcgccaccgucgagguguccaacaaggcccugcugauccggaacaucaucaacacgaccuucguggucugcauccucauccuggcggugugcguggucagcaccuccgccguggagauggagagccugcccgccgggaccugggagcgcgaggaggaccucacgaacuucugccaccaggagugccaggugaccgagaccgagugccugugccccuacgaggcccugguccuccggaagccgcuguucuccgacagcaucgugaagggcaugaagaaccugcucaacuccaccagccuggagacgucccugagcaucgaggcccccuggggcgcgaucaacgugcaguccaccuucaagcccaccgucagcgccgccaacaucgcccucuccuggagcuccguggagcaccgcgggaacaagauccuggugagcggccgcuccgagagcaucaugaagcuggaggagcggaccgggaucuccugggaccucggcgucgaggacgccagcgagagcaagcugcugacgguguccaucauggaccucagccagauguacuccccgguguucgaguaccugagcggggaccgccaggucgaggaguggcccaaggcgaccugcaccggcgacugccccgagcggugcgggugcaccuccagcacgugccugcacaaggaguggccccacucccgcaacuggcggugcaacccgaccuggugcuggggcgugggcaccgggugcacgugcugcggccucgacgucaaggaccuguucaccgacuacauguucgugaaguggaagguggaguacaucaagaccgaggccaucgucugcguggagcugaccagccaggagcgccagugcucccucaucgaggccgggacccgguucaaccugggccccgugacgaucacccugagcgagccccgcaacauccagcagaagcugcccccggagaucgucacccugcacccccggaucgaggagggcuucuucgaccugaugcacgugaagaaggugcucuccgccagcaccgucugcaagcugcaguccugcacccacggggugcccggcgaccuccagguguaccacaucgggaaccugcugaagggcgacaaggucaacgggcaccugauccacaagaucgagccccacuucaacacgagcuggauguccugggacggcugcgaccucgacuacuacugcaacaugggcgacuggccgagcugcuccuacaccggggugacccagcacaaccacgccgcguucgugaacaugcugaacaucgagaccgacuacacgaagaucuuccacuuccacagcaagcgcgucaccgcccacggcgacacgccccagcuggaccucaaggcccggcccaccuacggggccggcgagaucaccgugcugguggaggucgcggacauggagcugcacaccaagaagaucgagaucuccgggcucaaguucgccagccugaccugcaccggcugcuacgccugcagcuccggcaucagcugcaaggugcgcauccacguggacgagcccgacgagcugacgguccacgugaaguccgaggacccggacaucguggccgccagcuccagccucauggcgcggaagcuggaguucgggaccgacuccaccuucaaggccuucagcgccaugcccaagaccucccugugcuucuacaucgucgagcgcgaguacugcaagagcugcuccaaggaggacacgcagaagugcgugaacaccaagcucgagcagccccagagcauccugaucgagcacaagggcaccaucaucgggaagcagaacgacacgugcaccuccaaggccggcugcuggcuggagagcgugaaguccuucuucuacgggcugaagaacaugcucagcggcaucuucggcaacgucuucaucgggaucuuccuguuccuggcccccuucauccuccugauccuguucuucauguucggcuggcggauccucuucugcuucaagugcugccgccggacccgcgggcuguucaaguaccggcaccugaaggacgacgaggagaccggcuaccgcaagaucaucgagcggcucaacaacaagaagggcaagaacaagcugcuggacggggagcgccucgcggaccgcaagaucgccgagcuguucuccaccaagacgcacaucggcuga

SEQ ID NO: 11939 - RNA, 5070 nt, Artificial Sequence
  derived and/or modified CDS sequence (opt1) from CCHFV(Baghdad 12)__AJ538197.2__GP
augcccgugagcaucaugcacaucucccugaucuacgccguccucugccugcagcuguacggccucggggagacccacggcagcuccagcgggaccgagcacaaccgcacgaacgugguggccaccccgggcgggucccagagccccgagccccuggucuccaccacccugcccgugacgcucgacagcuccaccgugaccccggcgacccaggccagcggccccgagggcuccggggaggucuacacgagcccccccaccaccaccgagggccuguccccgagcgacgccacguccgagcugcccaccaccaccgggaucggcaucagcuccagcuccgacgugaacagcagcacgcaggccgccggggacaccuccacccccaccgcgcggacgagccuccccgacuccccgagcaccccccccaccucccaggacacccaccaccccaugcgcaaccugcugagcgugacgucccucaagccggaggagacccccgcccccagcaaguccggcaaggagagccccgccgccuccagcccgcaccccgucgcgucccggccccccaccccgagcaccacggcccagggccccaccgagaacaacucccgcaacaccaccgugcagcugaagagcgugacgcaguccgccacccuggggcccauggccagccccacccagaccguccuccugcaguccgugacgagcaucgccauccaggacacccacccgagccccaccaaccggucccgccggaaccuggagauggagaucauccucacccugccccagggccugaagaaguacuacgggaaggugcuccgccugcugcagcucacccuggaggaggacacggagggccugcucgaguggugcaagcggaaccugggccuggacugcgacgacaccuucuuccagaagcgcaucgaggaguucuucaucaccggggagggccacuucaacgagguccuccaguuccggaccccggggacgcugagcaccaccgaguccacccacgcgggcagccccacgguggagcccuucaaguccuacuucgccaagggguuccugcucaucgacagcggcuacuucuccgccaagugcuacagccgcaccuccaacagcggccugcagcugaucaacgugacccggcacuccaccaagaucgccgacacgcccgggccgaagaucaccaaccucaagaccaucagcugcaucaaccugaaggccuccaucuucaaggagcaccgcgagaucgagaucaacguccugcucccccagguggcggugaaccugagcaacugccacgucaccaucaagucccacgugugcgacuacagccugaacaucgacggcacggugaagcucccccacauccaccacgaggggaucuucauccccggcaccuacaagaucgucaucgacaagaagaacaagcugaacgaccggugcacccuguucaccaacugcgugaucaaggggcgcgagguccggaagggccaguccgugcuccgccaguacaagacggagauccggaucggcaaggccagcaccgggagccgccggcugcuguccgaggagagcggcgacgacugcaucucccgcacccgccuccugcggaccgagacggccgagauccacggggacagcuacggcgggccgggcgacaagaucaccaucugcaacggcuccaccaucguggaccagcgccuggggagcgagaugggcugcuacaccaucaaccgggucaaguccuucaagcugugcgagaacagcgccacggggaaguccugcaagaucgacagcauccccgugaagugccgccagggcuacugccucaagaucacccaggagggccgggggcacgugaagcugucccgcggcagcgaggucgugcuggacgccugcgacuccagcugcgaggugaugauccccaaggggaccggcgacauccucgucgacugcuccgggggccagcagcacuuccugaaggacaaccugaucgaccucggcugccccaacaucccgcugcuggggaagauggcgaucuacaucugccggaugagcaaccaccccaagaccacgauggccuuccucuucugguucuccuucggcuacgugaucaccugcauccugugcaaggccaucuucuaccugcucaucaucguggggacccugggcaagcgcuucaagcaguaccgggagcugaagccccagaccugcacgaucugcgagaccacccccgucaacgccaucgacgccgagaugcacgaccucaacugcagcuacaacaucugcccguacugcgcgucccgccugaccagcgacgggcuggcccggcacgugacccagugccccaagcgcaaggagaagguggaggagacggagcucuaccugaaccuggagcggauccccugggucgugcgcaagcuccugcaggugagcgaguccaccggcgucgcccugaagcggagcuccuggcucaucgugcugcuggugcuccuggccgucagcuccagccccgugcaguccgcgccgaucggcuacgggaagaccaucgagaccuaccaggcccgcgagggcuacacgagcaucugccuguucgugcucggguccauccuguucaucgucagcugccugaccaagggccucguggacuccaucgggaacaucuucuuccccggccugagcaucugcaagaccugcuccaucggcagcaucaacggguucgagguggagucccacaagugcuacugcagccugcucugcugccccuacugccggcacugcuccgccgaccgcgagauccaccagcugcaccugagcaucugcaagaagcggaagaccggcuccagcgucaugcucgccgugugcaagcgcaugugcuuccgcgccacgauggaggugagcaacaaggcgcugcugauccgguccaucaucaacaccaccuucgucgugugcauccucacccuggccgugugcgucgugagcacguccgccguggagauggagagccugcccgccgggaccugggagcgcgaggaggaccucaccaacuucugccaccaggagugccaggucaccgagacggagugccugugcccguacgaggcccuggugcuccggaagccccuguuccuggacuccaucgugaagggcaccaagaaccuccugaacagcaccucccuggagaccagccucuccaucgaggcgcccuggggggccaucaacguccagagcacguacaagccgaccguguccaccgccaacaucgcccugagcugguccagcguggagcaccgcggcaacaagauccuggucuccggccggagcgaguccaucaugaagcucgaggagcgcaccgggaucagcugggaccugggcguggaggacgccuccgagagcaagcugcucacggugagcgucauggaccugucccagauguacagccccguguucgaguaccuguccggggaccggcagguggaggaguggcccaaggcgaccugcaccggcgacugccccgagcgcugcggcugcaccacgagcaccugccuccacaaggaguggccgcacucccggaacuggcgcugcaaccccaccuggugcuggggggucggcaccgggugcacgugcugcggccuggacgugaaggaccuguucaccgacuacauguucgugaaguggaaggucgaguacaucaagaccgacgccaucgugugcgucgagcucaccagccaggagcggcagugcucccugaucgaggccgggacgcgcuucaaccugggcagcgugaccaucacccucuccgagccccggaacauccagcagaagcugcccccggagaucaucacccugcacccccgcaucgaggagggcuucuucgaccucaugcacgugcagaagguccugagcgccuccaccgugugcaagcugcagagcugcacgcacggggugcccggcgaccuccaggucuaccacaucgggaaccugcugaagggcgacaaggugaacgggcaccucauccacaagaucgagccccacuucaacaccuccuggaugagcugggacggcugcgaccuggacuacuacugcaacaugggcgacuggccguccugcaccuacaccggggugacgcagcacaaccacgcgagcuucgucaaccugcucaacaucgagaccgacuacaccaaguccuuccacuuccacagcaagcgggugaccgcccacggcgacacgccccagcuggaccugaaggugcgccccaccuacggggccggcgagaucaccguccucguggagguggccgacauggagcugcacaccaagaagaucgagaucuccgggcugaaguucgccagccucacgugcaccggcugcuacgcgugcagcuccggcaucagcugcaagguccggauccacguggacgagcccgacgagcugaccgugcacgucaaguccgacgacccggacgugguggccgccagcuccagccugauggcccgcaagcucgaguucgggaccgacuccacguucaaggccuucagcgcgaugcccaagaccucccugugcuucuacaucgucgagcgggaguacugcaagagcugcuccaaggaggacacccagaagugcgugaacaccaagcuggagcagccccagagcauccucaucgagcacaagggcacgaucaucgggaagcagaacaacaccugcaccgccaagaccuccugcuggcuggagagcgugaaguccuucuucuacggccugaagaacaugcugagcggcaucuucgggaacuucuucaugggcaucuuccucuuccuggcccccuucauccugcucauccuguucuucauguucggguggcgcauccuguucugcuucaagugcugccggcgcacgcgcggccucuucaaguaccggcaccugaaggacgacgaggagaccggguaccgccggaucaucgagcgccugaacaacaagaagggcaagaacaagcuccuggacggcgagcggcuggccgaccgccggaucgccgagcucuucuccaccaagacccacaucggguga

SEQ ID NO: 11940 - RNA, 5070 nt, Artificial Sequence
  derived and/or modified CDS sequence (opt1) from CCHFV(Hodzha)__AY223476.1__GP
augcccgugagcaucaugcacauccugcucaugugcgccguccugugccugcagcaguacggccucggggagacccaccgcccgaacaacggcaccgagcacaacaagacgaacgugcugaccacccccggggacaagcugucccccgagcuccccgugagcaccgcccuguccgucacgccggacagcuccaccgugacccccaccacgcccgugagcggccuggagggguccggcgacgucuacaccagcccgcccgugaccaccaagggccucucccccagcaaggcgacguccgagcugcccgccagcuccgggaucgacaccagcuccgccagcgacguggacuccagcacccaggccgcccgggacaccuccacgcugaccguccgcaccagcccgcccagcucccccagcaccccgcccacgucccaggacaccuaccaccucgugcggaaccugcugagcgugaccucccccuggcccgaggagaccacggcgcccagcaaguccggcaaggagagccccgucgccaacuccccgcaccccgugaccagccgccccuccagcccgcccaucaccgugcaggggcccaccgagaacuccagccacaacacgaccggccagcucgaguccauggcccagagcaccacccugguccccauggccucccccacgcagaccgugcugagccaguccgugaccagccucgcgguccaggacgcccacccgagccccaccaaccgguccaagcgcaaccuggagauggugaucauccugacgcucccccaggggcugaagaaguacuacggcaaggugcugcggcuccugcagcugacccucgaggaggacaccgagggccugcuggaguggugcaagcgcaaccucgggcuggacugcgacgacaccuucuuccagaagcggaucgaggaguucuucaucaccggcgaggggcacuucaacgagguccugcaguucaagacgccgagcacccucuccaccaccgagagcacgcacgccgugucccccaccgccgagcccuucaagagcuacuucgccaagggcuuccuguccaucgacagcggcuacuucuccgcgaagugcuacagcaagaccuccaacagcgggcugcagcucaucaacgugacccgccacuccacgcggaucgccgacacccccggcccgaagaucaccaaccugaagaccaucagcugcaucaaccugaaggccuccgucuucaaggagcaccgcgagguggagaucaacguccuccugccccagguggccgugaaccugagcaacugccacgucacgaucaagucccacgugugcgacuacagccucgacguggacgggaccguccggcugccccacauccaccacggcgggaccuucauccccggcaccuacaagaucgugaucgacaagaagaacaagcugaacgaccgcugcacgcucuacaccaacugcgugaucaagggccgggagguccgcaaggggcagagcauccugcggcaguacaagaccgagauccgcaucggcaaggccuccaccgggagccggcgccugcucuccgaggagagcggcgacgacugcaucucccggacgcagcugcugcgcaccgagaccgcggagauccacggggacgacuacggcggcccgggggacaagaucaccaucugcaacggcagcacgaucguggaccagcgccugggguccgagcucggcugcuacaccaucaaccgggucaagagcuucaagcugugcaagaacuccgccaccggcaagagcugcgagaucgacuccacccccgugaagugccgccagggguacugccugaagaucacgcaggagggccgggggcacgugaagcucagccgcggcuccgaggugguccuggacgccugcgacagcuccugcgaggugaugauccccaaggggaccggcgacauccugguggacugcagcggcgggcagcagcacuuccucaaggacaaccugaucgaccugggcugcccccggaucccgcuccuggggaagauggccaucuacaucugccgcauguccaaccaccccaagaccaccauggccuuccuguucugguucagcuucggcuacgucaucacgugcauccucugcaaggcgaucuucuaccugcugaucaucguggggacccucggcaagcgguucaagcaguaccgcgagcugaagccccagaccugcaccaucugcgagacgacccccgccaacgccaucgacgccgagaugcacgaccugaacugcuccuacaacaucugcccguacugcgccagccggcucaccagcgacggccuggcgcgccacgugacccagugccccaagcggaaggagaaggucgaggagaccgagcuguaccucaaccuggagcgcauccccuggaucgugcggaagcugcuccagguguccgagagcacgggggucgcccugaagcgcuccagcuggcugaucgugcuccuggugcuguucgccgucucccucagccccgugcaguccgccccgaucggccacgggaagaccaucgagaccuaccaggcgcgggaggacuacaccagcaucugccuguucgugcugggcuccauccucuucaucgucagcugccugaugaaggggcugguggacuccaucggcaacaucuucuuccccggccucacgaucugcaagaccugcagcaucggguccaucaacggcuucgagaucgagagccacaagugcuacugcucccugcugugcugccccuacugccgccacugcagcgccgaccgggagauccaccagcuccaccuguccaucugcaagaagcgcaagaccgggagcaacgugaugcuggccgucugcaagcggaugugcuuccgcgccaccauggagguguccaacaaggcccuccugauccgcagcaucaucaacacgaccuucguggucugcauccugauccucgcggugugcguggucagcaccuccgccguggagauggagagccugcccgccggcaccugggagcgggaggaggaccugacgaacuucugccaccaggagugccaggugaccgagaccgagugccucugcccguacgaggcccugguccugcgccggccccucuuccuggacuccaucgugaaggggaccaagaaccugcucaacagcacgucccuggagaccagccuguccaucgaggcccccuggggcgcgaucaacgugcagagcaccuacaagccgaccgucuccacggccaacaucgcccucagcugguccagcguggagcaccgcggcaacaagauccugguguccgggcggagcgaguccaucaugaagcuggaggagcgcaccggcaucagcugggaccucggggucgaggacgccuccgagagcaagcugcugaccguguccgugauggaccucagccagauguacagccccgucuucgaguaccuguccggcgaccgccagguggaggaguggcccaaggcgaccugcacgggggacugccccgagcggugcggcugcaccagcagcacgugccugcacaaggaguggccgcacucccggaacuggcgcugcaaccccaccuggugcuggggcgucgggaccggcugcacgugcugcgggcucgacgugaaggaccuguucaccgacuacauguucgugaaguggaaggucgacuacaucaagaccgaggccaucgugugcguggagcugaccucccaggagcggcagugcagccucgucgaggccggcacccgcuucaaccugggccccgugaccaucacccuguccgagccccggaacauccagcagaagcucccgcccgagaucaucacgcugcacccccgcaucgaggagggguucuucgaccugaugcacgugcagaagguccucagcgccuccaccgugugcaagcugcagagcugcacccacggcgugcccggggaccugcaggucuaccacaucggcaaccuccugaagggggacaaggugaacggccaccugauccacaagaucgagccgcacuucaacaccuccuggaugagcugggacggcugcgaccucgacuacuacugcaacaugggggacuggcccuccugcaccuacacgggcgugacccagcacaaccacgccagcuucgucaaccugcugaacaucgagaccgacuacaccaaguccuuccacuuccacagcaagcgggugacggcgcacggggacacgccccagcucgaccugaaggcccgccccaccuacggcgccggggagaucaccgugcuggucgagguggccgacauggagcuccacaccaagaagaucgagaucaccggccugaaguucgccucccugaccugcaccggcugcuacgcgugcagcuccgggaucagcugcaaggugcggauccacgucgacgagccggacgagcucacggugcacgucaagagcgacgaccccgacgugguggccgccuccagcucccugauggcccgcaagcuggaguucggcaccgacagcaccuucaaggccuucuccgcgaugcccaagaccagccucugcuucuacaucguggagcgggaguacugcaaguccugcagcaaggaggacacgcagaagugcgucaacaccaagcuggagcagccccaguccauccugaucgagcgcaaggggaccaucaucggcaagcagaacaacacgugcaccgccaaggccagcugcuggcuggaguccgucaagagcuucuucuacgggcucaagaacaugcuguccggcaucuucggcaacguguucguggggaucuuccuguuccucgccccguucauccugcugauccucuucuucauguucggcuggcggauccuguucugcuucaagugcugccgccgcacccgggggcuguucaaguacaagcaccucaaggacgacgaggagaccggcuaccgccggaucaucgagcgccugaacaacaagaagggcaagaacaagcugcucgacggggagcggcuggccgaccgccggaucgcggagcuguucagcaccaagacgcacaucggcuga

SEQ ID NO: 11941 - RNA, 5067 nt, Artificial Sequence
  derived and/or modified CDS sequence (opt1) from CCHFV(Kosovo/9553/2001)__AY675511.1__GP
augcccaucaacaucaugcacacccugcucgugugcuucauccuguaccugcagcuccugggccuggggggcgcccacgggcagagcaacgccaccgagcacaacggcacgaacaccaccaccgcgccggggacgucccagagccccaagccccccgccuccaccaccccgagccacgcccccgaguccagcaccaucaagcucacgacccccaccuccgagaccgagggcagcggcgagacgacccccccgaccuccaccacgcaggggagccccccccuggagaccacccccgagcgcuccaccacgaccgccaccagcaccuccggcacggacaacaugaacagcaccacccagaugaccgacaacacgccgacccugaccgccuccaccagccccuccagcucccccagcacgcccagcaccucccaggggcuccacuacccgguccggagccugcuguccgugagcucccccaagaccgugaccacgcccacccccaugagcccgggcgagauguccagcgagaccuccagccagcacuccgcgaugagccgcacccccaccccccacacggccacccaggucuccaccgagaacgccaaccggagcaccucccgccagagcgaguccagcgcccagcccgcgacgcaguccccggugaccagccccgcccagagcauccuccugauguccgccacccccaccacgauccagaacauccaccccagcccgaccaaccgguccaagcgcaaccuggagauggagaucauccucacccugagccaggggcugaagaaguacuacggcaagauccucaagcugcugcaccucacccuggaggaggacacggagggccugcucgaguggugcaagcggaaccugggguccaacugcgacgacgacuucuuccagaagcgcaucgaggaguucuucaucaccggcgagggguacuucaacgaggugcugcaguucaagacccucagcacccccucccccacggagccgagccacgcccggcugcccaccgccgagcccuucaaguccuacuucgcgaagggcuuccugagcaucgacuccggcuacuucagcgccaagugcuacccccgcuccagcaccuccgggcuccagcugaucaacgucacccagcacccggcccggaucgccgagacgcccggccccaagaucaccagccugaagaccaucaacugcaucaaccuccgcgccuccguguucaaggagcaccgggagguggagaucaacguccugcugccccagaucgcggugaaccucagcaacugccacguggucaucaacagccacgugugcgacuacucccuggacaccgacgggccggugcgccugccccggaucuaccacgagggcacguucaugcccgggaccuacaagaucgucaucgaccgcaagaacaagcucaacgaccggugcacccuggugaccaacugcgugaucaagggccgcgagguccggaagggccagagcgugcugcgccaguacaagacggagaucaagaucgggaaggcccccaccggcucccggaagcuccugagcgaggagccgggggacgacugcaucucccgcacccagcugcuccgcaccgagacggccgagauccacgacgacaacuacggcgggcccggcgacaagaucaccaucugcaacggcagcaccaucguggaccagcggcugggguccgagcugggcugcuacaccaucaaccgcgucaagagcuucaagcucugcgagaacuccgccacggggaagaccugcgagaucgacagcacccccgugaagugccggcagggcuucugccugaagaucacccaggaggggcgcggccacgugaagcugucccggggcagcgaggucgugcuggacgccugcgacuccagcugcgaggucaugauccccaaggggaccggcgacauccucguggacugcuccgggggccagcagcacuuccugaaggacaaccugaucgaccucggcugcccgcacaucccccugcuggggaagauggcgaucuacaucgcccgcaugagcaaccaccccaagacgaccauggccuuccucuucugguucucccugggcuacgugaucaccugcauccugugcaaggcccucuucuacagccugaucaucaucgggacccugggcaagaagaucaagcaguaccgggagcucaagccccagacgugcaccaucugcgagaccgccccggucaacgcgaucgacgccgagaugcacgaccugaacugcuccuacaacaucugccccuacugcgccagccgccugaccagcgacgggcucgcccggcacgugaagcagugccccaagcgcaaggagaagguggaggagacggagcuguaccugaaccucgagcggauccccugggucgugcgcaagcugcugcagguguccgagagcaccggcgucgcgcucaagcgguccagcuggcugaucgugcugcucgugcugcugaccgucucccucagcccggugcaguccgcccccgugggccacgggaagaccaucgagacguaccagacccgcgagggcuucaccagcaucugccuguucaugcugggguccauccucuucaucgucagcugccuggugaagggccugguggacuccgucagcgacuccuucuuccccgggcucagcgugugcaagaccugcuccaucggcagcaucaacggcuucgagaucgagucccacaagugcuacugcagccuguucugcugcccguacugccggcacugcuccgccgaccgcgagauccaccagcugcaccucagcaucugcaagaagcggaagacggggagcaacgugaugcuggccgucugcaagcgcaugugcuuccgggccaccaucgaggcgucccgccgcgcccugcucauccggagcaucaucaacaccaccuucgugaucugcauccugacgcugaccaucugcguggccuccaccagcgccgucgagauggagacccuccccgccgcgacgugggagcgcgaggaggaccugaccaacuucugccaccaggagugccaggugcccgagaccgagugccugugccccuacgaggcccucgugcugcggaagccgcuguuccucgacuccaucgucaagggcaugaagaaccugcugaacagcaccucccucgagacgagccuguccaucgaggcccccuggggggccaucaacgugcagagcaccuucaagcccaccguguccaccgccaacaucgcgcugagcugguccagcgucgagcaccgcggcaacaagauccucgugacggggcgguccgagagcaucaugaagcuggaggagcgcaccggcguguccugggaccugggcgucgaggacgccagcgaguccaagcuccugaccgugagcaucauggaccugagccagauguacucccccguguucgaguaccucagcggggaccggcaggucgaggaguggccgaaggccaccugcacgggcgacugccccgagcgcugcgggugcaccuccagcaccugccugcacaaggaguggccccacucccggaacuggcgcugcaaccccaccuggugcuggggcguggggaccggcugcacgugcugcggcguggacgucaaggaccuguucaccgaccacauguucgugaaguggaagguggaguacaucaagaccgaggccaucgucugcguggagcucaccagccaggagcggcagugcucccugaucgaggcggggacgcgcuucaaccugggcccggugaccaucacccucagcgagccccggaacauccagcagaagcugccccccgagaucaucacccugcacccgaagaucgaggagggguucuucgaccucaugcacguccagaaggugcuguccgccagcacggugugcaagcugcaguccugcacccacggcauccccggcgaccuccaggucuaccacaucgggaaccugcugaagggcgaccgcgugaacgggcaccucauccacaagaucgagccccacuucaacaccagcuggauguccugggacggcugcgaccuggacuacuacugcaacaugggggacuggcccagcugcaccuacacgggcgugacccagcacaaccacgccgccuucgucaaccugcucaacaucgagaccgacuacaccaagacguuccacuuccacuccaagcgggugaccgcccacggcgacaccccgcagcuggaccugaaggcgcgccccaccuacggggccggcgagaucacgguccucguggagguggccgacauggagcugcacaccaagaaggucgagaucagcgggcugaaguucgccucccucgccugcaccggcugcuacgcgugcagcuccgggaucagcugcaaggugcggauccacguggacgagcccgacgagcugaccguccacgugaagagcuccgaccccgacguggucgccgccagcacgucccugauggcccgcaagcucgaguucggcaccgacagcaccuucaaggccuucuccgcgaugccgaagaccagccugugcuucuacaucguggagaaggaguacugcaaguccugcagcgaggacgacacgaagaagugcguggacaccaagcuggagcagccccaguccauccucaucgagcaccggggcaccaucaucgggaagcccaacgacaccugccccgccaagacgagcugcuggcuggaguccgucaagagcuucuucuacggccugaagaacaugcucggguccguguucggcaacuucuucaucgggauccugcuguuccuggccccguucuuccucuggaugcugagcuucauguucggcuggaagauccuguucugcuucaagugcugccgccggacccgcggccucuucaaguaccgccaccugaaggacgacgaggagaccggguaccggcgcaucaucgagcggcugaacaacaagaagggcaagaaccgccuccuggacggggagcggcuggccgaccgcaagaucgcggagcucuucuccaccaagacgcacaucggcuga

SEQ ID NO: 11942 - RNA, 5067 nt, Artificial Sequence
  derived and/or modified CDS sequence (opt1) from CCHFV(200406546-Turkey)__KR864902.1__GP
augcccaccaacaucacccacacccugcuggugugcuucauccuguaccugcagcuccuggggcgcgggggcgcccacgggcagagcaacgccaccgagcacaacggcaccaacaccaccaccgcgcccgggaccagccagagccacaagccccuggugagcaccaccccgccccacacccucgagagcuccaccaucaagcacaccacccccaccagcgagaccgagggcuccggcgagaccaccccgccgcccaacaccacccaggggcccuccccgcccgaggccacccccgagcggcccgccaccaccgccaccuccacccccagcacggacaacaccaacuccaccacccagaugaacgacaacaaccccacgagcaccaucuccaccagccccuccagcucccccagcacgccgcccacgccccagggcauccaccaccccgcccgcucccugcugagcgugagcucccucaagaccgcgaccacccccacgcccaccagccccggggagaucuccagcgagaccuccagccagcacuccgccaugagccggaccccgacccugcacacgaccacccagguguccaccgagagcacgaaccacuccacgccccgccagagcgaguccagcgcccagcccaccacccccuccccgaugacgagccccgcccaguccauccugcccaugagcgcggccccgaccgccauccagaacauccaccccucccccaccaaccggagcaagcgcaaccucgaggucgagaucauccugacccugagccagggccucaagaaguacuacgggaagauccugaagcugcuccaccugacgcuggaggaggacaccgagggccuccuggaguggugcaagcggaaccugggcuccagcugcgacgacgacuucuuccagaagcgcaucgaggaguucuucgugaccggggagggcuacuucaacgaggugcuccaguucaagacccuguccacgcugagccccaccgagccgucccacgccaagcuccccaccgucgagcccuucaagagcuacuucgccaagggguuccuguccaucgacagcggcuacuucuccgcgaagugcuacccccggagcuccaccagcggccugcagcucaucaacgugacgcagcacccggcccgcaucgccgagacccccgggcccaagaccaccucccugaagacgaucaacugcaucaaccugcgggccagcguguucaaggagcaccgcgagaucgagaucaacguccuccugccccagaucgccgugaaccuguccaacugccacgcggugaucaagagccacgucugcgacuacucccucgacaccgacggcccggugcggcugccccacaucuaccacgaggggaccuucauccccggcaccuacaagaucgugaucgacaagaagaacaagcugaacgaccgcugcauccucgucacgaacugcgugaucaaggggcgggaggugcgcaagggccagagcguccugcggcaguacaagaccgagaucaagaucggcaaggccagcaccgggucccgcaagcugcucagcgaggagcccggcgacgacugcaucucccggacccagcugcugcgcacggagaccgccgagauccacgacgacaacuacgggggcccgggggacaagaucaccaucugcaacggcagcaccaucguggaccagcggcucggcuccgagcuggggugcuacacgaucaaccgcgucaagagcuucaagcugugcgagaacuccgccaccggcaagaccugcgagaucgacagcacccccgucaagugccgccagggguucugccucaagaucacccaggagggccgggggcacgugaagcugucccgcggcagcgaggugguccuggacgugugcgacuccagcugcgaggucaugauccccaagggcacgggggacauccugguggacugcuccggcgggcagcagcacuuccucaaggacaaccugaucgaccugggcugcccccacgugccgcuccugggccggauggccaucuacaucugccgcaugagcaaccacccccggaccaccauggcguuccuguucugguucuccuucggguacgucaucacgugcaucuucugcaaggcccucuucuacagccugaucaucaucggcacgcuggggaagaaguucaagcaguaccgcgagcucaagccccagaccugcaccaucugcgagaccgcccccgugaacgccaucgacgccgagaugcacgaccugaacugcuccuacaacaucugcccguacugcgcgagccggcugacguccgacggccucgcccgccacgugccccagugccccaagcggaaggagaaggucgaggagaccgagcuguaccugaaccucgagcgcaucccguggaucgugcggaagcugcuccaggugagcgagagcaccggggucgcccucaagcgcuccagcuggcugaucgugcugcucgugcugcugaccgucucccucagccccgugcaguccgcccccgugggccacggcaagacgaucgagaccuaccagacccgggagggguucaccagcaucugccuguucaugcugggcuccauccucuucaucgucagcugccuggugaaggggcugguggacuccgucagcgacuccuucuuccccggccucagcgugugcaagacgugcuccaucgggagcaucaacggcuucgagaucgagucccacaagugcuacugcagccuguucugcugcccguacugccgccacugcuccgcggaccgggagauccaccagcugcaccucagcaucugcaagaagcgcaagaccggcuccaacgugaugcuggccgucugcaagcggaugugcuuccgcgccaccaucgaggccagccggcgcgcccugcucauccgcagcaucaucaacaccacguucgugaucugcauccugacccugaccaucugcguggucuccaccagcgcgguggagauggagaaccuccccgccgggacgugggagcgggaggaggaccugaccaacuucugccaccaggagugccaggugaccgagaccgagugccugugccccuacgaggcccucguccugcgcaagccccuguuccucgacuccaucgugaagggcaugaagaaccugcugaacagcacgucccucgagaccagccuguccaucgaggccccguggggcgccaucaacgugcagagcaccuucaagcccaccgucuccacggcgaacaucgcccugagcugguccagcaucgagcaccggggcaacaagauccucgugaccgggcgcuccgagagcaucaugaagcuggaggagcggaccggcguguccugggaccugggcgucgaggacgccagcgaguccaagcuccugaccgugagcaucauggaccugucccagauguacagccccguguucgaguaccucagcggggaccgccaggucgaggaguggcccaaggccacgugcaccggcgacugcccggagcggugcgggugcaccuccuccacgugccugcacaaggaguggccccacucccgcaacuggcggugcaaccccaccuggugcuggggcguggggaccggcugcacgugcugcggcguggacgucaaggaccuguucaccgaccacauguucgugaaguggaagguggaguacaucaagaccgaggccaucgucugcguggagcucacgagccaggagcgccagugcucccugaucgaggcggggacccgguucaaccugggccccgugaccaucacccucagcgagccgcgcaacauccagcagaagcugccgcccgagaucaucacgcugcaccccaaggucgaggagggguucuucgaccucaugcacgugcagaaggugcuguccgccagcaccgucugcaagcugcaguccugcacccacggcaucccgggcgaccuccagguguaccacaucgggaaccugcugaagggcgaccgggugaacgggcaccucauccacaagaucgagccccacuucaacaccagcuggauguccugggacggcugcgaccuggacuacuacugcaacaugggggacuggcccagcugcacguacaccggcgucacccagcacaaccacgccgccuucgugaaccugcucaacaucgagaccgacuacacgaagaccuuccacuuccacuccaagcgcgucaccgcgcacggcgacacgccccagcuggaccugaaggcccggccgacguacggggccggcgagaucaccgugcucguggaggucgccgacauggagcugcacaccaagaagguggagaucagcgggcugaaguucgccucccucgcgugcaccggcugcuacgccugcagcuccgggaucagcugcaaggugcgcauccacgucgacgagcccgacgagcugacggugcacgugaaguccagcgaccccgacgucguggccgccagcaccucccugaccgcccggaagcucgaguucggcaccgacagcacguucaaggcguucuccgccaugcccaagaccagccugugcuucuacaucguggagaaggaguacugcaaguccugcaacgaggacgacacccagaagugcgucgacaccaagcuggagcagccgcagagcauccucaucgagcacaagggcacgaucaucgggaagcagaacgacacgugcaccgccaaggccuccugcuggcuggagagcgugaaguccuucuucuacggccugaagaacaugcucgggagcguguucggcaacuucuucaucgggauccugcuguuccucgcccccuucguccugcuggugcuguucuucauguucggcuggaagauccucuucugcuucaagugcugccgccggacccgcggccuguucaaguaccggcaccugaaggacgacgaggagacgggguacaagcgcaucaucgagcgccucaacaacaagaagggcaagaaccggcugcuggacggggagcgccucgcggaccggaagaucgccgagcuguucuccaccaagacccacaucggcuga

SEQ ID NO: 11943 - RNA, 5067 nt, Artificial Sequence
  derived and/or modified CDS sequence (opt1) from CCHFV(Haskovo-V46/13)__KR092379.1__GP
augcccaccaacaucaugcacacccugcucgugugcuucauccuguaccugcagcuccugggccucgggggcgcccacgggcagagcaacacgaccgagcacaacggcaccaacaacaccacggccccggggaccucccagagccccaagccccacauguccaccacgcccccgcacgcgcccgagagcuccaccaucaagcccaccacccccaccagcgagacggagggcuccggcgagaccaccccgcccagcaacaccacgcaggggcccuccccgcccgagaccaccagcgagcgccccgccaccacggccaucuccaccagcuccaccgacaacaugaaccccaccagccagaugacggacaacacccccaccuccaccgucagcaucuccccgagcuccagccccagcacgcccuccacgccccagggcaugcaccacccggcccggagccugcuguccgugagcucccccaagaccgccaccacccccacccccaccagcccgguggaggucggguccgagaccagcucccagcacagcgcgauguccagcacgcccacgccccacaccgccacccagguguccaccgagaacaccaaccacagcacgccccgccaguccgagccgagcgcccagcagaccacccccucccccaugccgagccccgcccaguccacccugcucaugagcgcggcccccaccgccgugcagaacacccaccccagcccgaccaaccgguccaagcgcaaccuggagauggagaucauccugacgcucagccagggccugaagaaguacuacgggaagauccugaagcuccugcaccugacccucgaggaggacaccgagggccugcuggaguggugcaagcggaaccucggcuccaacugcgacgacgacuucuuccagaagcgcaucgaggaguucuucaugaccggggagggcuacuucaacgagguccugcaguucaagacgcugagcacccucucccccauggagcccagccacgccgagcugcccaccgccgagccguucaaguccuacuucgcgaagggguuccugagcaucgacuccggcuacuucagcgccaagugcuacccccgguccagcaccuccggccuccagcugaucaacgugacgcagcaccccgcccgcaucgccgagacccccgggccgaagaccaccagccugaaggccaucaacugcaucaaccuccgggcguccguguucaaggagcaccgcgagaucgagaucaacguccugcugccccagaucgccgugaaccucagcaacugccacguggucaucaacucccacgugugcgacuacagccuggacacggacggccccgugcggcugccccacaucuaccacgaggggaccuucaucccgggcaccuacaagaucgucaucgacaagaagaacaagcucaacgaccgcugcacccuggugacgaacugcgugaucaaggggcgggagguccgcaagggccagagcgugcugcggcaguacaagaccgagaucaagaucggcaaggccuccaccgggagccgcaagcuccuguccgaggagcugggcgacgacugcaucagccggacccagcuccugcgcacggagaccgccgagauccacgacgacaacuacgggggccccggggacaagaucaccaucugcaacggcuccaccaucguggaccagcggcugggcagcgagcucgggugcuacacgaucaaccgcggcaaguccuucaagcugugcgagaacagcgccaccgggaagaccugcgagaucgacuccacccccgucaagugccggcagggcuucugccugaagaucacgcaggaggggcgcggccacgugaagcucagccgcggcuccgaggugguccuggacgcgugcgacagcuccugcgaggugaugauccccaaggggaccggcgacauccuggucgacugcagcgggggccagcagcacuuccugaaggacaaccucaucgaccugggcugcccgcacaucccccugcucgggaagauggccaucuacaucugccggauguccaaccacccccgcaccaccauggccuuccuguucugguucagcuucggcuacgugaucacgugcaucuucugcaaggcccuguucuacucccucaucaucaucgggacccugggcaagaagaucaagcaguaccgggagcugaagccccagaccugcaccaucugcgagaccacgccggugaacgccaucgacgcggagaugcacgaccucaacugcagcuacaacaucugccccuacugcgccucccgccugaccagcgacgggcuggcccggcacgucacccagugccccaagcgcaaggagaagguggaggagaccgagcucuaccugaaccuggagcggaucccguggaucgugcgcaagcuccugcaggucagcgaguccacgggcguggcccugaagcggagcuccuggcucaucgugcugcugguccuccugcccgugagccugucccccgugcagagcgcgcccgucggccacgggaagaccaucgagaccuaccagacccgcgagggcuucacguccaucugccucuucaugcuggggagcauccuguucaucguguccugccucgugaagggccuggucgacagcgugggggacuccuucuucccgggccugagcgugugcaagaccugcuccaucggcagcaucaacggguucgagaucgagucccacaagugcuacugcagccucuucugcugccccuacugccggcacugcuccgccgaccgcgagauccaccagcugcaccugagcaucugcaagaagcggaagaccggcuccaacgucaugcucgccgugugcaagcgcaugugcuuccgggccaccaucgaggccagccgccgggcgcugcugauccgcagcaucaucaacacgaccuucgccaugugcauccucacccugaccaucugcguggucuccacgagcgccguggagauggagaaccugcccgccgggaccugggagcgggaggaggaccucaccaacuucugccaccaggagugccaggugaccgagacggagugccugugccccuacgaggcccugguccuccgcaagccgcuguuccuggacuccaucgugaagggcaugaagaaccuccugaacagcaccucccuggagaccagccucuccaucgaggcgcccuggggcgccaucaacgugcagagcaccuucaagcccacggucuccaccgccaacaucgcccugagcugguccagcguggagcaccgcgggaacaagauccuggugaccggccgguccgagagcaucaugaagcucgaggagcgcaccggggucuccugggaccugggcguggaggacgccagcgaguccaagcugcucacggugagcaucauggaccugucccagauguacagccccgucuucgaguaccugagcggggaccgccagguggaggaguggccgaaggcgaccugcaccggcgacugccccgagcggugcgggugcaccuccagcacgugccuccacaaggaguggccccacucccggaacuggcgcugcaaccccaccuggugcuggggcgugggcaccgggugcacgugcugcggcgucgacgugaaggaccuguucaccgaccacauguucgugaaguggaaggucgaguacaucaagaccgaggccaucgugugcguggagcugaccagccaggagcggcagugcucccucaucgaggccgggacccgcuucaaccugggcccggucaccaucacgcugagcgagccccggaacauccagcagaagcucccgcccgagaucaucacccugcaccccaagaucgaggagggcuucuucgaccugaugcacgugcagaaggugcucuccgccagcaccgucugcaagcugcaguccugcacccacgggauccccggcgaccuccagguguaccacaucgggaaccugcugaagggcgaccgcgugaacgggcaccugauccacaagaucgagccccacuucaacacgagcuggauguccugggacggcugcgaccucgacuacuacugcaacaugggcgacuggcccagcugcaccuacaccggggucacccagcacaaccacgcggccuucgugaaccugcugaacaucgagacggacuacaccaagaccuuccacuuccacuccaagcgggugaccgcccacggcgacacgccgcagcucgaccugaaggcccgccccaccuacggggccggcgagaucaccguccugguggaggucgcggacauggagcuccacaccaagaagguggagaucagcgggcugaaguucgccucccugacgugcaccggcugcuacgccugcagcuccggcaucagcugcaaggugcggauccacgucgacgagcccgacgagcucaccgugcacgugaaguccagcgaccccgacgucguggccgccgggaccagccugauggcgcgcaagcuggaguucggcacggacuccaccuucaaggccuucagcgccaugccgaagaccucccucugcuucuacaucguggagcgggaguacugcaagagcugcuccgaggacgacacccagaagugcgucgacacgaagcuggagcagccccagagcauccugaucgagcacaaggggaccaucaucggcaagcagaacgacacgugcaccgcccgcgccuccugcuggcucgagagcgugaaguccuucuucuacgggcugaagaacaugcugggcagcguguucggcaacuuccucaucgggauccugcuguuccucgcgcccuucguccugcuggugcuguucuucauguucggcuggaagauccucuucugcuucaagugcugccggcgcacccgggggcuguucaaguaccgccaccugaaggacgacgaggagaccggcuaccggcgcaucaucgagcgccucaacuccaagaagggcaagaaccggcugcuggacggggagcgccucgccgaccggaagaucgccgagcuguucagcaccaagacccacaucggcuga

SEQ ID NO: 11944 - RNA, 5067 nt, Artificial Sequence
  derived and/or modified CDS sequence (opt1) from CCHFV(VLG/TI29414)__AY179961.1__GP
augcccaccaacaucaugcacacccugcucgugugcuucauccuguaccugcagcuccugggccucgggggcgcccacauccagagcaacgccacggagcacaacgggaccaacaccaccacggcgccguccaccagccagucccccaagccccuggucagcaccgcgcccccgcacgcccuggaguccagcaccaucaagcccacgacccccguguccgagaccgagggcagcgggggcaccacgcccccgcccaacaccacccagggccccuccccgcccgaggccacccccgagcgccccgccacgaccgccaccagcacccccuccacggacaacaccaacagcaccacccacgugacggacaacaacccgaccuccaccaucagcaccucccccagcuccagccccuccacgcccagcaccccgcaggggauccaccaccccgcccggaaccugcucagcgucuccagccccaagaccgccaccacgcccaccccgaccucccccggcgacaucagcuccgagaccagcucccugcacagcgccaugucccgcacgagcacccuguacaccgcgacccagguguccaccgagaacgccaaccacagcgcgccccggcaguccgagagcuccgcccagcagacgaccaccagccccaugaccuccccggcccagcccauccucgugaugagcgccgcccccacggccauccagaacauccacccgucccccaccaaccgcagcaagcggaaccuggagauggagaucauccugacccucagccaggggcugaagaaguacuacggcaagauccugaagcuccugcaccugacccucgaggaggacacggaggggcugcuggaguggugcaagcgcucccucggcagcaacugcgacgacgacuucuuccagaagcggaucgaggaguucuucaugaccggcgagggguacuucaacgagguccugcaguucaagacccuguccacccucagccccacggagcccucccacgcccgcccgcccaccguggagcccuucaagagcuacuucgccaagggcuuccuguccaucgacagcggguacuucuccgcgaagugcuacccccggcugagcaccuccggccuccagcugaucaacgugacccagcacccggcccgcaucgccgagacgcccggccccaagaccaccagccugaagaccaucaacugcaucaaccuccgggccuccgucuucaaggagcaccgcgagaucgagaucaacgugcugcugccccagaucgccgugaaccucagcaacugccacgucgugaucaacucccacgugugcgacuacagccuggacacggacgggccgguccggcugccccacaucuaccacgagggcaccuucauccccgggaccuacaagaucgugaucgacaagaagaacaagcucaacgaccgcugcacccuggugacgaacugcgucaucaagggccgggaggugcgcaaggggcaguccgugcugcggcaguacaagaccgagaucaagaucggcaaggcgagcaccggcagccgcaagcuccuguccgaggagcccggggacgacugcaucagccggacccagcugcuccgcgccgagccggccgagauccacgacgacaacuacggcgggcccggcgacaagaucacgaucugcaacggguccaccaucgucgaccagcggcugggcagcgagcugggcugcuacaccaucaaccgcgugaaguccuucaagcucugcgagaacagcgccaccgggaagacgugcgagaucgacuccacccccgugaagugccgccagggcuucugccugaagaucacccaggaggggcggggccacgucaagcugagccgcggguccgaggugguccuggacgccugcgacagcuccugcgaggugaugauccccaagggcaccggcgacauccucguggacugcagcgggggccagcagcacuuccugaaggacaaccugaucgaccucgggugcccgcacaucccccugcugggcaagauggcgaucuacaucugccggauguccaaccacccccgcacgaccauggccuuccucuucugguucagcuucggcuacgucaucacgugcaucuucugcaaggcccuguucuacucccugaucaucaucgggacccucggcaagaagaucaagcaguaccgggagcugaagccccagaccugcaccaucugcgagaccgccccggugaacgcgaucgacgccgagaugcacgaccugaacugcagcuacaacaucugccccuacugcgccucccgccucaccagcgacgggcuggcccggcacgugccccagugcccgaagcgcaaggagaaggucgaggagaccgagcuguaccucaaccuggagcggauccccuggaacgugcgcaagcugcuccagguguccgagagcacgggcgucgcccugaagcggagcuccuggcugaucgugcuccuggugcugcucaccgucagccugucccccgugcagagcgcgcccguggggcacggcaagaccaucgagaccuaccagacgcgcgagggcuucaccuccaucugccuguucaugcucgggagcauccuguuccuggucuccugccucgugaagggccugguggacagcgucuccgacagcuucuucccggggcuguccgugugcaagaccugcagcaucggcuccaucaacggguucgagaucgagagccacaagugcuacugcucccucuucugcugccccuacugccggcacugcagcgccgaccgcgagauccaccagcugcaccuguccaucugcaagaagcggaagaugggcagcaacgugaugcucgccgucugcaagcgcaugugcuuccgggccaccaucgaggccucccgccgggcgcugcugauccgcagcaucaucaacacgaccuucgugaucugcauccucacccugaccaucugcguggucagcacguccgccguggagauggagaaccugcccagcggcaccugggagcgcgaggaggaccucaccaacuucugccaccaggagugccaggugaccgagacggagugccugugccccuacgaggcccugguccuccggaagccgcuguuccuggacuccaucgugaaggggaugaagaaccuccugaacagcaccaaccuggagaccucccucagcaucgaggcccccuggggcgccaucaacgugcaguccaccuucaagcccacggucagcaccgcgaacaucgcccuguccuggagcuccguggagcaccgcgggaacaagauccuggugaccggccggagcgaguccaucaugaagcucgaggagcgcaccggggucagcugggaccugggcguggaggacgccuccgagagcaagcugcucacgguguccaucauggaccugagccagauguacucccccgucuucgaguaccugagcggcgaccgccagguggaggaguggccgaaggcgaccugcaccggggacugccccgagcggugcggcugcaccagcuccacgugccuccacaaggaguggccccacagccggaacuggcgcugcaaccccaccuggugcugggagguggggaccggcugcacgugcugcggguggaacgucaaggaccuguucaccgaccacauguucgugaaguggaagguggaguacaucaagaccgaggccaucgucugcguggagcugaccucccaggagcggcagugcagccucaucgaggccggcacccgcuucaaccugggcccggugaccaucacgcuguccgagccccggaacauccagcagaagcucccgcccgagaucaucacccugcaccccaaggucgaggagggguucuucgaccugaugcacgugcagaaggugcucagcgccuccaccgucugcaagcugcagagcugcacccacggcauccccggggaccuccagguguaccacaucggcaaccugcugaagggcgaccgcgugaacgggcaccugauccacaagaucgagccccacuucaacacguccuggaugagcugggacggcugcgaccucgacuacuacugcaacaugggggacuggcccuccugcaccuacaccggcaugacccagcacaaccacgccgccuucgucaaccugcugaacaucgagacggacuacaccaagaccuuccacuuccacagcaagcgggugaccgcgcacggggacacgccgcagcucgaccugaaggcccgccccaccuacggcgccggcgagaucaccguccugguggagguggccgacauggagcuccacaccaagaaggucgagaucuccgggcugaaguucgccagccuggcgugcacgggcugcuacgccugcuccagcgggaucuccugcaaggugcggauccacguggacgagcccgacgagcucaccguccacgucaagagcaacgaccccgacgugaucgccgccuccaccagccugauggcccgcaagcuggaguucggcaccgacagcacguucaaggcguucuccgccaugccgaagaccagccucugcuucuacaucgccgagcgggaguacugcaaguccugcagcgaggaggacacccagaagugcguggacaccaagcuggagcagccccaguccauccugaucgagcacaaggggacgaucaucggcaagcagaacgacacgugcaccgccaaggcgagcugcuggcucgaguccgucaagagcuucuucuacggccugaagaacaugcugggguccguguucggcaacuucuucaucgggauccuccuguuccuggcccccuucgugcugcucgugcuguucuucauguucggcuggaagauccuguucugcuucaagugcugccgccggacccgcgggcuccugaaguaccggcugcucaaggacgacgaggagaccggcuaccgccgcaucaucgagcggcugaacaacaagaagggcaagaaccgccugcucgacggggagcggcuggccgaccgcaagaucgccgagcuguucagcaccaagacccacaucggcuga

SEQ ID NO: 11945 - RNA, 5067 nt, Artificial Sequence
  derived and/or modified CDS sequence (opt1) from CCHFV(UCCR4405)__KY484029.1__GP
augcccaucaacaucaugcacgcccugcucgugugcuucauccuguaccugcagcucagcggccucgggggcgcccaccgccaguccaacgcgaccgagcacaacgggaccaacacgaccaccgccccgggcaccagccagucccccaagccgcccgucagcacgacccugccccacacccccgaggccuccaccaucaagcugacgacccccaccagcgagaccgagggguccggcgagacgacgcccccgcccaacaccacccagggccugccccugcccgggaccaccccggagcggagcgccaccaccgccacguccaccagcuccaccgacgacaugaacagcaccacgcagaugaccgacaacacccccaccuccacggugagcaucggccucuccagcucccccagcaugcccuccaccagccaggggauccacuacccggugcgcagccugcuguccgucagcucccccaagaccgcgaccacgcccacccccaugagcccgggcgaggugucccccgagaccagcucccagcacagcgccaugucccggauccccacccucuacacggccacccaggugagcaccgagaacaccaaccgcuccaucccccggcagagcgaguccagcguccagccggccacccagucccccaucacgagccccgcgcagaccauccugcugauguccgccgcccccaccgccauccaggacaugcacccgagccccaagaaccgcuccaagcggaaccucgagguggagaucauccugacccugagccaggggcucaagaaguacuacggcaagauccugaagcugcuccaccugacgcuggaggaggacaccgagggccuccuggaguggugcaagcgcaaccuggggagcaacugcgacgacgacuucuuccagaagcggaucgaggaguucuucaucaccggcgagggguacuucaacgaggugcuccaguucaagacccccuccacgcugagcccgaccgagcccucccacguccgccugcccaccgccgagcccuucaagagcuacuucgcgaagggcuuccucuccaucgacagcggcuacuucuccgccaagugcuacccgcggagcuccaccagcgggcugcagcugaucaacgugacgcagcaccccgcccgcaucgccgagacccccggccccaagaccaccucccucaagacgaucaacugcaucaaccugcgggccagcguguucaaggagcaccgcgaggucgagaucaacgugcugcucccgcagaucgcggugaaccuguccaacugccacgucgugaucaacagccacgugugcgacuacucccuggacaccgacgggcccguccggcucccccgcauccaccacgagggcgccuucauccccgggaccuacaagaucgugaucgacaagaagaacaagcugaacgaccggugcagccuggugaccaacugcgucaucaagggccgcgaggugcggaagggccaguccgugcuccgccaguacaagacggagaucaagaucgggaaggccagcaccggcagccggaagcugcuguccgaggagccgggggacgacugcaucagccgcacccagcuccugaagaccgagacggccgagauccacgacgacaacuacggcgggcccggcgacaagaucaccaucugcaacggcuccaccaucgucgaccagcgccuggggagcgagcucggcugcuacaccaucaaccgggugaaguccuucaagcugugcgagaacagcgccacggggaagaccugcgagaucgacuccacccccgucaagugccgccagggcuucugccugaagaucacccaggaggggcggggccacgugaagcugagccgcggcuccgaggugguccucgacgcgugcgacagcuccugcgaggugaugauccccaaggggacgggcgacauccugguggacugcagcgggggccagcagcacuuccugaaggacaaccucaucgaccugggcugcccgcacaucccccugcucgggaagauggccaucuacaucugccggauguccaaccacccccgcaccaccauggccuuccuguucugguucagcuucggcuacgucaucacgugcaucuucugcaaggcccuguucuacucccucaucaucaucgggacccugggcaagaagaucaagcaguaccgggagcugaagccccagaccugcaccaucugcgagaccgccccggugaacgcgaucgacgccgagaugcacgaccucaagugcagcuacaacaucugccccuacugcgccucccgccugaccagcgacgggcuggcccggcacgugacgcagugccccaagcgcaaggagaaggucgaggagaccgagcucuaccugaaccuggagcggauccccuggaucgugcgcaagcuccuccagguguccgagagcaccggcgucgcgcugaagcggagcuccuggcucaucgugcugcuggugcuccugaccgucagccuguccccggugcagagcgcccccgugggccacgggaagacgaucgagaccuaccagacccgcgagggcuucaccuccaucugccucuucaugcuggggagcauccuguucaucgucuccugccucgugaagggccugguggacagcgucuccgacagcuucuuccccgggcuguccgugugcaagacgugcagcaucggcuccaucaacggcuucgagaucgagagccacaagugcuacugcucccucuucugcugcccguacugccggcacuacagcgccgaccgcgagauccaccagcugcaccuguccaucugcaagaagcggaagaccgggagcaacgugaugcucgccgucugcaagcgcaugugcuucaaggccaccaucgaggcgucccggcgcgcccugcugauccgcagcaucaucaacaccacguucgugaucugcauccucauccuggccaucugcguggucagcaccuccgccguggagauggagaaccugcccgccggcaccugggagcgggaggaggaccucaccaacuucugccaccaggagugccaggugacggagaccgagugccugugccccuacgaggcgcugguccuccgcaagccccuguuccuggacagcaccgugaaggggaugaagaaccuccugaacuccaccagccuggagacgucccucagcaucgaggccccguggggcgccaucaacgugcaguccaccuucaagcccaccgucagcaccgccaacaucgcccuguccuggagcuccguggagcaccgggggaacaagauccuggugacgggccgcagcgaguccaucaugaagcucgaggagcggaccggcgucagcugggaccuggggguggaggacgcguccgagagcaagcugcucaccguguccaucauggaccugagccagauguacucccccgucuucgaguaccugagcggcgaccgccagguggaggaguggcccaaggcgaccugcacgggggacugcccggagcggugcggcugcaccagcagcacgugccuccacaaggaguggccccacucccgcaacuggcggugcaaccccaccuggugcuggggcguggggaccggcugcacgugcugcggggucgacgugaaggaccuguucaccgaccacauguucgugaaguggaaggucgaguacaucaagaccgaggccaucgugugcguggagcugaccucccaggagcgccagugcagccucaucgaggccggcacccgguucaaccuggggcccgucaccaucacccuguccgagccgcgcaacauccagcagaagcucccgcccgagaucaucacccugcaccccaagaucgaggagggcuucuucgaccugaugcacgugcagaaggugcucagcgccuccacggucugcaagcugcagagcugcacccacggcauccccggggaccugcagaucuaccacaucggcaaccuccugaagggggaccgggugaacggccaccugauccacaagaucgagccccacuucaacaccuccuggaugagcugggacgggugcgaccucgacuacuacugcaacaugggcaacuggcccuccugcaccuacacgggcgucacccagcacaaccacgccgccuucgugaaccugcugaacaucgagaccgacuacaccaagacguuccacuuccacagcaagcgcgugaccgcccacggggacacgccccagcucgaccugaaggcccggccgaccuacggcgcgggggagaucaccguccugguggagguggccgacauggagcuccacaccaagaaggucgagaucuccggccugaaguucgccagccuggugugcaccgggugcuacgccugcuccagcggcaucuccugcaaggugcgcauccacgucgacgagcccgacgagcucaccgugcacgucaagagcuccgaccccgacgugguggccgcgagcacgagccugauggcccggaagcuggaguucggcaccgacuccaucuucaaggccuucagcgccaugcccaagaccucccucugcuucuacaucguggagcgcgaguacugcaagagcugcuccgaggacgacaccaagaagugcgucgacacgaagcuggagcagccgcagagcauccugaucgagcacaaggggaccaucaucggcaagcagaacgacacgugcaccgccaaggcguccugcuggcucgagagcgugaaguccuucuucuacgggcugaagaacaugcugggcagcguguucgggaacuucuucgucggcauccuccuguuccuggcccccuucgugcugcucgugcuguucuucauguucggcuggaagauccuguucugcuucaagugcugccggcgcacccggggccucuucaaguaccgccaccugaaggacgacgaggagaccggguaccgccggaucaucgagcgccugaacuccaagaaggggaagaaccggcuccuggacggcgagcgccuggccgaccggaagaucgccgagcuguucagcaccaagacccacaucggcuga

SEQ ID NO: 11946 - RNA, 5067 nt, Artificial Sequence
  derived and/or modified CDS sequence (opt1) from CCHFV(Ast133)__KX056060.1__GP
augcccaucaacaucaagcacacccugcucgugugcuucauccuguaccugcagcucagcggccuggggggcgcccacgggcaguccaacgccaccgagcacaacggcacgaacaccaccaccgucccggggacgagccagucccccaagccccccgcgagcaccaccccgccccacacccccgaguccagcacggugaagcugaccacccccaccuccgagacggagggcagcggcgagaccaccccgccccccaacaccacgcaggggcucccccugccgggcaccacccccgagcgcuccgccaccacggccaccagcaccuccagcaccgacaacaugaacuccacgacccaggugaccgacaacacccccacgagcaccgucuccaucagccccuccagcuccccgagcaugcccagcaccucccaggggauccaccaccccgugcggagccugcucuccgugagcucccccaagaccgucacgaccccgacccccaugagccccggcgagaugucccccgagaccagcucccagcacuucgccaugagccgcaucccgacgcuguacaccgccacccagguguccaccgagaacaccgaccggagcacgccccgccaguccgagagcuccgugcagcccgcgacccagagccccaucaccuccccggcccagaccauccugcucaugagcgccgcccccaaggcgauccaggacaugcaccccuccccgacgaaccggagcaagcgcaaccuggaggucgagaucauccugacccucagccaggggcugaagaaguacuacggcaagauccugaagcuccugcaccugacccucgaggaggacaccgagggccugcuggaguggugcaagcggaaccucggguccaacugcgacgacgacuucuuccagaagcgcaucgaggaguucuucaucacgggcgagggguacuucaacgaggugcugcaguucaagacccugagcacccucucccccaccgagcccagccacgugcggcugcccacggccgagccguucaaguccuacuucgccaagggcuuccugagcaucgacuccggcuacuucagcgccaagugcuacccccgcuccagcaccuccgggcuccagcugaucaacgucacccagcaccccgcccggaucgcggagacccccggcccgaagacgaccagccugaagaccaucaacugcaucaaccuccgcgccuccguguucaaggagcaccgggagguggagaucaacguccugcugccccagaucgccgugaaccucagcaacugccacguggucaucaacucccacgugugcgacuacagccuggacaccgacgggcccgugcgccugccccggauccaccacgagggcacguucaucccggggaccuacaagaucgucaucgaccgcaagaacaagcucaacgaccggugcucccuggugaccaacugcgugaucaagggccgcgagguccggaagggccagagcgugcugcgccaguacaagaccgagaucaagaucgggaaggccagcacgggcucccggaagcuccugagcgaggagcccgacgacgacugcaucucccgcacccagcugcucaagaccgagaccgccgagauccacgacgacaacuacgggggccccggggacaagaucacgaucugcaacggcagcaccaucgucgaccagcgccugggcuccgagcuggggugcuacaccaucaaccgggugaagagcuucaagcucugcgagaacuccgcgaccggcaagacgugcgagaucgacagcacccccgugaagugccgccagggguucugccugaagaucacccaggagggccgggggcacgucaagcugucccgcggcagcgagguggugcuggacgccugcgacuccagcugcgagaucaugaucccgaagggcaccggggacauccucgucgacugcuccggcgggcagcagcacuuccugaaggacaaccugaucgaccucggcugcccccacaucccccugcugggcaagauggccaucuacaucugccggaugagcaaccacccccgcacgaccauggccuuccucuucugguucuccuucggguacgugaucaccugcaucuucugcaaggcccuguucuaccugcucaucaucaucggcacccuggggaagaagaucaagcaguaccgggagcugaagccgcagaccugcacgaucugcgagaccgcgcccgugaacgccaucgacgccgagaugcacgaccucaacugcagcuacaacaucugccccuacugcgccucccgccugaccagcgacggccuggcccggcacgucacccagugccccaagcgcaaggagaagguggaggagacggagcucuaccugaaccuggagcggaucccguggaucgugcgcaagcuccugcaggucuccgagagcaccgggguggcgcugaagcggagcuccuggcucaucgugcugcugguccuccugaccgugagccugucccccgugcagagcgcccccgucggccacggcaagaccaucgagacguaccagacccgcgagggguucaccuccaucugccucuucaugcugggcagcauccuguucaucguguccugccucgugaaggggcuggucgacagcguguccgacagcuucuucccgggccuguccgugugcaagaccugcagcaucggguccaucaacggcuucgagaucgagagccacaagugcuacugcucccucuucugcugccccuacugccggcacugcagcgccgaccgcgagauccaccagcugcaccuguccaucugcaagaagcggaagacgggcagcaacgucaugcucgccgugugcaagcgcaugugcuucaaggcgaccaucgaggccucccggcgcgcccugcugauccgcagcaucaucaacaccaccuucgugaugugcauccucacgcuggccaucugcgucgugagcaccuccgccguggagauggaggaccugcccgcggggaccugggagcgggaggaggaccucaccaacuucugccaccaggagugccaggucacggagaccgagugccugugccccuacgaggcccuggugcuccgcaagccgcuguucagcgacuccaucgugaagggcaugaagaaccugcucaacagcaccucccuggagaccagccuguccaucgaggcccccuggggggccaucaacguccagagcacguucaagcccaccguguccaccgccaacaucgcgcucagcugguccagcguggagcaccggggcaacaagauccuggucaccgggcgcuccgagagcaucaugaagcuggaggagcggacgggcguguccugggaccucggcguggaggacgccagcgaguccaagcugcugaccgucagcaucauggaccucucccagauguacagccccguguucgaguaccugagcggggaccgccagguggaggaguggccgaaggccaccugcaccggcgacugccccgagcggugcgggugcacguccagcaccugccugcacaaggaguggccccacucccgcaacuggcggugcaaccccaccuggugcuggggcgucgggaccggcugcacgugcugcggcguggacgugaaggaccucuucaccgaccacauguucaucaaguggaaggucgaguacaucaagaccgaggccaucgugugcguggagcugaccagccaggagcgccagugcucccugaucgaggccgggacccgguucaaccucggcccggucacgaucacccugagcgagccccgcaacauccagcagaagcugccccccgagaucaucacccuccacccgaagaucgaggagggguucuucgaccugaugcacgugcagaaggugcuguccgcgagcaccgucugcaagcuccaguccugcacgcacggcauccccggcgaccugcagaucuaccacaucgggaaccugcucaagggcgaccgggugaacgggcaccugauccacaagaucgagccccacuucaacaccagcuggauguccugggacggcugcgaccuggacuacuacugcaacaugggggacuggcccagcugcaccuacaccggcgucacgcagcacaaccacgccgccuucgugaaccuccugaacaucgagaccgacuacaccaagaccuuccacuuccacuccaagcgcgugacggcccacggcgacaccccgcagcuggaccucaaggcgcggcccaccuacggggccggcgagaucaccguccugguggagguggccgacauggagcugcacacgaagaaggucgagaucagcgggcucaaguucgccucccugaccugcaccggcugcuacgccugcagcuccgggaucagcugcaaggugcgcauccacguggacgagcccgacgagcugaccguccacgugaaguccagcgaccccgacguggucgcggccagcacgucccucauggcccggaagcuggaguucggcaccgacagcaccuucaaggccuucuccgccaugccgaagaccagccugugcuucuacaucguggagcgcgaguacugcaaguccugcagcgaggacgacacgaagaagugcguggacaccaagcucgagcagccccaguccauccugaucgagcacaagggcaccaucaucgggaagcagaacgacaccugcacggcgaaggccagcugcuggcuggaguccgucaagagcuucuucuacggccucaagaacaugcugggguccguguucggcagcuucuucguggggauccugcucuuccuggcccccuucguccugcuggugcucuucuucauguucggcuggaagauccuguucugcuucaagugcugccggcgcacccggggccuguucaaguaccgccaccucaaggacgacgaggagaccggguaccgccggaucaucgagcgccugaacuccaagaagggcaagaaccggcugcucgacggggagcgccuggccgaccggaagaucgccgagcuguucagcuccaagacccacaucggcuga

SEQ ID NO: 11947 - RNA, 5067 nt, Artificial Sequence
  derived and/or modified CDS sequence (opt1) from CCHFV(Ast137)__KX056057.1__GP
augcccaucaacaucaugcacacccugcucgugugcuucauccuguaccugcagcucagcggccucgggggcgcccacgggcaguccaacgccaccgagcacaacggcacgaacaccaccaccgucccggggacgagccagucccccaagccgcccgcgagcaccacccugccccacacccccgaguccagcacggugaagcugaccacccccaccuccgagacggagggcagcggcgagaccacgcccccgcccaacaccacccaggggcugcccccgcccggcaccacccccgagcgccccgccaccacggccaccuccaccagcuccaccgacaacaugaacagcacgacccaggugaccgacaacacccccacguccaccgucagcaucuccccgagcuccagccccuccaugcccagcaccagccaggggauccacuaccccgugcggucccugcucagcguguccagcccgaagaccgucacgacccccacccccaugucccccggcgagaugagcccggagaccuccagccagcacuccgccaugagccgcauccccacgcuguacaccgccgcccagguguccaccgagaacaccaaccggagcacgccccgccaguccgagagcuccgcccagcccgccacccagagcccgaccaccuuccccgcccagaccauccugcucauguccgcggcccccaaggccauccaggacaugcacccgagccccacgaaccgguccaagcgcaaccuggagguggagaucauccugacccucagccaggggcugaagaaguacuacggcaagauccugaagcuccugcaccugacccucgaggaggacaccgagggccugcuggaguggugcaagcggaaccucgggagcaacugcgacgacgacuucuuccagaagcgcaucgaggaguucuucaucacgggcgagggguacuucaacgagguccugcaguucaagacccuguccacccucagccccaccgagcccucccacgugcggcugccgacggccgagcccuucaagagcuacuucgccaagggcuuccuguccaucgacagcggcuacuucuccgcgaagugcuacccccgcagcuccaccagcgggcuccagcugaucaacgugacccagcaccccgcccggaucgccgagaccccgggccccaagacgaccucccugaagaccaucaacugcaucaaccuccgcgccagcgucuucaaggagcaccgggagguggagaucaacgugcugcugccccagaucgccgucaaccucuccaacugccacguggugaucaacagccacgucugcgacuacucccuggacaccgacgggcccgugcgccugccgcggauccaccacgagggcacguucauccccgggaccuacaagaucgugaucgacaagaagaacaagcucaacgaccgcugcagccuggucaccaacugcgugaucaagggccgggaggugcgcaagggccaguccguccugcggcaguacaagaccgagaucaagaucgggaaggcgagcacgggcagccgcaagcuccuguccgaggagcccggggacgacugcaucagccggacccagcugcucaagaccgagaccgccgagauccacgacgacaacuacggcgggcccggcgacaagaucacgaucugcaacggcuccaccaucguggaccagcgccucgggagcgagcugggcugcuacaccaucaaccgcgucaaguccuucaagcucugcgagaacagcgcgaccgggaagacgugcgagaucgacuccaccccggugaagugccggcagggcuucugccugaagaucacccaggaggggcgcggccacgugaagcugagccggggcuccgaggucgugcuggacgccugcgacagcuccugcgagaucaugauccccaaggggaccggcgacauccucguggacugcagcgggggccagcagcacuuccugaaggacaaccugaucgaccucggcugcccccacaucccccugcuggggaagauggccauccacaucugccgcauguccaaccacccgcggacgaccauggcguuccucuucugguucagcuucggcuacgucaucacgugcaucuucugcaaggcccuguucuacucccugaucaucaucgggacccucggcaagaagaucaagcaguaccgcgagcugaagccccagaccugcaccaucugcgagaccgcccccgugaacgccaucgacgccgagaugcacgaccugaacugcagcuacaacaucugccccuacugcgcgucccggcucaccagcgacgggcuggcccgccacgugacccagugcccgaagcggaaggagaaggucgaggagacggagcuguaccucaaccuggagcgcauccccuggaucgugcggaagcugcuccagguguccgagagcaccggcgucgcccugaagcgcagcuccuggcugaucgugcuccuggugcugcucaccgucagccugucccccgugcagagcgccccggugggccacgggaagaccaucgagacguaccagacccgggagggcuucaccaacaucugccuguucaugcucggguccauccuguucaucgucagcuaccuggugaagggccucguggacuccgucagcgacuccuucuuccccgggcugagcgugugcaagaccugcuccaucggcagcaucaacggcuucgagaucgagucccacaagugcuacugcagccuguucugcugccccuacugccgccacugcuccgcggaccgggagauccaccagcuccaccuggggaucugcaagaagcgcaagacgggcagcaacgugaugcuggccgucugcaagcggaugugcuucaaggccaccaucgaggccucccgccgggcccuccugauccgcagcaucaucaacaccaccuucgugaucugcauccugacgcucgcgaucugcguggucuccaccagcgccguggagauggagaaccugcccgccgggaccugggagcgcgaggaggaccugaccaacuucugccaccaggagugccaggugacggagaccgagugccucugcccguacgaggcccugguccugcggaagccccucuuccuggacagcaucgugaagggcaccaagaaccugcucaacuccaccagccuggagacgucccugagcaucgaggcccccuggggcgcgaucaacgugcaguccaccuucaagcccaccgucagcaccgccaacaucgcccucuccuggagcuccguggagcaccgcgggaacaagauccuggugacgggccggagcgaguccaucaugaagcuggaggagcgcaccggggucagcugggaccucggcguggaggacgccuccgagagcaagcugcugaccguguccaucauggaccucagccagauguacuccccggucuucgaguaccugagcggggaccgccagguggaggaguggcccaaggccacgugcaccggcgacugccccgagcggugcgggugcaccuccuccacgugccugcacaaggaguggccccacagccggaacuggcgcugcaacccgaccuggugcuggggcgugggcaccgggugcacgugcugcggcgucgacgugaaggaccucuucaccgaccacauguucaucaaguggaagguggaguacaucaagaccgaggcgaucgucugcguggagcugaccagccaggagcggcagugcagccugaucgaggccgggacccgcuucaaccucggccccgugaccaucacccuguccgagccccggaacauccagcagaagcugcccccggagaucaucacccuccaccccaagaucgaggagggcuucuucgaccugaugcacguccagaaggugcugagcgccuccacggugugcaagcuccagagcugcacccacgggauccccggcgaccugcagaucuaccacaucgggaaccugcucaagggcgaccgccugaacgggcaccugauccacaagaucgagccccacuucaacaccuccuggaugagcugggacggcugcgaccucgacuacuacugcaacaugggcgacuggccguccugcaccuacacgggggucacccagcacaaccacgccgcguucgugaaccugcugaacaucgagaccgacuacaccaagacguuccacuuccacagcaagcgggucaccgcccacggcgacacgccccagcucgaccugaaggcccgccccaccuacggggccggcgagaucaccgugcugguggaggucgccgacauggagcuccacaccaagaagguggagguguccgggcugaaguucgcgagccuggccugcaccggcugcuacgccugcuccagcggcaucuccugcaagguccggauccacguggacgagcccgacgagcucaccgugcacgucaagagcuccgacccggacgugguggccgccagcacgucccugauggcgcgcaagcuggaguucgggaccgacagcaccuucaaggccuucagcgccaugcccaagaccucccucugcuucuacaucgucgagcgggaguacugcaagagcugcuccgaggacgacacgaagaagugcguggacaccaagcuggagcagccccagagcauccugaucgagcacaagggcaccaucaucgggaagcagaacgacacgugcaccgccaaggccuccugcuggcucgagagcgugaaguccuucuucuacggccugaagaacaugcuggggagcgucuucggcaacuucuucgugggcauccuccuguuccuggcgcccuucgugcugcucguccuguucuucaucuucggguggaagauccuguucugcuucaagugcugccgccggacccgcggccucuucaaguaccggcaccugaaggacgacgaggagaccggguaccgcaagaucaucgagcgccugaacuccaagaagggcaagaaccggcuccuggacggcgagcgccuggccgaccggaagaucgccgagcuguucagcaccaagacgcacaucggguga

SEQ ID NO: 11948 - RNA, 5067 nt, Artificial Sequence
  derived and/or modified CDS sequence (opt1) from CCHFV(Ast149)__KX056054.1__GP
augcccaucaacaucaugcacacccugcucgugugcuucauccuguaccugcagcucagcggccuggggggcgcccacgggcaguccaacgccaccgagcacaacggcacgaacaccaccaccgcgccggggacgagccagucccccaagccccccgccagcaccaccccgccccacacccccgaguccagcacggucaagcugaccacccccaccuccgagacggagggcagcggcgagaccaccccgccccccaacaccacgcaggggcuccccccgcccggcaccacccccgagcgccccgccaccacggccaccuccaccagcuccaccgacaacaugaacagcacgacccaggugaccgacaacaccccgacguccaccgugagcaccucccccagcuccagccccuccaugcccagcaccagccaggggauccacuacccgguccggucccugcugagcguguccagccccaagacggugaccacccccacccccauguccccgggcgagaugagccccgagacguccagccagcacuccgccaugagccgcauccccacccucuacaccgcggcccaggucuccaccgagaacgccaaccggagcaccccccgccaguccgagagcuccgcccagccggcgacgcagagccccaccaccuuccccgcccagaccauccugcugauguccgccgccccgaaggccauccaggacaugcaccccagccccacgaaccgguccaagcgcaaccucgagguggagaucauccugacccugagccaggggcucaagaaguacuacggcaagauccugaagcugcuccaccugacccuggaggaggacaccgagggccuccuggaguggugcaagcggaaccuggggagcaacugcgacgacgacuucuuccagaagcgcaucgaggaguucuucaucacgggcgagggguacuucaacgaggugcuccaguucaagacccuguccacccugagccccaccgagccgucccacguccggcuccccacggcggagcccuucaagagcuacuucgccaagggcuuccuguccaucgacagcggcuacuucuccgccaagugcuacccccgcagcuccaccagcgggcugcagcucaucaacgugacccagcacccggcccggaucgccgagacccccggccccaagacgaccucccugaagaccaucaacugcaucaaccugcgcgcgagcguguucaaggagcaccgggaggucgagaucaacgugcuccugccccagaucgccgugaaccuguccaacugccacgucgugaucuacagccacgugugcgacuacucccucgacaccgacgggccgguccgccugccccggauccaccacgagggcacguucauccccgggaccuacaagaucgugaucgacaagaagaacaagcugaacgaccgcugcagccucgugaccaacugcgucaucaagggccgggaggugcgcaagggccaguccgugcugcggcaguacaagaccgagaucaagaucgggaaggccagcacgggcagccgcaagcugcucuccgaggagcccggggacgacugcaucagccggacccagcugcugaagaccgagaccgccgagauccacgacgacaacuacggcgggccgggcgacaagaucacgaucugcaacggcuccaccaucgucgaccagcgccucgggagcgagcugggcugcuacaccaucaaccgcgugaaguccuucaagcugugcgagaacagcgccaccgggaagacgugcgagaucgacuccacccccgucaagugccggcagggcuucugccucaagaucacccaggaggggcgcggccacgugaagcugagccggggcuccgaggugguccuggacgcgugcgacagcuccugcgagaucaugauccccaaggggaccggcgacauccugguggacugcagcgggggccagcagcacuuccucaaggacaaccugaucgaccugggcugcccccacaucccgcuccuggggaagauggccaucuacaucugccgcauguccaaccacccccggacgaccauggccuuccuguucugguucagcuucggcuacgugaucaccugcaucuucugcaaggcccucuucuacucccugaucaucaucgggacccugggcaagaagaucaagcaguaccgcgagcucaagccccagaccugcacgaucugcgagaccgcccccgucaacgcgaucgacgccgagaugcacgaccugaacugcagcuacaacaucugcccguacugcgccucccggcugaccagcgacgggcucgcccgccacgugacccagugccccaagcggaaggagaagguggaggagacggagcuguaccugaaccucgagcgcauccccuggaucguccggaagcugcugcagguguccgagagcaccggcguggcgcucaagcgcagcuccuggcugaucguccugcucgugcugcugaccgugagccucuccccgguccagagcgcccccgugggccacgggaagaccaucgagacguaccagacccgggagggcuucaccaacaucugccuguucaugcugggguccauccucuucaucgugagcugccuggucaagggccugguggacuccgugagcgacuccuucuuccccgggcucagcgucugcaagaccugcuccaucggcagcaucaacggcuucgagaucgagucccacaagugcuacugcagccuguucugcugccccuacugccgccacugcuccgccgaccgggagauccaccagcugcaccucgggaucugcaagaagcgcaagacgggcagcaacgugaugcuggccgugugcaagcggaugugcuucaaggccaccaucgaggcgucccgccgggcccugccgauccgcagcaucaucaacaccaccuucgucaucugcauccucacgcuggccaucugcgugguguccaccagcgccgucgagauggagaaccugcccgccgggaccugggagcgcgaggaggaccucaccaacuucugccaccaggagugccaggugacggagaccgagugccugugccccuacgaggcgcuggugcuccggaagccccuguuccuggacagcaucgucaagggcaugaagaaccuccugaacuccaccagccuggagaccucccucagcaucgaggccccguggggggccaucaacgugcaguccacguucaagcccaccgugagcaccgccaacaucgcccuguccuggagcuccgucgagcaccgcggcaacaagauccuggugaccggccggagcgaguccaucaugaagcucgaggagcgcacgggggugagcugggaccugggcgucgaggacgcguccgagagcaagcugcucaccguguccaucauggaccugagccagauguacucccccguguucgaguaccugagcggggaccggcaggucgaggaguggcccaaggccaccugcaccggcgacugcccggagcgcugcgggugcacguccagcaccugccuccacaaggaguggccccacagccggaacuggcgcugcaaccccaccuggugcuggggcgugggcaccgggugcacgugcugcggcguggacgucaaggaccuguucaccgaccacauguucaucaaguggaagguggaguacaucaagaccgaggccaucgugugcgucgagcugaccucccaggagcggcagugcagccucaucgaggccgggacccgcuucaaccugggccccgugacgaucacccuguccgagccgcggaacauccagcagaagcucccccccgagaucaucacccugcaccccaagaucgaggagggcuucuucgaccugaugcacgugcagaagguccucagcgcguccaccgugugcaagcugcagagcugcacgcacgggaucccgggcgaccugcagaucuaccacaucgggaaccuccugaagggcgaccgccugaacgggcaccucauccacaagaucgagccccacuucaacaccuccuggaugagcugggacggcugcgaccuggacuacuacugcaacaugggcgacuggcccuccugcaccuacaccggggugacgcagcacaaccacgccgccuucgucaaccugcucaacaucgagaccgacuacaccaagaccuuccacuuccacagcaagcgggugacggcccacggcgacaccccccagcuggaccugaaggcccgcccgaccuacggggcgggcgagaucaccguccucguggagguggccgacauggagcugcacacgaagaaggucgagguguccgggcugaaguucgccagccucgccugcaccggcugcuacgccugcuccagcggcaucuccugcaaggugcggauccacgucgacgagcccgacgagcugaccgugcacgugaagagcuccgaccccgacgucguggcggccagcaccucccugauggcccgcaagcucgaguucgggacggacagcaccuucaaggccuucagcgccaugcccaagaccucccugugcuucuacaucguggagcgggaguacugcaagagcugcuccgaggacgacaccaagaagugcgucgacacgaagcuggagcagccgcagagcauccucaucgagcacaagggcaccaucaucgggaagcagaacgacaccugcaccgcgaaggccuccugcuggcuggagagcgugaaguccuucuucuacggccugaagaacaugcucgggagcguguucggcaacuucuucgucggcauccugcuguuccucgcccccuucgugcugcuggcccuguucuucaucuucggguggaagauccucuucugcuucaagugcugccgccggacgcgcggccuguucaaguaccggcaccugaaggacgacgaggagaccggguaccgcaagaucaucgagcgccucaacuccaagaagggcaagaaccggcugcuggacggcgagcgccucgcggaccggaagaucgccgagcuguucagcaccaagacccacaucggguga

SEQ ID NO: 11949 - RNA, 5067 nt, Artificial Sequence
  derived and/or modified CDS sequence (opt1) from CCHFV(Ast199)__KX056051.1__GP
augcccaucaacaucaugcacacccugcucgugugcuucauccuguaccugcagcucagcggccucgggggcgcccacguccaguccaacgccaccgagcacaacgggacgaacaccaccaccgugccgggcacgagccagucccccaagccgcccgcgagcaccacccugccccacacccccgaguccagcacggugaagcugaccacccccaccuccgagacggaggggagcggcgagaccacgcccccgcccaacaccacccagggccugcccccgcccgggaccacccccgagcgccccgccaccacggccaccaccaccuccagcacggacaacaugaacuccaccacccaggucaccgacaacacgcccaccagcaccguguccaucagcccguccagcaaccccuccaugcccagcaccucccagggcauccacuaccccgugcggagccugcucagcgucuccagcccgaagacggugaccacccccacccccaugucccccggggagaugagcccggagacguccagccagcacuccgccaugagccgcauccccacccuguacaccgccgcccagguguccaccgagaacaccaaccggagcacgccccgccaguccgagagcuccgcccagcccgccacccagagcccgaccaccuuccccgcccagacgaucccccugauguccgcggccccgaaggccauccaggacaugcaccccagccccaccaaccgguccaagcgcaaccucgaggucgagaucauccugacccugagccagggccucaagaaguacuacgggaagauccugaagcugcuccaccugacccuggaggaggacacggagggccuccuggaguggugcaagcggaaccugggcuccaacugcgacgacgacuucuuccagaagcgcaucgaggaguucuucaucaccggggagggcuacuucaacgaggugcuccaguucaagacccccagcacccugagcccgacggagcccucccacgugcggcugcccaccgccgagcccuucaagagcuacuucgccaagggguuccucuccaucgacagcggcuacuucuccgcgaagugcuacccgcgcagcuccaccagcggccugcagcugaucaacgucacccagcaccccgcccggaucgccgagacgcccgggcccaagaccaccucccucaagaccaucaacugcaucaaccugcgcgccagcguguucaaggagcaccgggagguggagaucaacguccugcucccgcagaucgccgugaaccuguccaacugccacguggucaucaacagccacgugugcgacuacucccuggacacggacggccccgugcgccucccccggauccaccacgaggggaccuucauccccggcaccuacaagaucgucaucgacaagaagaacaagcugaacgaccgcugcagccuggugaccaacugcgugaucaaggggcgggagguccgcaagggccaguccgugcuccggcaguacaagacggagaucaagaucggcaaggcgagcaccgggucccgcaagcugcugagcgaggagccgggcgacgacugcaucagccggacccagcuccugaagaccgagacggccgagauccacgacgacaacuacgggggccccggggacaagaucaccaucugcaacggcuccaccaucgucgaccagcgccugggcagcgagcucgggugcuacaccaucaaccgcgugaaguccuucaagcugugcgagaacagcgcgacgggcaagaccugcgagaucgacuccacccccgugaagugccggcagggguucugccugaagaucacccaggagggccgcgggcacgucaagcucagccggggcuccgagguggugcuggacgccugcgacagcuccugcgagaucaugauccccaagggcacgggggacauccuggucgacugcagcggcgggcagcagcacuuccugaaggacaaccucaucgaccugggcugcccgcacaucccccugcucggcaagauggccaucuacaucugccgcauguccaaccacccccggaccaccauggcguuccuguucugguucagcuucggguacgugaucacgugcaucuucugcaaggcccuguucuacucccucaucaucaucggcacccuggggaagaagaucaagcaguaccgcgagcugaagccccagaccugcaccaucugcgagaccgccccggugaacgccaucgacgccgagaugcacgaccucaacugcagcuacaacaucugccccuacugcgcgucccggcugaccagcgacggccuggcccgccacgucacgcagugccccaagcggaaggagaagguggaggagaccgagcucuaccugaaccuggagcgcaucccguggaucgugcggaagcuccugcaggucuccgagagcaccgggguggcccugaagcgcugcuccuggcucaucgugcugcugguccuccugaccgugagccugagccccgugcaguccgcccccgucggccacggcaagacgaucgagaccuaccagacccgggagggguucaccaacaucugccucuucaugcugggcagcauccuguucaucguguccugccucgugaaggggcuggucgacagcguguccgacagcuucuuccccggccuguccgugugcaagacgugcagcaucggguccaucaacggcuucgagaucgagagccacaagugcuacugcucccucuucugcugcccguacugccgccacugcagcgcggaccgggagauccaccagcugcaccugggcaucugcaagaagcgcaagaccggguccaacgucaugcucgccgugugcaagcggaugugcuucaaggccaccaucgaggccagccgccgggcccugcugauccgcuccaucaucaacaccacguucgugaucugcauccucacccuggcgaucugcgucgugagcaccuccgccguggagauggagaaccugcccgccggcaccugggagcgcgaggaggaccucacgaacuucugccaccaggagugccaggucaccgagaccgagugccugugccccuacgaggcccuggugcuccggaagccccuguuccuggacagcaucgugaaggggaugaagaaccuccugaacuccaccagccuggagacgagccucuccaucgaggccccguggggcgcgaucaacguccagagcaccuucaagcccaccguguccaccgccaacaucgcccugagcugguccagcguggagcaccgcgggaacaagauccuggucacgggccgguccgagagcaucaugaagcucgaggagcgcaccggcguguccugggaccuggggguggaggacgccagcgaguccaagcugcucaccgucagcaucauggaccugucccagauguacagccccguguucgaguaccuguccggcgaccgccagguggaggaguggcccaaggccacgugcaccggggacugcccggagcggugcggcugcaccagcagcacgugccuccacaaggaguggccccacucccggaacuggcgcugcaaccccaccuggugcuggggcgucgggaccggcugcacgugcugcgggguggacgugaaggaccuguucaccgaccacauguucaucaaguggaaggucgaguacaucaagaccgaggcgaucgugugcguggagcugaccucccaggagcggcagugcagccucaucgaggccggcacccgcuucaaccuggggcccgucaccaucacccugagcgagccgcggaacauccagcagaagcucccgcccgagaucaucacccugcaccccaagaucgaggagggcuucuucgaccugaugcacgugcagaaggugcucuccgccagcacggucugcaagcugcaguccugcacccacggcauccccggggaccugcagaucuaccacaucggcaaccuccugaagggggaccgccugaacggccaccucauccacaagaucgagccccacuucaacaccagcuggauguccugggacgggugcgaccuggacuacuacugcaacaugggcgacuggcccagcugcaccuacacgggcgugacccagcacaaccacgccgcguucgucaaccugcucaacaucgagaccgacuacaccaagacguuccacuuccacuccaagcgggugaccgcccacggggacacgccccagcuggaccugaaggcccgcccgaccuacggcgccggggagaucaccgugcucgucgagguggccgacauggagcugcacaccaagaagguggaggucagcggccugaaguucgcgucccucgccugcaccgggugcuacgccugcagcuccggcaucagcugcaaggugcggauccacguggacgagcccgacgagcugaccguccacgugaaguccagcgaccccgacguggucgccgccuccacgagccugauggcgcgcaagcucgaguucggcaccgacuccaccuucaaggccuucagcgccaugcccaagaccucccugugcuucuacaucguggagcgggaguacugcaagagcugcagcgaggacgacacgaagaagugcguggacaccaagcuggagcagccgcaguccauccucaucgagcacaaggggaccaucaucggcaagcagaacgacacgugcaccgccaaggccagcugcuggcuggaguccgucaagagcuucuucuacgggcugaagaacaugcucggcuccguguucgggaacuucuucgugggcauccugcuguuccucgcgcccuucguccugcuggugcuguucuucaucuucggcuggaagauccucuucugcuucaagugcugccgccggacccgcgggcuguucaaguaccggcaccugaaggacgacgaggagaccggcuaccgcaagaucaucgagcgccucaacagcaagaaggggaagaaccggcugcuggacggcgagcgccucgccgaccggaagaucgccgagcuguucuccaccaagacgcacaucggcuga

SEQ ID NO: 11950 - RNA, 5067 nt, Artificial Sequence
  derived and/or modified CDS sequence (opt1) from CCHFV(Saf)__KX013487.1__GP
augcccaccaacaucaugcacacccugcucgugugcuucauccuguaccugcagcuccugggccucgggggcgcccacgggcagagcaacgccacggagcacaacggcaccaacaccaccacggcgccguccaccagccagucccccaagccccuggucagcaccgcgcccccgcacgcccuggaguccagcaccaucaagcccacgacccccgccuccgagaccgaggggagcggcgagaccacgcccccgcccaacaccacccagggccccuccccgcccgagaccacgcccgagcgccccgccaccaccgccaccagcacgcccuccaccgacaacaccaacagcaccacgcacgugaccgacaacaacccgaccuccaccaucagcacgucccccagcuccagccccuccacccccagcaccccgcaggggauccaccaccccgcccggaaccugcucagcguguccagccccaagaccgccacgacccccaccccgaccucccccggcgagaucagcuccgagacgagcucccugcacagcgccaugucccgcaccagcacccuguacaccgcgacccaggucuccacggagaacgccaaccacagcgcgccccggcaguccgagagcuccgcccagcccaccaccaccagcccgaugacgucccccgcccagagcauccucgugauguccgccgcccccaccgccauccagaacauccacccgagccccaccaaccgcagcaagcggaaccuggagauggagaucauccugacccucucccaggggcugaagaaguacuacggcaagauccugaagcuccugcaccugacgcucgaggaggacaccgaggggcugcuggaguggugcaagcgcaaccucggcagcaacugcgacgacgacuucuuccagaagcggaucgaggaguucuucaugaccggcgagggguacuucaacgaggugcugcaguucaagacccuguccacgcucagccccaccgagcccucccacgcccgcccgcccaccgucgagcccuucaagagcuacuucgccaagggcuuccuguccaucgacagcggguacuucuccgcgaagugcuacccccggagcuccaccagcggccugcagcucaucaacgugacgcagcacccggcccgcaucgccgagacccccggccccaagaccaccucccugaagacgaucaacugcaucaaccugcgggccagcguguucaaggagcaccgcgagaucgagaucaacguccuccugccccagaucgccgugaaccuguccaacugccacguggucaucaacagccacgugugcgacuacucccucgacaccgacgggccggugcggcugccccacauccaccacgagggcaccuucauccccgggaccuacaagaucgucaucgacaaggagaacaagcugaacgaccgcugcacgcucgugaccaacugcgugaucaagggccgggagguccgcaaggggcagagcgugcugcggcaguacaagaccgagaucaagaucggcaaggcgagcaccggcucccgcaagcugcucagcgaggagcccggggacgacugcaucucccggacgcagcugcugcgcaccgagaccgccgagauccacgacgacaacuacggcgggccgggcgacaagaucaccaucugcaacgggagcacgaucguggaccagcggcucggcuccgagcugggcugcuacaccaucaaccgcgucaagagcuucaagcugugcgagaacuccgccaccgggaagaccugcgagaucgacagcacgcccgugaagugccgccagggcuucugccucaagaucacccaggaggggcggggccacgugaagcugucccgcgggagcgaggucgugcuggacgccugcgacuccagcugcgaggucaugauccccaagggcaccggcgacauccugguggacugcuccgggggccagcagcacuaccucaaggacaaccugaucgaccuggggugcccccacaucccgcuccugggcaagauggccaucuacaucugccggaugagcaaccacccccgcaccaccauggcguuccuguucugguucuccuucggcuacgugaucacgugcaucuucugcaaggcccucuucuacagccugaucaucaucgggacccugggcaagaagaucaagcaguaccgggagcucaagccccagaccugcaccaucugcgagacggcccccgucaacgccaucgacgcggagaugcacgaccugaacugcuccuacaacaucugcccguacugcgccagccgccugaccuccgacgggcucgcccggcacgugccccagugccccaagcgcaaggagaagguggaggagaccgagcuguaccugaaccucgagcggaucccguggaucguccgcaagcugcuccaggugagcgagagcaccggcguggcccugaagcgguccagcuggcugaucguccugcucgugcugcugacggugucccucagccccguccaguccgcccccguggggcacggcaagaccaucgagaccuaccagacccgcgagggcuucacgagcaucugccuguucaugcugggguccauccucuuccuggugagcugccuggucaagggccucguggacuccgugagcgacuccuucuuccccgggcugagcgucugcaagaccugcuccaucggcagcaucaacggguucgagaucgagucccacaagugcuacugcagccuguucugcugcccguacugccggcacugcuccgcggaccgcgagauccaccagcuccaccugagcaucugcaagaagcggaagaccggcuccaacgugaugcuggccgugugcaagcgcaugugcuuccgggccaccaucgaggccagccgccgggcccuccugauccgcagcaucaucaacacgaccuucgucaucugcauccugacccucaccaucugcgugguguccacgagcgcggucgagauggagaaccugcccuccggcaccugggagcgcgaggaggaccugaccaacuucugccaccaggagugccaggugaccgagacggagugccucugccccuacgaggcccuggugcugcggaagccccucuucagcgacuccaucgucaaggggaugaagaaccugcugaacagcaccucccucgagaccagccuguccaucgaggccccguggggcgccaucaacgugcagagcaccuucaagcccacgguguccaccgccaacaucgcgcugagcugguccagcgucgagcaccgcgggaacaagauccucgugaccggccgguccgagagcaucaugaagcuggaggagcgcaccgggguguccugggaccugggcgucgaggacgccagcgaguccaagcuccugacggugagcaucauggaccugagccagauguacucccccguguucgaguaccucagcggcgaccggcaggucgaggaguggcccaaggcgaccugcaccggggacugcccggagcgcugcggcugcaccuccagcacgugccugcacaaggaguggccccacucccggaacuggcgcugcaaccccaccuggugcuggggcguggggaccgggugcacgugcugcggcguggacgucaaggaccuguucaccgaccacauguucgugaaguggaagguggaguacaucaagaccgaggccaucgucugcguggagcucaccagccaggagcggcagugcucccugaucgaggccggcacccgcuucaaccuggggcccgugaccaucacgcucagcgagccgcggaacauccagcagaagcugccgcccgagaucaucacccugcaccccaaggucgaggagggcuucuucgaccucaugcacgugcagaaggugcuguccgccagcaccgucugcaagcugcaguccugcacccacgggauccccggcgaccuccagguguaccacaucggcaaccugcugaagggggaccgcgugaacggccaccucauccacaagaucgagccccacuucaacacgagcuggauguccugggacgggugcgaccuggacuacuacugcaacaugggcgacuggcccagcugcaccuacaccggggucacccagcacaaccacgccgccuucgugaaccugcucaacaucgagacggacuacaugaagaccuuccacuuccacuccaagcgggucaccgcccacggcgacacgccccagcuggaccugaaggcgcgcccgaccuacggcgccggggagaucaccgugcucguggaggucgccgacauggagcugcacaccaagaagguggagaucagcggccugaaguucgugucccucgccugcaccgggugcuacgccugcagcuccggcaucagcugcaagguccggauccacguggacgagcccgacgagcugacggugcacgucaagagcuccgaccccgacgugguggcggccagcaccucccugauggcccgcaagcucgaguucgggaccgacagcaccuucaaggccuucuccgccaugcccaagacgagccugugcuucuacaucgucgagcgggaguacugcaaguccugcagcgaggaggacacccagaagugcguggacaccaagcuggagcagccgcaguccauccucaucgagcacaagggcaccaucaucggcaagcagaacgacacgugcaccgcgaaggccagcugcuggcuggaguccgucaagagcuucuucuacgggcugaagaacaugcucggcuccguguucgggaacuucuucaucggcauccugcuguuccucgcccccuucgugcugcuggugcuguucuucauguucggguggaagauccucuucugcuucaagugcugccgccggacccgcggccugcugaaguaccggcaccucaaggacgacgaggagaccggcuaccgccgcaucaucgagcggcugaacaacaagaaggggaagaaccgccugcucgacggcgagcggcuggccgaccgcaagaucgcggagcuguucagcacgaagacccacaucggguga

SEQ ID NO: 11951 - RNA, 5067 nt, Artificial Sequence
  derived and/or modified CDS sequence (opt1) from CCHFV(Min)__KX013481.1__GP
augcccaccaacaucaugcacacccugcucgugugcuucauccuguaccugcagcuccugggccuggggggcgcccacgggcagagcaacgccacggagcacaacggcaccaacaccaccacggcgccguccaccagccagucccccaagccccucgucagcaccgcccccccgcacgcccuggaguccagcaccaucaagcccacgacccccgccuccgagaccgaggggagcggcgagaccacgcccccgcccaacaccacccagggccccucccccccggagaccacgcccgagcgccccgccaccaccgcgaccagcacgcccuccaccgacaacaccaacagcaccacgcacgugaccgacaacaacccgaccuccaccaucagcacgucccccagcuccagccccuccacccccagcaccccgcaggggauccaccaccccgcccggaaccugcucagcguguccagccugaagaccgccacgacccccacccccaccuccccgggcgagaucagcuccgagacgagcucccugcacagcgccaugucccgcaccagcacccucuacaccgcgacccaggucuccacggagaacgccaaccacagcgccccccggcaguccgagagcuccgcccagcccaccaccaccagccccaugacguccccggcccagagcauccuggugauguccgcggcccccaucgccauccagaacauccaccccagcccgaccaaccgcagcaagcggaaccuggagauggagaucauccucacccugucccaggggcugaagaaguacuacggcaagauccucaagcugcugcaccucacccuggaggaggacacggaggggcugcucgaguggugcaagcgcaaccugggcagcaacugcgacgacgacuucuuccagaagcggaucgaggaguucuucaugaccggcgagggguacuucaacgaggugcugcaguucaagacccucuccacccugagccccacggagcccucccacgcccgccccccgaccgucgagcccuucaagagcuacuucgccaagggcuuccuguccaucgacagcggguacuucuccgcgaagugcuacccccggagcuccaccagcggccuccagcugaucaacgugacccagcaccccgcccgcaucgccgagacgccgggccccaagaccaccucccugaagaccaucaacugcaucaaccuccgggccagcguguucaaggagcaccgcgagaucgagaucaacguccugcugccccagaucgccgugaaccucuccaacugccacguggucaucaacagccacgugugcgacuacucccuggacacggacgggcccgugcggcugccgcacaucuaccacgagggcaccuucauccccgggaccuacaagaucgucaucgacaagaagaacaagcucaacgaccgcugcacccuggugacgaacugcgugaucaagggccgggagguccgcaaggggcagagcgugcugcggcaguacaagaccgagaucaagaucggcaaggcgagcaccggcucccgcaagcuccugagcgaggagcccggggacgacugcaucucccggacccagcugcuccgcacggagaccgccgagauccacgacgacaacuacggcgggcccggcgacaagaucaccaucugcaacgggagcaccaucguggaccagcggcugggcuccgagcugggcugcuacacgaucaaccgcgucaagagcuucaagcucugcgagaacuccgccaccgggaagaccugcgagaucgacagcaccccggugaagugccgccagggcuucugccugaagaucacgcaggaggggcggggccacgugaagcugucccgcgggagcgaggucgugcuggacgccugcgacuccagcugcgaggucaugauccccaagggcaccggcgacauccucguggacugcuccgggggccagcagcacuuccugaaggacaaccugaucgaccucgggugcccccacaucccccugcugggcaagauggccaucuacaucugccggaugagcaaccacccgcgcaccaccauggcguuccucuucugguucuccuucggcuacgugaucaccugcaucuucugcaaggcccuguucuacagccugaucaucaucgggacgcucggcaagaagaucaagcaguaccgggagcugaagccccagaccugcaccaucugcgagaccgcccccgucaacgccaucgacgcggagaugcacgaccugaacugcuccuacaacaucugccccuacugcgccagccgccucacguccgacgggcuggcccggcacgugccgcagugccccaagcgcaaggagaagguggaggagaccgagcuguaccucaaccuggagcggauccccuggaucguccgcaagcugcuccaggugagcgagagcaccggcguggcccugaagcgguccagcuggcugaucguccuccuggugcugcucaccgugucccugagcccgguccaguccgcccccguggggcacggcaagacgaucgagaccuaccagacccgcgagggcuucaccagcaucugccuguucaugcucggguccauccuguuccuggugagcugccucgucaagggccugguggacuccgugagcgacuccuucuuccccgggcugagcgucugcaagacgugcaccaucggcuccaucaacggguucgagaucgagagccacaagugcuacugcucccucuucugcugccccuacugccggcacugcagcgcggaccgcgagauccaccagcugcaccuguccaucugcaagaagcggaagaccggcagcaacgugaugcucgccgugugcaagcgcaugugcuuccgggccaccaucgaggccucccgccgggcccugcugauccgcagcaucaucaacacgaccuucgucaucugcauccucacccugaccaucugcguggugagcacguccgcggucgagauggagaaccugccgagcggcaccugggagcgcgaggaggaccucaccaacuucugccaccaggagugccaggugaccgagacggagugccugugccccuacgaggcccuggugcuccggaagccccuguuccuggacuccaucgucaaggggaccaagaaccuccugaacagcaccucccuggagaccagccucuccaucgaggcccccuggggcgccaucaacgugcagagcacguucaagccgaccguguccaccgccaacaucgcgcugagcugguccagcgucgagcaccgcgggaacaagauccuggugaccggccgguccgagagcaucaugaagcucgaggagcgcacggggguguccugggaccugggcgucgaggacgccagcgaguccaagcugcucaccgugagcaucauggaccugucccagauguacagccccguguucgaguaccugagcggcgaccggcaggucgaggaguggcccaaggccaccugcaccggggacugccccgagcgcugcggcugcacguccagcaccugccuccacaaggaguggccgcacucccggaacuggcgcugcaaccccaccuggugcuggggggugggcaccgggugcaccugcugcggcguggacgucaaggaccuguucacggaccacauguucgugaaguggaagguggaguacaucaagaccgaggccaucgucugcguggagcugaccagccaggagcggcagugcucccucaucgaggcgggcacccgcuucaaccuggggcccgugacgaucacccugagcgagccccggaacauccagcagaagcucccgcccgagaucaucacccugcaccccaaggucgaggagggcuucuucgaccugaugcacgugcagaaggugcucuccgccagcaccgucugcaagcugcaguccugcacgcacgggauccccggcgaccugcagguguaccacaucggcaaccuccugaagggggaccgcaucaacggccaccugauccacaagaucgagccgcacuucaacaccagcuggauguccugggacgggugcgaccucgacuacuacugcaacaugggcgacuggcccagcugcaccuacaccggggugacgcagcacaaccacgccgccuucgucaaccugcugaacaucgagaccgacuacaccaagaccuuccacuuccacuccaagcgggugacggcccacggcgacaccccccagcucgaccugaaggcgcgccccaccuacggcgccggggagaucaccguccugguggagguggccgacauggagcuccacacgaagaaggucgagaucagcggccugaaguucgccucccuggccugcaccgggugcuacgcgugcagcuccggcaucagcugcaaggugcggauccacguggacgagccggacgagcucaccguccacgugaaguccagcgaccccgacguggucgccgccagcaccucccugauggcccgcaagcuggaguucgggacggacagcaccuucaaggccuucuccgcgaugcccaagaccagccucugcuucuacaucguggagcgggaguacugcaaguccugcagcgaggaggacacccagaagugcguggacacgaagcuggagcagccccaguccauccugaucgagcacaagggcaccaucaucggcaagcagaacgacaccugcaccgccaaggccagcugcuggcucgaguccgucaagagcuucuucuacgggcugaagaacaugcugggcuccguguucgggaacuucuucaucggcauccuccuguuccuggccccguucgugcugcucguccuguucuucauguucggguggaagauccuguucugcuucaagugcugccgccggacgcgcggccuccugaaguaccggcaccugaaggacgacgaggagaccggcuaccgccgcaucaucgagcggcucaacaacaagaaggggaagaaccgccugcuggacggcgagcggcucgcggaccgcaagaucgccgagcuguucagcaccaagacccacaucggguga

SEQ ID NO: 11952 - RNA, 5067 nt, Artificial Sequence
  derived and/or modified CDS sequence (opt1) from CCHFV(Mamon)__KX013478.1__GP
augcccaccaacaucaugcacacccugcucgugugcuucauccuguaccugcagcuccugggccucgggggcgcccacgggcagagcaacacgaccgagcacaacggcaccaacaccacgaccgccccguccaccagccagucccccaagccccuggucagcaccgcgcccccgcacgcccuggaguccagcacgaucaagcccaccacccccgccuccgagaccgaggggagcggcgagacgacgcccccgcccaacaucacccagggccccuccccgcccgagaccacccccgagcgccccgccaccaccgccaccagcacgcccuccaccgacaacaccaacagcaccacgcacgugaccgacaacaacccgaccuccaccaucagcacgucccccagcuccagccccuccacccccagcaccccgcaggggauccaccaccccgcgcggaaccugcucagcguguccagccccaagaccgccacgacccccaccccgaccucccccggcgagaucagcuccaagacgagcucccugcacagcgccaugucccgcaccagcacccuguacaccgccacccaggucuccacggagaacgcgaaccacagcgcgccccggcaguccgagagcuccgcccagcccaccaccaccagcccgaugacgucccccgcccagagcauccucgugauguccgccgcccccaccgccauccagaacauccacccgagccccaccaaccgcagcaagcggaaccuggagauggagaucauccugacccucucccaggggcugaagaaguacuacggcaagauccugaagcuccugcaccugacgcucgaggaggacaccgaggggcugcuggaguggugcaagcgcaaccucggcagcaacugcgacgacgacuucuuccagaagcggaucgaggaguucuucaugaccggcgagggguacuucaacgaggugcugcaguucaagacccuguccacgcucagccccaccgagcccucccacgcccgcccgcccaccgucgagcccuucaagagcuacuucgccaagggcuuccuguccaucgacagcggguacuucuccgccaagugcuacccccggagcuccaccagcggccugcagcucaucaacgugacgcagcacccggcgcgcaucgccgagacccccggccccaagaccaccucccugaagacgaucaacugcaucaaccugcgggccagcguguucaaggagcaccgcgagaucgagaucaacguccuccugccccagaucgccgugaaccuguccaacugccacguggucaucaacagccacgugugcgacuacucccucgacaccgacgggccggugcggcugccccacaucuaccacgagggcaccuucauccccgggaccuacaagaucgucaucgacaagaagaacaagcugaacgaccgcugcacgcucgugaccaacugcgugaucaagggccgggagguccgcaaggggcagagcgugcugcggcaguacaagaccgagaucaagaucggcaaggccagcaccggcucccgcaagcugcucagcgaggagcccggggacgacugcaucucccggacgcagcugcugcgcaccgagaccgcggagauccacgacgacaacuacggcgggccgggcgacaagaucaccaucugcaacgggagcacgaucguggaccagcggcucggcuccgagcugggcugcuacaccaucaaccgcgucaagagcuucaagcugugcgagaacuccgccaccgggaagaccugcgagaucgacagcacgcccgugaagugccgccagggcuucugccucaagaucacccaggaggggcggggccacgugaagcugucccgcgggagcgaggucguguccgacgccugcgacagcuccugcgaggucaugauccccaagggcaccggcgacauccugguggacugcagcgggggccagcagcacuuccugaaggacaaccucaucgaccuggggugcccccacaucccgcugcucggcaagauggccaucuacaucugccggauguccaaccacccccgcaccaccguggccuuccuguucugguucagcuucggcuacgucaucacgugcaucuucugcaaggcgcuguucuacucccucaucaucaucgggacccugggcaagaagaucaagcaguaccgggagcugaagccccagaccugcaccaucugcgagacggcccccgugaacgccaucgacgccgagaugcacgaccucaacugcagcuacaacaucugcccguacugcgcgucccgccugaccagcgacgggcuggcccggcacgugccccagugccccaagcgcaaggagaaggucgaggagaccgagcucuaccugaaccuggagcggaucccguggaucgugcgcaagcuccuccaggugagcgaguccaccggcgucgcccugaagcggagcuccuggcugaucgugcugcuggugcuccugacggucagccugucccccgugcagagcgcccccguggggcacggcaagaccaucgagaccuaccagacccgcgagggcuucacguccaucugccucuucaugcuggggagcauccuguuccucgucuccugccuggugaagggccugguggacagcgucuccgacagcuucuuccccgggcucuccgugugcaagaccugcagcaucggcuccaucaacggguucgagaucgagagccacaagugcuacugcucccuguucugcugcccguacugccggcacugcagcgccgaccgcgagauccaccagcugcaccucuccaucugcaagaagcggaagaccggcagcaacgugaugcuggcggucugcaagcgcaugugcuuccgggccaccaucgaggccagccgccgggcccugcucauccgcuccaucaucaacacgaccuucgugaucugcauccugacccugaccaucugcguggucagcacguccgccguggagauggagaaccuccccagcggcaccugggagcgcgaggaggaccugaccaacuucugccaccaggagugccaggugaccgagacggagugccugugccccuacgaggcgcucguccugcggaagccccuguuccucgacuccaucgugaaggggaugaagaaccugcugaacagcaccucccucgagaccagccuguccaucgaggccccguggggcgccaucaacgugcagagcaccuucaagcccacggucuccaccgccaacaucgcccugagcugguccagcguggagcaccgcgggaacaagauccucgugaccggccgguccgagagcaucaugaagcuggaggagcgcaccggggucuccugggaccugggcguggaggacgcgagcgaguccaagcuccugacggugagcaucauggaccugagccagauguacucccccgucuucgaguaccucagcggcgaccgccagguggaggaguggcccaaggcgaccugcaccggggacugcccggagcggugcggcugcaccuccagcacgugccugcacaaggaguggccccacucccggaacuggcgcugcaaccccaccuggugcuggggcguggggaccgggugcacgugcugcggcgucgacgugaaggaccuguucaccgaccacauguucgugaaguggaaggucgaguacaucaagaccgaggccaucgugugcguggagcucaccagccaggagcggcagugcucccugaucgaggccggcacccgcuucaaccuggggcccgucaccaucacgcucagcgagccgcggaacauccagcagaagcugccgcccgagaucaucacccugcaccccaagguggaggagggcuucuucgaccucaugcacgugcagaagguccuguccgccagcaccgugugcaagcugcaguccugcacccacgggauccccggcgaccuccagguguaccacaucggcaaccugcugaagggggaccgcgucaacggccaccucauccacaagaucgagccccacuucaacacgagcuggauguccugggacgggugcgaccuggacuacuacugcaacaugggcgacuggcccagcugcaccuacaccggggugacccagcacaaccacgccgccuucgucaaccugcucaacaucgagacggacuacaccaagaccuuccacuuccacuccaagcgggugaccgcccacggcgacacgccccagcuggaccugaaggcccgcccgaccuacggcgcgggggagaucaccgugcucgucgagguggccgacauggagcugcacaccaagaagguggagaucagcggccugaaguucgccucccucgccugcacggggugcuacgccugcagcuccggcaucagcugcaagguccggauccacguggacgagcccgacgagcugaccgugcacgucaagagcuccgaccccgacgugguggcggccagcaccucccugauggcccgcaagcucgaguucgggaccgacagcacguucaaggccuucuccgccaugcccaagaccagccugugcuucuacaucgucgagcgggaguacugcaaguccugcagcgaggaggacacccagaagugcguggacaccaagcuggagcagccgcaguccauccucaucgagcacaagggcacgaucaucggcaagcagaacgacacgugcaccgcgaagaccagcugcuggcuggaguccgucaagagcuucuucuacgggcugaagaacaugcucggcuccguguucgggaacuucuucaucggcauccugcuguuccucgcccccuucgugcugcuggugcuguucuucauguucggguggaagauccucuucugcuucaagugcugccgccggacccgcggccugcugaaguaccggcaccucaaggacgacgaggagaccggcuaccgccgcaucaucgagcggcugaacaacaagaaggggaagaaccgccugcucgacggcgagcggcuggccgaccgcaagaucgccgagcuguucagcaccaagacccacaucggguga

SEQ ID NO: 11953 - RNA, 5067 nt, Artificial Sequence
  derived and/or modified CDS sequence (opt1) from CCHFV(K340_6)__KX013475.1__GP
augcccaucaacaucaugcacacccugcucgugugcuucauccuguaccugcagcucagcggccucgggggcgcccacguccaguccaacgccaccgagcacaacgggacgaacaccaccaccgcgccgggcacgagccagucccccaagccgcccgccagcaccacccugccccacacccccgaguccagcacggugaagcccaccacccccaccuccgagacggaggggagcggcgagaccaccccgccgcccaacaccacgcagggccugccgcccaccgggaccacccccgagcgcuccgccacgaccgccaccagcaccuccagcacggacaacaugaacuccaccacccaggugaccgacagcacgcccaccuccaccgucagcaccucccccagcuccagcagcuccaugcccagcacgucccagggcauccaccaccccgugcggagccugcuguccgugagcucccccaagaccgucaccacccccacgccgaugagccccggggagaugucccccgagaccagcucccagcacagcgccaugucccgcgugcccacccucuacaccgcgacccaggugagcacggagaacaccgaccgguccaccccgcgccagagcgaguccagcguccagcccgccacccagucccccaucacgagccccgcccagaccauccugcugaugagcgccgcgccgaaggccauccaggacaugcaccccucccccaccaaccggagcaagcgcaaccucgagguggagaucauccugacccugucccagggccucaagaaguacuacgggaagauccugaagcugcuccaccugacgcuggaggaggacaccgagggccuccuggaguggugcaagcggaaccugggcagcaacugcgacgacgacuucuuccagaagcgcaucgaggaguucuucaucaccggggagggcuacuucaacgaggugcuccaguucaagacccuguccacgcugagcccgaccgagcccucccacguccggcuccccaccgccgagcccuucaagagcuacuucgccaagggguuccuguccaucgacagcggcuacuucuccgccaagugcuacccgcgcagcuccaccagcggccugcagcucaucaacgugacgcagcaccccgcgcggaucgccgagacccccgggcccaagaccaccucccugaagacgaucaacugcaucaaccugcgcgccagcguguucaaggagcaccgggaggucgagaucaacgugcuccugccgcagaucgccgugaaccuguccaacugccacgucgugaucaacagccacgugugcgacuacagccucgacaccgacggccccguccgccugccccggauccaccacgaggggaccuucauccccggcaccuacaagaucgugaucgaccgcaagaacaagcugaacgaccggugcucccucgugacgaacugcgucaucaaggggcgcgaggugcggaagggccagagcguccugcgccaguacaagaccgagaucaagaucggcaaggccuccaccgggagccggaagcugcucuccgaggagccgggcgacgacugcaucagccgcacccagcugcugaagacggagaccgcggagauccacgacgacaacuacgggggccccggggacaagaucaccaucugcaacggcuccaccaucguggaccagcgccucggcagcgagcuggggugcuacacgaucaaccgggugaaguccuucaagcugugcgagaacagcaccaccggcaagaccugcgagaucgacuccacgcccgucaagugccgccagggguucugccucaagaucacccaggagggccgggggcacgugaagcugagccgcggcuccgaggugguccuggacgccugcgacagcuccugcgagaucaugauccccaagggcaccggggacauccugguggacugcagcggcgggcagcagcacuuccucaaggacaaccugaucgaccugggcugcccgcacaucccgccccucggcaagauggccaucuacaucugccggauguccaaccacccccgcaccaccauggccuuccuguucugguucagcuucggguacgugaucacgugcaucuucugcaaggcccuguucuacucccucaucaucaucggcacccuggggaagaagaucaagcaguaccgggagcugaagccccagaccugcaccaucugcgagacggcgcccgucaacgccaucgacgccgagaugcacgaccucaacugcagcuacaacaucugccccuacugcgccagccgccugaccuccgacggccuggcccggcacgugacccagugccccaagcgcaaggagaagguggaggagaccgagcucuaccugaaccuggagcggaucccguggaucguccgcaagcuccuccaggugagcgaguccacggggguggcgcugaagcggagcuccuggcugaucguccugcuggugcuccugaccgugagccugucccccguccagagcgcccccgugggccacggcaagaccaucgagaccuaccagacgcgcgagggguucaccuccaucugccucuucaugcugggcagcauccuguucaucguguccugccucgucaaggggcugguggacagcguguccgacagcuucuucccgggccuguccgucugcaagaccugcagcaucggguccaucaacggcuucgagaucgagagccacaagugcuacugcucccucuucugcugccccuacugccggcacugcagcgccgaccgcgagauccaccagcugcaccugagcaucugcaagaagcggaagaccggcuccaacgugaugcucgccgugugcaagcgcaugugcuucaaggcgacgaucgaggccagccggcgcgcccugcugauccgcuccaucaucaacaccaccuucgucaugugcauccucacccuggccaucugcguggugagcacguccgccgucgagauggaggaccugcccgcggggaccugggagcgggaggaggaccucaccaacuucugccaccaggagugccaggugaccgagacggagugccugugccccuacgaggcccuggugcuccgcaagccgcugagccuggacuccaucgucaagggcaugaagaaccuccugaacagcaccucccuggagaccagccucuccaucgaggcccccuggggcgccaucaacgugcagagcaccuucaagcccacgguguccaccgccaacaucgcgcugagcugguccagcgucgagcaccgggggaacaagauccuggugaccgggcgcuccgagagcaucaugaagcucgaggagcggaccggcguguccugggaccugggcgucgaggacgccagcgagagcaagcugcucacgguguccaucauggaccugagccagauguacucccccguguucgaguaccugagcggggaccgccaggucgaggaguggccgaaggcgaccugcaccggcgacugccccgagcggugcgggugcaccuccagcacgugccuccacaaggaguggccccacucccgcaacuggcggugcaaccccaccuggugcuggggcguggggaccggcugcacgugcugcggcguggacgucaaggaccuguucaccgaccacauguucaucaaguggaagguggaguacaucaagaccgaggccaucgugugcgucgagcugaccagccaggagcgccagugcucccucaucgaggccgggacccgguucaaccugggcccggugaccaucacgcugagcgagccccgcaacauccagcagaagcucccgcccgagaucaucacccugcaccccaagaucgaggagggguucuucgaccugaugcacgugcagaagguccucuccgccagcaccgugugcaagcugcaguccugcacccacggcauccccggcgaccugcagaucuaccacaucgggaaccuccugaagggcgaccgggucaacgggcaccugauccacaagaucgagccccacuucaacacgagcuggauguccugggacggcugcgaccucgacuacuacugcaacaugggggacuggcccagcugcaccuacaccggcgugacccagcacaaccacgccgccuucgugaaccugcugaacaucgagacggacuacaccaagaccuuccacuuccacuccaagcgcgucaccgcccacggcgacacgccgcagcucgaccugaaggcgcggcccaccuacggggccggcgagaucaccgugcugguggaggucaccgacauggagcuccacacgaagaagguggagaucagcgggcugaaguucgccucccugaccugcaccggcugcuacgccugcagcagcgggaucuccugcaaggugcgcauccacgucgacgagcccgacgagcucaccgugcacgucaagagcuccgaccccgacgugguggccgcgagcacgucccugauggcccggaagcuggaguucggcaccgacagcaccuucaaggccuucuccgccaugccgaagaccagccucugcuucuacaucguggagcgcgaguacugcaaguccugcagcgaggacgacacgaagaagugcgucgacaccaagcuggagcagccccaguccauccugaucgagcacaagggcaccaucaucgggaagcagaacgacacgugcaccgccaaggcgagcugcuggcucgaguccgucaagagcuucuucuacggccugaagaacaugcugggguccguguucggcagcuucuucguggggauccuccuguuccuggcccccuucgugcuccuggugcuguucuucauguucggcuggaagauccuguucugcuucaagugcugccggcgcacccggggccucuucaaguaccgccacuucaaggacgacgaggagaccggguaccgccggaucaucgagcgccugaacuccaagaagggcaagaaccggcugcucgacggggagcgccuggccgaccggaagaucgccgagcuguucagcaccaagacgcacaucggcuga

SEQ ID NO: 11954 - RNA, 5067 nt, Artificial Sequence
  derived and/or modified CDS sequence (opt1) from CCHFV(K323_27)__KX013472.1__GP
augcccaucaacaucaugcacacccugcucgugugcuucauccuguaccugcagcucagcggccucgggggcgcccacgggcaguccaacgccaccgagcacaacggcacgaacaccaccaccgucccggggacgagccagucccccaagccgcccgcgagcaccacccugccccacacccccgaguccagcacggugaagcucaccacccccaccuccgagacggagggcagcggcgagaccacgcccccgcccaacaccacccaggggcugccccugcccggcaccaccccggagcgcuccgccaccacggccaccagcaccuccagcaccgacaacaugaacuccacgacccaggugaccgacaacacccccacgagcaccgucuccaucagccccuccagcucccccagcaugccgagcaccucccaggggauccaccaccccgugcggagccuccuguccgugagcucccccaagaccgucacgacccccaccccgaugagccccggcgagaugucccccgagaccagcucccagcacagcgccaugucccgcauccccacgcuguacaccgccacccaggugagcaccgagaacaccgaccgguccacgccgcgccagagcgaguccagcgugcagcccgcgacccagucccccaucaccagccccgcccagaccauccuccugauguccgccgccccgaaggcgauccaggacaugcaccccagccccacgaaccggagcaagcgcaaccuggaggucgagaucauccucacccugucccaggggcugaagaaguacuacggcaagauccucaagcugcugcaccucacccuggaggaggacaccgagggccugcucgaguggugcaagcggaaccuggggagcaacugcgacgacgacuucuuccagaagcgcaucgaggaguucuucaucacgggcgagggguacuucaacgaggugcugcaguucaagacccucuccacccugagcccgaccgaguccagccacgugcggcugcccacggccgagcccuucaaguccuacuucgccaagggcuuccucagcaucgacuccggcuacuucagcgccaagugcuacccccgcuccagcaccuccgggcugcagcugaucaacgucacccagcacccggcccggaucgcggagacccccggccccaagacgaccagccucaagaccaucaacugcaucaaccugcgcgccuccguguucaaggagcaccgggagguggagaucaacguccugcucccccagaucgccgugaaccugagcaacugccacguggucaucuccagccacgugugcgacuacagccuggacaccgacgggccggugcgccucccccggauccaccacgagggcacguucauccccgggaccuacaagaucgucaucgaccgcaaggacaagcugaacgaccggugcucccuggugaccaacugcgugaucaagggccgcgagguccggaagggccagagcgugcuccgccaguacaagaccgagaucaagaucgggaaggccuccacgggcagccggaagcugcuguccgaggagcccggggacgacugcaucagccgcacccagcuccugaagaccgagaccgccgagauccacgacgacaacuacggcgggccgggcgacaagaucacgaucugcaacggcuccaccaucgucgaccagcgccuggggagcgagcucggcugcuacaccaucaaccgggugaaguccuucaagcugugcgagaacagcgcgaccgggaagacgugcgagaucgacuccacccccgugaagugccgccagggcuucugccugaagaucacccaggaggggcggggccacgucaagcugagccgcggcuccgagguggugcucgacgccugcgacagcuccugcgagaucaugauccccaaggggaccggcgacauccuggucgacugcagcgggggccagcagcacuuccugaaggacaaccucaucgaccugggcugcccccacaucccgcugcucgggaagauggccaucuacaucugccggauguccaaccacccccgcacgaccauggccuuccuguucugguucagcuucggcuacgugaucacgugcaucuucugcaaggcccuguucuaccuccugaucaucaucgggacccugggcaagaagaucaagcaguaccgggagcucaagccccagaccugcaccaucugcgagaccgcgcccgugaacgccaucgacgccgagaugcacgaccugaacugcuccuacaacaucugcccguacugcgccagccgccugaccagcgacgggcucgcccggcacgucacccagugccccaagcgcaaggagaagguggaggagacggagcuguaccugaaccucgagcggauccccuggaucgugcgcaagcugcugcaggucuccgagagcaccggcguggcgcucaagcgguccagcuggcugaccgugcugcucguccugcugaccgugucccucagccccgugcaguccgccccggucggccacgggaacacgaucgagaccuaccagacccgcgagggcuucaccagcaucugccuguucaugcugggguccauccucuucaucgugagcugccuggugaagggccuggucgacuccgugagcgacuccuucuuccccgggcucagcgugugcaagacgugcuccaucggcagcaucaacggcuucgagaucgagucccacaagugcuacugcagccuguucugcugcccccacugccggcaccgcuccgccgaccgggagauccaccagcugcaccucagcaucugcaagaagcgcaagaccgggagcaacgucaugcuggccgugugcaagcggaugugcccgaaggcgaccaucgaggccucccgccgcgcccugcccauccggagcaucaucaacaccacgcucgugaugugcauccugacccuggccaucugcgucguguccaccagcgccguggagauggaggaccuccccgcgggcaccugggagcgcgaggaggaccugacgaacuucugccaccaggagugccaggucaccgagaccgagugccugugccccuacgaggcccucgugcugcggaagccgcuguuccucgacuccaucgccaaggggaugaagaaccugcugaacagcaccucccucgagacgagccuguccaucgaggcccccuggggcgccaucaacgugcagagcaccuucaagcccaccgucuccaccgcgaacaucgcccugagcugguccagcguggagcaccgcgggaacaagauccucgugacgggccgguccgagagcaucaugaagcuggaggagcgcaccggcgucuccugggaccuggggguggaggacgccagcgaguccaagcuccugaccgugagcaucauggaccugagccagauguacucccccgucuucgaguaccucagcggcgaccgccagguggaggaguggccgaaggcgaccugcacgggggacugccccgagcggugcggcugcaccuccagcacgugccugcacaaggaguggccccacucccggaacuggcgcugcaaccccaccuggugcuggggcguggggaccggcugcacgugcugcggggucgacgugaaggaccuguucaccgaccacauguucaucaaguggaagguggaguacaucaagaccgaggccaucgucugcguggagcucaccggccaggagcggcagugcagccugaucgaggccgggacccgcuucaaccugggcccggugaccaucacccucuccgagccccggaacauccagcagaagcugccgcccgagaucaucacccugcaccccaagaucgaggagggcuucuucgaccucaugcacguccagaaggugcugagcgccuccacggugugcaagcugcagagcugcacccacgggauccccggcgaccuccagaucuaccacaucgggaaccugcugaagggcgaccgcgucaacgggcaccucauccacaagaucgagccccacuucaacaccuccuggaugagcugggacggcugcgaccuggacuacuacugcaacaugggcgacuggcccuccugcaccuacacgggggugacccagcacaaccacgccgccuucgucaaccugcucaacaucgagaccgacuacaccaagacguuccacuuccacagcaagcgggugaccgcgcacggcgacaccccgcagcuggaccugaaggcccgccccaccuacggggccggcgagaucacggugcucgucgagguggccgacauggagcugcacaccaagaagguggagaucuccgggcugaaguucgccagccugaccugcaccggcugcuacgcgugcuccagcggcaucuccugcaagguccggauccacguggacgagcccgacgagcugacggugcacgucaagagcagcgaccccgacgugguggccgccuccaccagccugauggcccgcaagcucgaguucgggaccgacuccaccuucaaggccuucagcgcgaugccgaagacgucccugugcuucuacaucgucgagcgggaguacugcaagagcugcuccgaggacgacaccaagaagugcguggacaccaagcuggagcagccccagagcauccucaucgagcacaagggcaccaucaucgggaagcagaacgacacgugcaccgccaaggccuccugcuggcuggagagcgugaaguccuucuucuacggccugaagaacaugcucgggagcgucuucggcuccuucuucgugggcauccugcuguuccuggcccccuucgugcuccugguccuguucuucauguucggguggaagauccucuucugcuucaagugcugccgccggacccgcggccuguucaaguaccgccaccugaacgacgacgaggagaccggguaccggcgcaucaucgagcggcucaacagcaagaagggcaagaaccgccugcuggacggcgagcggcucgccgaccgcaagaucgcggagcuguucuccacgaagacccacaucggguga

SEQ ID NO: 11955 - RNA, 5067 nt, Artificial Sequence
  derived and/or modified CDS sequence (opt1) from CCHFV(K315_14)__KX013469.1__GP
augcccuucaacaucaugcacacccugcucgugugcuucauccuguaccugcagcucagcggccuggggggcgcccacgggcaguccaacgagaccgagcacaacggcacgaacaccaccaccgucccggggacgagccagucccccaagccccccgccagcaccacccugcagcacaccccggaguccagcacggugaagcucaccacccccaccuccgagacggagggcagcggcgagaccaccccccccccgaacaccacgcaggggcugcccccccccggcaccaccccggagcgcuccgcgaccacggccaccagcaccuccagcaccgacaacaugaacuccacgacccaggugaccgacaacacccccacgagcaccgucuccaucagccccuccagcucccccagcaugccgagcaccucccaggggauccacuaccccauccggagccugcucuccgugagcucccccaagaccgugacgacccccaccccgaucagccccggcgagaugucccccgagaccagcucccagcacagcgccaugucccgcauccccacgcuguacaccgccacccaggucagcaccgagaacaccaaccgguccacgccgcgccagagcgaguccagcgugcagcccgccacccagucccccaucaccagccccgcgcagaccauccugcucauguccgccgccccgaaggccauccaggacaugcaccccagccccacgaaccggagcaagcgcaaccuggagguggagaucauccugacccucucccaggggcugaagaaguacuacggcaagauccugaagcuccugcaccugacccucgaggaggacaccgagggccugcuggaguggugcaagcggaaccucgggagcaacugcgacgacgacuucuuccagaagcgcaucgaggaguucuucaucacgggcgagggguacuucaacgagguccugcaguucaagacccuguccacccucagcccgaccgagcccucccacgugcggcugcccacggcggagcccuucaagagcuacuucgccaagggcuuccuguccaucgacagcggcuacuucuccgccaagugcuacccgcgcagcuccaccagcgggcuccagcugaucaacgugacccagcaccccgcccggaucgccgagacccccggccccaagacgaccucccugaagaccaucaacugcaucaaccuccgcgcgagcgucuucaaggagcaccgggagguggagaucaacgugcugcugccgcagaucgccgucaaccucuccaacugccacguggugaucaacagccacgucugcgacuacucccuggacaccgacgggcccgugcgccugccccggauccaccacgagggcacguucauccccgggaccuacaagaucgugaucgacaagaagaacaagcucaacgaccgcugcagccuggucaccaacugcgugaucaagggccgggaggugcgcaagggccagagcguccugcggcaguacaagaccgagauccgcaucgggaaggccuccacgggcagccggaagcuccuguccgaggagccgggggacgacugcaucagccgcacccagcugcucaagaccgagaccgccgagauccacgacgacaacuacggcgggcccggcgacaagaucacgaucugcaacggcuccaccguggucgaccagcgccuggggagcgagcugggcugcuacaccaucaaccgggugaaguccuucaagcucugcaagaacagcgccaccgggaagacgugcgagaucgacuccacccccgugaagugccgccagggcuucugccugaagaucacccaggaggggcggggccacgucaagcugagccgcggcuccgagguggugcuggacgucugcgacagcuccugcgagaucaugauccccaaggggaccggcgacauccucguggacugcagcgggggccagcagcacuuccugaaggacaaccugaucgaccucggcugcccgcacaucccccugcuggggaagauggcgaucuacaucugccggauguccaaccacccccgcacgaccauggccuuccucuucugguucagcuucggcuacgugaucaccugcaucuucugcaaggcccuguucuacucccugaucaucaucgggacccucggcaagaagaucaagcaguaccgggagcugaagccccagaccugcacgaucugcgagaccgccccggucaacgccaucgacgcggagaugcacgaccugaacugcagcuacaacaucugccccuacugcgccucccgccucaccagcgaggggcuggcccggcacgugacccagugccccaagcgcaaggagaagguggaggagacggagcuguaccucaaccuggagcggauccccuggaucguccgcaagcugcuccaggugagcgaguccaccggcguggcccugaagcggagcuccuggcugaucguccuccuggugcugcucaccgugagccuguccccgguccagagcgcccccgugggccacgggaagaccaucgagacguaccagacccgcgagggcuucaccuccaucugccuguucaugcucgggagcauccuguucaucguguccugccuggucaagggccucguguacagcguguccgacagcuucuuccccgggcuguccgucugcaagaccugcagcaucggcuccaucaacggcuucgagaucgagagccacaagugcuacugcucccuguucugcugcccguacugccggcacugcagcgcggaccgcgagauccaccagcuccaccuguccaucugcaagaagcggaagacggggagcaacgugaugcuggccgugugcaagcgcaugugcuucaaggccaccaucgaggccagccggcgcgcgcuccugauccgcuccaucaucaacaccaccuucgucaucugcauccugacgcucgccaucugcguggugagcaccuccgccgucgagauggaggaccugcccgccggcaccugggagcgggaggaggaccugaccaacuucugccaccaggagugccaggugacggagaccgagugccucugccccuacgaggcccuggugcugcgcaagccccucuuccuggacagcaucgucaaggggaugaagaagcugcucaacuccaccagccuggagaccucccugagcaucgaggcgccguggggcgccaucaacgugcaguccacguucaagcccaccgugagcaccgccaacaucgcccucuccuggagcuccgucgagcaccgggggaacaagauccuggugaccggccgcagcgaguccaucaugaagcuggaggagcggacgggcgugagcugggaccucggggucgaggacgccuccgagagcaagcugcugaccguguccaucauggaccucagccagauguacagccccguguucgaguaccuguccggcgaccgccaggucgaggaguggcccaaggcgaccugcaccggggacugcccggagcggugcggcugcacgagcuccaccugccugcacaaggaguggccccacagccgcaacuggcggugcaaccccaccuggugcuggggggugggcaccggcugcacgugcugcgggguggacgucaaggaccucuucaccgaccacauguucaucaaguggaagguggaguacaucaagaccgaggccaucgugugcgucgagcugaccucccaggagcgccagugcagccugaucgaggccggcacccgguucaaccucgggcccgugacgaucacccuguccgagccgcgcaacauccagcagaagcugccccccgagaucaucacccuccaccccaagaucgaggagggcuucuucgaccugaugcacgugcagaagguccugagcgccuccaccgugugcaagcuccagagcugcacgcacggcaucccgggggaccugcagaucuaccacaucggcaaccugcucaagggggaccgggucaacggccaccugauccacaagaucgagccccacuucaacaccuccuggaugagcugggacgggugcgaccuggacuacuacugcaacaugggcgacuggcccuccugcaccuacaccggcgugacgcagcacaaccacgccgcguucgugaaccuccugaacaucgagaccgacuacaccaagaccuuccacuuccacagcaagcgcgucacggcccacggggacaccccccagcuggaccucaaggcccggccgaccuacggcgccggggagaucaccgugcugguggaggucgcggacauggagcugcacacgaagaagguggagaucuccggccucaaguucgccagccugaccugcaccgggugcuacgccugcuccagcggcaucuccugcaaggugcgcauccacgucgacgagcccgacgagcugaccgugcacgugaagagcagcgaccccgacgucguggccgccuccacgagccucauggcgcggaagcuggaguucggcaccgacuccaccuucaaggccuucagcgccaugcccaagaccucccugugcuucuacaucguggagcgcgaguacugcaagagcugcuccgaggacgacacgaagaagugcgucgacaccaagcucgagcagccgcagagcauccugaucgagcacaaggggaccaucaucggcaagcagaacgacaccugcacggccaaggccuccugcuggcuggagagcgugaaguccuucuucuacgggcucaagaacaugcugggcagcguguucggguccuucuucgucggcauccugcucuuccuggcgcccuucgugcugcuggugcucuucuucauguucggcuggaagauccuguucugcuucaagugcugccggcgcacccgggggcuguucaaguaccgccaccucaaggacgacgaggagaccggcuaccgccggaucaucgagcgccugaacagcaagaaggggaagaaccggcugcucgacggcgagcgccuggccgaccggaagaucgccgagcuguucuccaccaagacgcacaucggcuga

SEQ ID NO: 11956 - RNA, 5067 nt, Artificial Sequence
  derived and/or modified CDS sequence (opt1) from CCHFV(K229_243)__KX013466.1__GP
augcccaccaacaucaugcacacccugcucgugugcuucauccuguaccugcagcuccugggccucggcggggcccaggggcagagcaacgccaccgagcacaacgagaccaacaccaccaccgcccccuccaccagccagucccccaagccgcccgugagcaccaccccgccccacgcccucgaguccagcacgaucaagcccaccacccccgcccgcgagaccgagggguccggggagaccacgccgccgcccaacaccacccagggccccagcccgcccgaggccacccccgagcggcccgccaccaccgcgaccuccacgcccagcaccgacaacaccaacuccaccacgcacgugaccgacaacaaccccaccagcaccaucuccacgagccccuccagcucccccagcacccccuucacgccccagggcauccaccaccccgcccgcaaccugcuguccgugagcagccccaagaccgccacgaccccgacccccaccagcccccgcgagcucagcuccgagacgagcucccugcacagcgccaucucccgcaccagcacccuguacaccgcgacccagguguccacggagaacgccaaccacagcgcgccccggcaguccgagagcuccgcccagccgaccaccaccagccccaugacgucccccgcccagagcauccucgugauguccgcggccccgaccgccauccagaacauccaccccagccccaccaaccgcuccaagcggaaccuggagauggagaucauccugacccucagccaggggcugaagaaguacuacggcaagauccugaagcuccugcaccugacgcucgaggaggacaccgaggggcugcuggaguggugcaagcgcaaccucggcagcaacugcgacgacgacuucuuccagaagcggaucgaggaguucuucaugaccggggagggcuacuucaacgaggugcugcaguucaagacccuguccacgcucagccccaccgagccgucccacgcccggccgcccgccgucgagcccuucaagagcuacuucgcgaagggcuuccuguccaucgacagcggguacuucuccgccaagugcuacccgcggagcuccaccagcggccugcagcucaucaacgugacccagcaccccgcccgcaucgccgagacgcccgggcccaagaccaccucccugaagaccaucaacugcaucaaccugcgggccagcguguucaaggagcaccgcgagaucgagaucaacguccuccugccgcagaucgcggugaaccuguccaacugccacguggucaucaacagccacgugugcgacuacucccucgacacggacggccccgugcggcugccccacaucuaccacgagggcaccuucauccccgggaccuacaagaucgucaucgacaagaagaacaagcugaacgaccgcugcacccucgugacgaacugcgugaucaagggccgggagguccgcaaggggcagagcgugcugcggcaguacaagaccgagaucaagaucggcaaggccuccaccgggagccgcaagcugcucagcgaggagccgggcgacgacugcaucucccggacccagcugcugcgcacggagaccgccgagauccacgacgacaacuacggcgggcccggcgacaagaucaccaucugcaacgggagcaccaucguggaccagcgccucggcuccgagcuggggugcuacacgaucaaccgggucaagagcuucaagcugugcgagaacuccgccaccggcaagaccugcgagaucgacagcacccccgugaagugccgccagggcuucugccucaagaucacgcaggaggggcggggccacgugaagcugucccgcgggagcgaggucgugcuggacgccugcgacuccagcugcgaggucaugauccccaagggcaccggggacauccugguggacugcuccggcggccagcagcacuuccucaaggacaaccugaucgaccuggggugcccgcacaucccccuccugggcaagauggcgaucuacaucugccggaugagcaaccacccccgcaccaccauggccuuccuguucugguucuccuucggguacgugaucacgugcaucuucugcaaggcccucuucuacagccugaucaucaucggcacgcugggcaagaagaucaagcaguaccgggagcucaagccccagaccugcaccaucugcgagaccgccccggucaacgcgaucgacgccgagaugcacgaccugaacugcuccuacaacaucugccccuacugcgccagccgccugacguccgacgggcucgcccggcacgugccccagugcccgaagcgcaaggagaagguggaggagaccgagcuguaccugaaccucgagcggauccccuggaucguccgcaagcugcuccaggugagcgaguccaccggcguggcccucaagcggagcagcuggcugaucguccugcucgugcugcugaccgugucccucagccccguccaguccgcgcccguggggcacggcaagacgaucgagaccuaccagacccgcgagggguucaccagcaucugccuguucaugcugggcuccauccucuuccuggugagcugccuggucaagggccucguggacuccgugagcgacuccuucuucccggggcugagcgucugcaagacgugcuccaucggcagcaucaacggguucgagaucgagucccacaagugcuacugcagccuguucugcugccccuacugccggcacugcuccgccgaccgcgagauccaccagcuccaccugagcaucugcaagaagcggaagaccggcuccaacgugaugcuggccgugugcaagcgcaugugcuuccgggccaccaucgaggccagccgccgcgcgcuccugauccgguccaucaucaacaccacguucgucaucugcauccugacccucaccaucugcguggugagcaccagcgccgucgagauggagaaccugcccgccgggacgugggagcgcgaggaggaccugaccaacuucugccaccaggagugccaggugaccgagaccgagugccucugccccuacgaggcccuggugcugcggaagccccuguuccuggacuccaucgucaagggcaugaagaaccugcucaacagcacgucccuggagaccagccuguccaucgaggcccccuggggcgcgaucaacgugcagagcaccuucaagcccaccguguccacggccaacaucgcccucagcugguccagcgucgagcaccgcgggaacaagauccuggugaccggccgguccgagagcaucaugaagcuggaggagcgcaccgggguguccugggaccucggcgucgaggacgccagcgaguccaagcugcugaccgugagcaucauggaccucucccagauguacagccccguguucgaguaccuguccggggaccggcaggucgaggaguggccgaaggcgacgugcaccggcgacugccccgagcgcugcggcugcaccagcuccacgugccugcacaaggaguggccccacucccggaacuggcgcugcaaccccaccuggugcuggggcgugggcaccgggugcacgugcugcggcguggacgucaaggaccucuucaccgaccacauguucgugaaguggaagguggaguacaucaagaccgaggccaucgucugcguggagcugacgagccaggagcggcagugcucccugaucgaggccgggacccgcuucaaccucggcccggugaccaucacccugagcgagccccggaacauccagcagaagcugccgcccgagaucaucacgcuccacccgaaggucgaggagggcuucuucgaccugaugcacgugcagaaggugcuguccgccagcaccgucugcaagcuccaguccugcacccacgggauccccggcgaccuccagguguaccacaucgggaaccugcucaagggcgaccgcgugaacggccaccugauccacaagaucgagccccacuucaacaccagcuggauguccugggacgggugcgaccuggacuacuacugcaacaugggcgacuggcccagcugcacguacaccggggucacccagcacaaccacgccgcguucgugaaccuccugaacaucgagaccgacuacacgaagaccuuccacuuccacuccaagcgggucaccgcccacggcgacaccccgcagcuggaccucaaggcccgccccacguacggggccggcgagaucaccgugcugguggaggucgccgacauggagcugcacaccaagaagguggagaucagcggccucaaguucgcgucccuggccugcaccgggugcuacgccugcagcuccggcaucagcugcaaggugcggauccacgucgacgagcccgacgagcugacggugcacgugaaguccagcgaccccgacgucguggccgccuccaccagccucauggcgcgcaagcuggaguucgggaccgacagcaccuucaaggccuucuccgccaugccgaagacgagccugugcuucuacaucguggagaaggaguacugcaaguccugcagcgaggaggacacccagaagugcgucgacaccaagcucgagcagccccaguccauccugaucgagcacaagggcaccaucaucgggaagcagaacgacacgugcaccgccaaggcgagcugcuggcuggaguccgucaagagcuucuucuacggccucaagaacaugcugggcuccguguucgggaacuucuucaucggcauccuccuguuccugacccccuucguccugcugguccuguucuucauguucggguggaagauccuguucugcuucaagugcugccggcgcacccggggccugcucaaguaccgccaccugaaggacgacgaggagacgggguaccgccggaucaucgagcgccugaacaacaagaagggcaagaaccggcuccuggacggcgagcgccuggccgaccggaagaucgccgagcuguucagcaccaagacccacaucggguga

SEQ ID NO: 11957 - RNA, 5067 nt, Artificial Sequence
  derived and/or modified CDS sequence (opt1) from CCHFV(K229_194)__KX013463.1__GP
augcccaucaacaucaugcacacccugcucgugugcuucauccuguaccugcagcucagcggccucgggggcgcccacgggcaguccaacgccaccgagcacaacggcacgaacaccaccaccgucccggggacgagccagucccccaagccgcccgcgagcaccacccugccccacacccccgaguccagcacggugaagcugaccacccccaccuccgagacggagggcagcggcgagaccacgcccccgcccaacaccacccaggggcugcccccgcccggcaccacccccgagcgccccgccaccacggccaccuccaccagcuccaccgacaacaugaacagcacgacccaggugaccgacaacacccccaucuccacggucagcaucuccccgagcuccagccccuccaugcccagcaccagccaggggauccacuaccccgugcggucccugcucagcguguccagcccgaagaccgucaccacgcccacccccaugucccccggcgagaugagcccggagaccuccagccagcacuccgccaugagccgcauccccacccuguacacggccacccagguguccaccgagaacaccaaccggagcacgccccgccaguccgagagcuccgcgcagcccgccacccagagcccgaccaccucccccacccagacgauccugcucaugagcgccgcccccaaggcgauccaggacaugcacccgucccccaccaaccggagcaagcgcaaccuggagguggagaucauccugacccucagccaggggcugaagaaguacuacggcaagauccugaagcuccugcaccugacccucgaggaggacacggagggccugcuggaguggugcaagcggaaccucggguccaacugcgacgacgacuucuuccagaagcgcaucgaggaguucuucaucaccggcgagggguacuucaacgagguccugcaguucaagacccugaacacccucagccccacggagcccucccacgugcggcugccgaccgccgagcccuucaagagcuacuucgccaagggcuuccuguccguggacagcggcuacuucuccgccaagugcuacccccgcagcuccaccagcgggcuccagcugaucaacgucacccagcaccccgcccggaucgcggagacgccgggccccaagaccaccucccugaagaccaucaacugcaucaaccuccgcgccagcguguucaaggagcaccgggagguggagaucaacguccugcugccccagaucgccgugaaccucuccaacugccacguggucaucaacagccacgugugcgacuacucccuggacacggacgggcccgugcgccugccgcggauccaccacgagggcaccuucauccccgggaccuacaagaucgucaucgacaagaagaacaagcucaacgaccgcugcagccuggugaccaacugcgugaucaagggccgggagguccgcaagggccaguccgugcugcggcaguacaagacggagaucaagaucgggaaggccagcaccggcagccgcaagcuccuguccgaggagcccggggacgacugcaucagccggacccagcugcucaagaccgagacggccgagauccacgacgacaacuacggcgggcccggcgacaagaucaccaucugcaacggcuccaccaucgucgaccagcgccucgggagcgagcugggcugcuacaccaucaaccgcgugaaguccuucaagcucugcgagaacagcgcgacggggaagaccugcgagaucgacuccaccccggugaagugccggcagggcuucugccugaagaucacccaggaggggcgcggccacgucaagcugagccggggcuccgagguggugcuggacgccugcgacagcuccugcgagaucaugauccccaaggggacgggcgacauccucgucgacugcagcgggggccagcagcacuuccugaagggcaaccugaucgaccucgggugcccccacaucccccugcugggcaagauggccaucuacaucugccgcauguccaaccacccgcggaccaccauggccuuccucuucugguucagcuucggguacgugaucacgugcaucuucugcaaggcccuguucuacucccugaucaucaucggcacccucgggaagaagaucaagcaguaccgcgagcugaagccccagaccugcaccaucugcgagaccgcgcccgugaacgccaucgacgccgagaugcacgaccugaacugcagcuacaacaucugccccuacugcgccucccggcucaccagcgacggccuggcccgccacgucacgcagugcccgaagcggaaggagaagguggaggagaccgagcuguaccucaaccuggagcgcauccccuggaucgugcggaagcugcuccaggucuccgagagcaccggcguggcgcugaagcgcagcuccuggcugaucgugcuccugguccugcucaccgugagccugucccccgugcagagcgccccggucgggcacggcaagacgaucgagaccuaccagacccgggagggguucaccaacaucugccuguucaugcucggcuccauccuguucaucgugagcugccuggugaaggggcucgucgacuccgugagcgacuccuucuuccccggccugagcgugugcaagacgugcuccaucggcagcaucaacggguucgagaucgagucccacaagugcuacugcagccuguucugcugccccuacugccgccacugcuccgccgaccgggagauccaccagcuccaccugggcaucugcaagaagcgcaagaccgggagcaacgucaugcuggccgugugcaagcggaugugcuucaaggcgaccaucgaggccucccgccgggcccuccugauccgcagcaucaucaacaccacguucgugaucugcauccugacccucgccaucugcgucguguccaccagcgccguggagauggagaaccugcccgcgggcaccugggagcgcgaggaggaccugacgagcuucugccaccaggagugccaggucaccgagaccgagugccucugcccguacgaggcccuggugcugcggaagccccucuuccuggacuccaucgugaaggggaagaagaaccugcucaacagcaccucccuggagacgagccuguccaucgaggcccccuggggcgccaucaacguccagagcaccuucaagcccaccguguccaccgccaacaucgcgcucagcugguccagcguggagcaccgcggcaacaagauccuggucacggggcgguccgagagcaucaugaagcuggaggagcgcaccggcguguccugggaccucgggguggaggacgccagcgaguccaagcugcugaccgucagcaucauggaccucucccagauguacagcccgguguucgaguaccuguccggcgaccgccagguggaggaguggcccaaggcgaccugcacgggggacugccccgagcggugcggcugcaccagcuccacgugccugcacaaggaguggccccacagccggaacuggcgcugcaacccgaccuggugcuggggcgucgggaccggcugcacgugcugcgggguggacgugaaggaccucuucaccgaccacauguucaucaaguggaaggucgaguacaucaagaccgaggccaucgugugcguggagcugaccagccaggagcggcagugcucccugaucgaggccggcacccgcuucaaccucggccccgucaccaucacccugagcgagccccggaacauccagcagaagcugcccccggagaucaucacccuccaccccaagaucgaggagggguucuucgaccugaugcacgugcagaaggugcuguccgccagcacggucugcaagcuccaguccugcacccacggcauccccggggaccugcagaucuaccacaucggcaaccugcucaagggggaccgccugaacggccaccugauccacaagaucgagccccacuucaacaccagcuggauguccugggacggcugcgaccucgacuacuacugcaacaugggggacuggccgagcugcaccuacacgggcgugacccagcacaaccacgccgccuucgucaaccugcugaacaucgagaccgacuacaccaagacguuccacuuccacuccaagcgggugaccgcccacggggacacgccccagcucgaccugaaggcgcgccccaccuacggcgccggggagaucaccgugcuggucgagguggccgacauggagcuccacaccaagaagguggagaucagcggccugaaguucgccucccuggccugcaccggcugcuacagcugcuccagcgggaucuccugcaagguccggauccacguggacgagcccgacgagcucaccgugcacgucaagagcuccgacccggacgugguggcggccagcacgagccugauggcccgcaagcuggaguucggcaccgacuccaccuucaaggccuucagcgccaugcccaagaccucccucugcuucuacaucgucgagcgggaguacugcaagagcugcuccgaggacgacacgaagaagugcguggacaccaagcuggagcagccccagagcauccugaucgagcacaaggggaccaucaucggcaagcagaacgacacgugcaccgcgaaggccuccugcuggcucgagagcgugaaguccuucuucuacgggcugaagaacaugcugggcagcgucuucggcaacuucuucguggggauccuccuguuccuggcccccuucgugcugcucguccuguucuucauguucggcuggaagauccuguucugcuucaagugcugccgccggacccgcggccucuucaaguaccggcaccugaaggacgacgaggagaccggguaccgcaagaucaucgagcgccugaacuccaagaagggcaagaaccggcuccuggacggggagcgccuggccgaccggaagaucgccgagcuguucagcaccaagacgcacaucggcuga

SEQ ID NO: 11958 - RNA, 5067 nt, Artificial Sequence
  derived and/or modified CDS sequence (opt1) from CCHFV(Gaib)__KX013445.1__GP
augcccgugagcaucauguacaucccgcuggucuacgccgugaucuaccuccagcuguacggccucgggggcgcccacgggcuccugaacaagaccgagcagaacgagaccggcaucacggcgacccacgggcgcgugcagggcccgcccuccgccagcaucacccugcccgucacccccgacccccucuccgccacgagcgccgccuccaccagcggccccgagggguccggcgaggugcccaccagcccguccaccaucacgcaggggcugaccagcuccgagaacacgccccagcugcccaccgcgaccgacaccggcaucagcuccaccagcaucaucgacguguccacccagacggccggggacaccagcacccccaccgcccacacgucccucccgaacagccccuccgcccccuucaccagccaggacacccggcacaccguccgcggccugcugacggugaccagcaccaaguccgacgaggcgagcacccucacggaccccaaggaggccuccaccgaggcccggagcccgucccccagcaucucccgcacccccacccccagcccgacggugcaggccuccaccgagaacaacacccccagcacgccccggcagcccgagccgaccacccgccccgcccugcccucccccaccaccagcccgacccagcccucccugagccaguccgcgacgagcgccgccauccaggacaugcaccccuccccgaccaaccggagccgccggaaccucgagauggagaucauccugacccugucccagggccucaagaaguacuacgggaagauccugaagcugcucgaccugacccuggaggaggacacggagggccuccuggaguggugcaagcgcaaccuggaccugaccugcgacgagaacuucuuccugaagcggaucgaggaguucuuccugagcggggagggccacuucaacgagguccuccaguucaaggcccccagcaccauguccagcaccgagcccacgcacgccgggcccccgaccguggagcccuucaaguccuacuucgcgaagggcuuccugagcaucgacuccggcuacuucagcgccaagugcuacccccgcaccuccaacagcgggcugcagcucaucaacgugacccagcacacggcccggaucgccgacacccccggcccgaagaucaccaacgucaagaccaucaacugcaucaaccugaaggccuccguguucaagaagcaccgcgagguggagaucaacguccugcucccccagaucgcggugaaccugagcaacugccacgugcugaucaagucccacgucugcgacuacagccucaacuucgacgggauggugcggcugccccgcauccaccacgagggcacguucauccccggcaccuacaagaucgugaucgaccggaagaacaagcagaacgaccgcugcacccuggucaccaacugcgugaucaaggggcgggaggugcgcaagggccaguccgcccuccggcaguaccgcacggagaucaagaucggggaggccagcaucggcucccgccggcugcugagcgaggaguccagcgacgacugcaucagccgcacccagcuccugcggaccgagaccgccgagauccacaacgacaacuacgggggcccgggcgacaagaucacgaucugcaacggguccaccaucgucgaccagcgccugggcagcgagcucgggugcuacaccaucaaccgggugaaguccuucaagcugugcgagaacagcgccaccggcaaguccugcgagaucgacagcauccccgucaagugccgccagggguucugccugaagaucacgcaggagggccggggccacgugaagcugucccgcgggagcgaggugguccucgacgcgugcgacuccagcugcgagaucaugauccccaagggcaccggggacauccugguggacugcuccggcggccagcagcacuuccugaaggacaaccucaucgaccuggggugccccaacaucccgcugcucggcaagauggccaucuacaucugccggaugagcaaccaccccaagaccaccauggccuuccuguucugguucuccuucggguacgugaucacgugcaucuucugcaaggccaucuucuaccugcucaucaucgucggcacccuggggaagaaguucaagcaguaccgcgagcugaagccccagaccugcaccaucugcgagacgacccccgugaacgcgaucgacgccgagaugcacgaccucaacugcagcuacaacaucugcccguacugcgccucccggcugaccagcgacggccuggcccgccacgugguccacugccccaagcggaaggagaagaucgaggagaccgagcucuaccugaaccuggagcgcgugcccugggugguccggaagcuccuccagguguccgagagcaccggcguggcccugaagcgcuccagcuggcucaucguccugcuggugcuccugacggugagccugucccccguccagagcgcgccgaucgggcacggcaagaccaucgagaccuaccagacccgggagggguacacguccaucugccucuucgugcugggcgggauccuguucaucgugagcugccucaugaagggccuggucgacuccgugggcaacaacuucuuccccgggcugaccaucugcaagaccugcagcaucuccagcaucaacggcuucgagaucgagucccacaagugcuacugcagccuccugugcugccccuacugccgccacugcuccgccgaccgggagauccaccagcugcaccucagcaucugcaagaagcgcaagaccggguccaacgugaugcuggccgucugcaagcgcaugugccugcgggugacgaccgaggugagcaaccgcgcccucuucauccgguccaucaucaacaccaccuucgucaucugcauccugauccuggccgugugcgugaucagcacguccgcggucgagauggagaaccucccggccggcaccugggagcgcgaggaggaccugaccaacuucugccaccaggagugccaggugaccgagacggagugccugugccccuacgaggcccucgugcugcggaagccccuguucagcgacuccaucgucaaggggaugaagaaccuccugaacagcaccagccuggagaccucccucagcaucgaggcccccuggggcgccaucaacgugcaguccaccuucaagccgacggugagcaccgcgaacaucgcccuguccuggagcuccaucgagcaccgcggcaacaagauccuggucagcgggcgguccgagagcaucaugaagcucgaggagcgcaccggcaucuccugggaccuggggguggaggacgccagcgagucccggcugcucaccgugagcgucauggaccugucccagauguacagccccguguucgaguaccuguccggcgaccgccagguggaggaguggcccaaggccacgugcaccggggacugccccgagcggugcggcugcaccagcuccacgugccuccacaaggaguggccgcacagccgcaacuggcggugcaaccccaccuggugcuggggcgucgggaccggcugcacgugcugcgggcuggacgugaaggaccuguucaccgacuacauguucgugaaguggaaggucgaguacaucaagaccgaggcgaucgugugcguggagcucaccagccaggagcgccagugcucccugaucgaggccggcacccgguucaaccugggccccgucaccaucacgcucagcgagccccgcaacauccagcagaagcugccgcccgagaucaucacccugcacccccggaucgaggagggguucuucgaccucaugcacgugcagaaggugcuguccgccagcaccgucugcaagcugcaguccugcacccacggcgugcccggggaccuccaggucuaccacaucggcaaccugcugaagggggacaaggugaacggccaccucauccacaagaucgagccgcacuucaacaccagcuggauguccugggacggcugcgaccuggacuacuacugcaacaugggggacuggcccagcugcacguacaccggcgugacccagcacaaccacgccgccuucgucaaccugcucaacaucgagaccgacuacacgaagaacuuccacuuccacuccaagcgcgugaccgcgcacggggacacgccccagcuggaccugaaggcccggcccaccuacggcgccggggagaucaccgugcucgucgagguggccgacauggagcugcacaccaagaagaucgagaucagcggccugaaguucgccucccugaccugcaccggcugcuacgcgugcagcuccgggaucagcugcaaggugcgcauccacgucgacgagccggacgagcugacggugcacgugaaguccgaggaccccgacaucgucgccgccagcuccagccugauggcccggaagcucgaguucggcaccgacuccaccuucaaggccuucagcgcgaugcccaagaccagccugugcuucuacaucguggagcgcgaguacugcaaguccugcagccgcgaggacacgcagaagugcguguccaccaagcuggagcagccccagagcauccucaucgagcacaaggggaccaucaucggcaagcagaacaacacgugcaccaccaagacgaccugcuggcuggaguccgucaagagcuucuucuacgggcugaagaacaugcucuccagcaucuucggcaacguguucgugggcaucuucuccuuccuggccccguucauccugcugauccucuucuucauguucggguggcggauccuguucugcuucaagugcugccgccggacccgcggccuguucaaguaccggcaccucaaggacgacgaggagaccggguaccgccggaucaucgagcgccugaacaacaagaagggcaagagcaagcugcucgacggcgagcggcuggccgaccgcaagaucgccgagcuguucuccaccaagacccacaucggguga

SEQ ID NO: 11959 - RNA, 5067 nt, Artificial Sequence
  derived and/or modified CDS sequence (opt1) from CCHFV(Kosova Hoti)__EU037902.1__GP
augcccaucaacaucaugcacacccugcucgugugcuucauccuguaccugcagcuccugggccuggggggcgcccacgggcagagcaacgccaccgagcacaacggcacgaacaccaccaccgcgccggggacgucccagagccccaagccccccgccuccaccaccccgagccacgcccccgagcccuccaccaucaagcucacgacccccaccagcgagaccgagggcuccggcgagacgaccccgcccaccaacaccacgcaggacagccccccccuggagaccaccccggagcgcuccgccaccacggccaccagcaccuccgggaccgacaacaugaacagcacgacccagaugaccgacaacacccccacguccaccgucagcaccucccugagcuccagccccuccacccccagcacgagccagggcaugcaccacccggugcggucccuccugagcguguccagccccaagaccgcgaccacccccacgcccauguccccgggggagaugagcuccgagaccagcucccagcacagcgccaugucccgcacccccaccccccacaccgccacgcaggucagcaccgagaacgccaaccgguccaccagccgccaguccgagagcuccgcgcagcccgccacccagagcccggugacgucccccgcccagagcauccugcucaugagcgccacccccaccaccauccagaacauccaccccuccccgacgaaccggagcaagcgcaaccuggagauggagaucauccugacccucucccagggccugaagaaguacuacgggaagauccugaagcuccugcaccugacccucgaggaggacaccgagggccugcuggaguggugcaagcggaaccucggcagcaacugcgacgacgacuucuuccagaagcgcaucgaggaguucuucaucacgggggagggcuacuucaacgaggugcugcaguucaagacccuguccacccccagcuccaccgagcccagccacgcccggcucccgacggcggagcccuucaaguccuacuucgccaagggguuccugagcaucgacuccggcuacuucagcgccaagugcuacccccgcuccagcaccuccggccugcagcucaucaacgucacccagcaccccgcccggaucgccgagaccccggggcccaagacgaccagccugaagaccaucaacugcaucaaccugcgcgcguccguguucaaggagcaccgggagguggagaucaacguccuccugccccagaucgccgugaaccugagcaacugccacguggucaucaacagccacgugugcgacuacucccucgacaccgacggccccgugcgccugccgcggaucuaccacgaggggacguucaugcccggcaccuacaagaucgucaucgaccgcaagaacaagcugaacgaccggugcacccucgugaccaacugcgugaucaaggggcgcgagguccggaagggccagagcgugcugcgccaguacaagacggagaucaagaucggcaaggcccccaccgggucccggaagcugcucagcgaggagcccggcgacgacugcaucucccgcacccagcugcugcgcaccgagacggccgagauccacgacgacaacuacgggggcccgggggacaagaucaccaucugcaacggcagcaccaucguggaccagcggcucggcuccgagcuggggugcuacaccaucaaccgcgucaagagcuucaagcugugcgagaacuccgccacgggcaagaccugcgagaucgacagcacccccgugaagugccggcagggguucugccucaagaucacccagaagggccgcgggcacgugaagcugucccggggcagcgaggucgugcuggacgcgugcgacuccaacugcgaggucaugauccccaagggcaccggggacauccugguggacugcagcggcgggcagcagcacuuccucaaggacaaccugaucgaccugggcugcccccacaucccgcuccugggcaagauggccaucuacaucugccgcauguccaaccaccccaagacgaccauggccuuccuguucugguucagcuucggguacgugaucaccugcaucuucugcaaggcccucuucuacucccugaucaucaucggcacccuggggaagaagaucaagcaguaccgggagcucaagccccagacgugcaccaucugcgagaccgcccccgucaacgcgaucgacgccgagaugcacgaccugaacugcagcuacaacaucugcccguacugcgccucccgccugaccagcgacggccucgcccggcacgugaagcagugccccaagcgcaaggagaagguggaggagacggagcuguaccugaaccucgagcggauccccugggucgugcgcaagcugcugcaggugagcgaguccaccggggucgcgcucaagcggagcuccuggcugaucgugcugcucgugcugcugaccgucagccucucccccgugcagagcgccccggugggccacggcaagaccaucgagacguaccagacccgcgagggguucaccuccaucugccuguucaugcugggcagcauccucuucaucgucuccugccuggugaaggggcugguggacagcgucuccgacagcuucuuccccggccucuccgugugcaagaccugcagcaucggguccaucaacggcuucgagaucgagagccacaagugcuacugcucccuguucugcugccccuacugccggcacugcagcgccgaccgcgagauccaccagcugcaccucaacaucugcaagaagcggaagacgggcuccaacgugaugcuggccgucugcaagcgcaugugcuuccgggccaccaucgaggcgagccgccgcgcccugcucauccggagcaucaucaacaccaccuucgugaucugcauccugacgcugaccaucugcguggucuccaccagcgccguggagauggagaaccucccggccgggaccugggagcgcgaggaggaccugacgaacuucugccaccaggagugccaggugaccgagaccgagugccugugccccuacgaggcccucguccugcggaagccccuguuccucgacuccaucgugaagggcaugaagaaccugcugaacagcaccucccucgagacgagccuguccaucgaggcgcccuggggggccaucaacgugcagagcaccuucaagccgaccgucuccaccgccaacaucgcccugagcugguccagcguggagcaccgcggcaacaagauccucgugacggggcgguccgagagcaucaugaagcuggaggagcgcaccggcaucuccugggaccugggcgucgaggacgccagcgaguccaagcuccugaccgugagcaucauggaccugucccagauguacagccccguguucgaguaccucagcggggaccggcaggucgaggaguggcccaaggcgaccugcacgggcgacugcccccagcgcugcgggugcaccuccagcaccugccugcacaaggaguggccgcacucccggaacuggcgcugcaaccccaccuggugcuggggcguggggaccggcugcacgugcugcggcguggacgucaaggaccuguucaccgaccacauguucgugaaguggaagguggaguacaucaagaccgaggccaucgucugcguggagcucaccagccaggagcggcagugcucccugaucgaggccgggacgcgcuucaaccugggccccgugaccaucacccucagcgagccccggaacauccagcagaagcugccgcccgagaucaucacccugcaccccaagaucgaggagggguucuucgaccucaugcacguccagaaggugcuguccgccagcacggugugcaagcugcaguccugcacccacggcauccccggcgaccuccaggucuaccacaucgggaaccugcugaagggcgaccgcgugaacgggcaccucauccacaagaucgagccgcacuucaacaccagcuggauguccugggacggcugcgaccuggacuacuacugcaacaugggggacuggcccagcugcaccuacacgggcgugacccagcacaaccacgcggccuucgucaaccugcucaacaucgagaccgacuacaccaagacguuccacuuccacuccaagcgggugaccgcccacggcgacaccccccagcuggaccugaaggcccgccccaccuacggggccggcgagaucacgguccucguggagguggcggacauggagcugcacaccaagaaggucgagaucagcgggcugaaguucgccucccucgccugcaccggcugcuacgccugcagcuccgggaucagcugcaaggugcggauccacguggacgagccggacgagcugaccguccacgugaaguccagcgaccccgacguggucgccgcgggcacgagccugauggcccgcaagcucgaguucggcaccgacuccaccuucaaggccuucagcgccaugcccaagaccucccugugcuucuacaucguggagaaggaguacugcaagagcugcuccgaggacgacacgaagaagugcguggacaccaagcuggagcagccccagagcauccucaucgagcaccgggggaccaucaucggcaagcagaacgacaccugcacggccaaggcguccugcuggcuggagagcgucaaguccuucuucuacgggcugaagaacaugcucggcagcguguucgggaacuucuucaucggcauccugcuguuccucgccccguucgugcugcugguccuguucuucauguucggcuggaagauccucuucugcuucaagugcugccgccggacccgcgggcuguucaaguaccgccaccugaaggacgacgaggagaccggcuaccggcgcaucaucgagcggcucaacaacaagaaggggaagaaccgccugcuggacggcgagcggcucgccgaccgcaagaucgccgagcuguucuccaccaagacgcacaucggcuga

SEQ ID NO: 11960 - RNA, 5067 nt, Artificial Sequence
  derived and/or modified CDS sequence (opt1) from CCHFV(Turkey200310849)__DQ211636.1__GP
augcccaccaacaucaugcacacccugcucgugugcuucauccuguaccugcagcuccugugccugggcggggcccacggccagcucaacacgaccgagcacaacgggaccaacaacaccacggccccgggcgcgagccagucccccaagccgcccaugagcaccaccccgccccacgcccccgaguccagcaccaucaagcccacgacccccaucuccgaggccgaggggagcggcgagaccaccuccacgcccaacaccacccagggccugagcucccccgagaccacgagcgagcgccccgccaccaccgccaucuccaccagcuccacggacagcaccaacccgaccacccagaugacggacaacacccccacccugaccgucuccacgagccccuccagcucccccagcaccccgagcacgccccaggggaucuaccaccccgcgcggucccuccugagcguguccagccccaagaccgugaccaccccgacccccaccucccccggcgagaugagcuccgagacgagcucccagcacagcgccaugucccgcauccccaccccgcacaccgccacccgggucagcaccgagaacacgaaccacuccacgccccgccagagcgaguccagcgcccagcagaccacccccucccccaugaccagcccggcgcaguccauccugcucaugagcgccgcccccaccgccgugcaggacauccaccccagcccgaccaaccgguccaagcgcaaccuggagaccgagaucauccugacgcucagccaggggcugaagaaguacuacggcaagauccugaagcuccugcaccugacccucgaggaggacaccgaggggcugcuggaguggugcaagcggaaccucggcuccaacugcgacgacgacuucuuccagaagcgcaucgaggaguucuucaugaccggcgagggguacuucaacgaggugcugcaguucaagacgcugagcacccucucccccaccgagcccagccacgcccggcugcccaccgcggagccguucaaguccuacuucgccaagggcuuccugagcaucgacuccggguacuucagcgccaagugcuacccccgcuccagcgccuccggccuccagcugaucaacgucacgcagcaccccgcccggaucgcggagacccccggcccgaagaccaccagccugaagacgaucaacugcaucaaccuccgcgccuccguguucaaggagcaccgggagaucgagaucaacgugcugcugccccagaucgccgucaaccucagcaacugccacguggugaucaacucccacgucugcgacuacagccuggacaccgacgggcccgugcgccugccccggaucuaccacgagggcaccuucaucccggggaccuacaagaucgugaucgacaagaagaacaagcucaacgaccgcugcacgcuggucaccaacugcgugaucaagggccgggaggugcgcaaggggcagagcguccugcggcaguacaagaccgagaucaagaucggcaaggccuccaccggcuuccgcaagcuccugagcgaggagcccggggacgacugcaucucccggacgcagcugcuccgcaccgagaccgccgagauccacgacgacaacuacggcgggcccggcgacaagaucaccaucugcaacgggagcacgaucguggaccagcgccugggcuccgagcugggcugcuacaccaucaaccgggucaagagcuucaagcucugcgagaacuccgcgaccgggaagaccugcgagguggacagcacgcccgugaagugccgccagggcuucugccugaagaucacccaggaggggcggggccacgugaagcugucccgcgggagcgaggucgugcuggacgccugcgacuccagcugcgaggucaugaucccgaagggcaccggcgacauccucguggacugcuccgggggccagcagcacuuccugaaggacaaccugaucgaccucgggugcccccacaucccccugcugggcaagauggccaucuacaucugccggaugagcaaccacccccgcaccaccauggccuuccucuucugguucuccuucggcuacgugaucacgugcaucagcugcaaggcccuguucuacucccugaucaucaucgggacccucggcaagaagaucaagcaguaccgggagcugaagccgcagaccugcaccaucugcgagacggcgcccgucaacgccaucgacgccgagaugcacgaccugaacugcagcuacaacaucugccccuacugcgccucccgccucaccagcgacgggcuggcgcggcacgugacccagugccccaagcgcaaggagaagguggaggagaccgagcuguaccucaaccuggagcggaucccguggaucguccgcaagcugcuccaggugagcgaguccacgggcguggcccugaagcggagcuccuggcugaucguccuccuggugcugcucaccgugagccugucccccguccagagcgcccccguggggcacggcaagaccaucgagaucuaccagacccgcgagggcuucgccuccaucugccuguucaugcucgggagcauccuguucaucguguccugccuggucaagggccucguggacagcguguccgacagcuucuucccggggcuguccgucugcaagacgugcagcaucggcuccgugaacggguucgagaucgagagccacaagugcuacugcucccuguucugcugccccuacugccggcacugcagcgccgaccgcgagauccaccagcuccaccuguccaucugcaagaagcggaagaccggcagcaacgugaugcuggcggucugcaagcgcaugugcuuccgggccaccaucgaggccagccgccgcgcccuccugauccgguccaucaucaacaccacguucgugaucugcauccugacccucaccaucugcguggucagcaccuccgccguggagauggagaaccugcccgcgggcacgugggagcgcgaggaggaccugaccaacuucugccaccaggagugccaggugaccgagaccgagugccucugccccuacgaggcccugguccugcggaagccccucuuccuggacagcaucgugaaggggaugaagaaccugcucaacuccacgagccuggagaccucccugagcaucgaggccccguggggcgccaucaacgugcaguccaccuucaagcccgccgucagcaccgcgaacaucgcccucuccuggagcuccguggagcaccgcgggaacaagauccuggugacgggccggagcgaguccaucaugaagcuggaggagcgcaccggggucagcugggaccucggcguggaggacgccuccgagagcaagcugcugaccguguccaucauggaccucagccagauguacagccccgucuucgaguaccuguccggcgaccgccagguggaggaguggccgaaggcgaccugcacgggggacugccccgagcggugcggcugcaccagcagcacgugccugcacaaggaguggccccacucccggaacuggcgcugcaaccccaccuggugcuggggcguggggaccgggugcacgugcugcggcgucgacgugaaggaccucuucaccgaccacauguucgugaaguggaaggucgaguacaucaagaccgaggccaucgugugcguggagcugaccucccaggagcggcagugcagccugaucgaggccggcacccgcuucaaccucgggccggucaccaucacccuguccgagccccggaacauccagcagaagcugccgcccgagaucaucacccuccaccccaagaucgaggagggcuucuucgaccugaugcacgugcagaaggugcugagcgccuccacggucugcaagcuccagagcugcacccacgggauccccggcgaccuccagguguaccacaucggcaaccugcucaagggggaccgcgugaacggccaccugauccacaagaucgagucccacuucaacaccagcuggauguccugggacgggugcgaccuggacuacuacugcaacaugggcgacuggcccagcugcaccuacacgggggucacccagcacaaccacgccgccuucgugaaccuccugaacaucgagaccgacuacaccaagacguuccacuuccacuccaagcgggucaccgcgcacggcgacacgccccagcuggaccucaaggcccgcccgaccuacggcgccggggagaucaccgugcugguggaggucgccgacauggagcugcacaccaagaagguggagaucagcggccucaaguucgccucccuggcgugcaccgggugcuacgccugcagcuccggcaucagcugcaaggugcggauccacgucgacgagcccgacgagcugaccgugcacgucaagagcuccgaccccgacgugguggccgccagcacgucccucauggcccgcaagcuggaguucgggaccgacagcaccuucaaggcguucuccgccaugcccaagaccagccugugcuucuacaucguggagcgggaguacugcaaguccugcagcgaggacgacacgcagaagugcgucgacacccgccucgagcagccgcaguccauccugaucgagcacaagggcaccaucaucggcaagcagaacgacacgugcaccgccaaggccagcugcuggcuggaguccgucaagagcuucuucuacgggcucaagaacaugcugggcuccguguucgggaaccuguucaucggcauccuccuguuccuggcgcccuucgugcugcucgugcuguucuucauguucggguggaagauccuguucugcuucaagugcugccggcgcacccgcggccucuucaaguaccggcaccugaaggacgacgaggagaccggcuaccgccggaucaucgagcgccugaacagcaagaaggggaagaaccggcuccuggacggcgaccgccuggccgaccggaagaucgccgagcuguucuccaccaagacgcacaucggguga

SEQ ID NO: 11961 - RNA, 5067 nt, Artificial Sequence
  derived and/or modified CDS sequence (opt1) from CCHFV(Kashmanov)__DQ211631.1__GP
augcccaccaacaucaugcacacccugcucgugugcuucauccuguaccugcagcuccugggccucgggggcgcccacgggcagagcaacgccacggagcacaacggcaccaacaccaccacggcgccguccaccagccagucccccaagccccuggucagcaccgcgcccccgcacgcccuggaguccagcaccaucaagcccacgacccccgccuccgagaccgaggggagcggcgagaccacgcccccgcccaacaccacccagggccccuccccgcccgagaccacgcccgagcgccccgccaccaccgccaccagcacgcccuccaccgacaacaccaacagcaccacgcacgugaccgacaacaacccgaccuccaccaucagcacgucccccagcuccagccccuccacccccagcaccccgcaggggauccaccaccccgcccggaaccugcucagcguguccagccccaagaccgccacgacccccaccccgaccucccccggcgagaucagcuccgaggccagcucccugcacagcgcgaugucccgcacgagcacccuguacaccgccacccaggucuccaccgagaacgccaaccacagcgcgccccggcaguccgagagcuccgcccagcccacgaccaccagcccgaugaccucccccgcccagagcauccucgugauguccgccgcccccaucgccauccagaacauccacccgagccccacgaaccgcagcaagcggaaccuggagauggagaucauccugacccucucccaggggcugaagaaguacuacggcaagauccugaagcuccugcaccugacccucgaggaggacaccgaggggcugcuggaguggugcaagcgcaaccucggcagcaacugcgacgacgacuucuuccagaagcggaucgaggaguucuucaugacgggcgagggguacuucaacgaggugcugcaguucaagacccuguccacccucagccccaccgagcccucccacgccggcccgcccacggucgagcccuucaagagcuacuucgcgaagggguuccuguccaucgacagcggcuacuucuccgccaagugcuacccccgcagcuccaccagcggccugcagcucaucaacgugacccagcacccggcccggaucgccgagacccccgggcccaagacgaccucccugaagaccaucaacugcaucaaccugcgcgccagcguguucaaggagcaccgggagaucgagaucaacguccuccugccccagaucgcggugaaccuguccaacugccacguggucaucaacagccacgugugcgacuacucccucgacaccgacggcccggugcgccugccccacaucuaccacgaggggacguucauccccggcaccuacaagaucgucaucgacaagaagaacaagcugaacgaccggugcacccucgugaccaacugcgugaucaaggggcgcgagguccggaagggccagagcgugcugcgccaguacaagacggagaucaagaucggcaaggccagcaccgggucccggaagcugcucagcgaggagcccggcgacgacugcaucucccgcacccagcugcugcggaccgagacggccgagauccacgacgacaacuacgggggcccgggggacaagaucaccaucugcaacggcagcaccaucguggaccagcgccucggcuccgagcuggggugcuacaccaucaaccgggucaagagcuucaagcugugcgagaacuccgccacgggcaagaccugcgagaucgacagcacccccgugaagugccgccagggguucugccucaagaucacccaggagggccgcgggcacgugaagcugucccggggcagcgaggucgugcuggacgccugcgacuccagcugcgaggucaugauccccaagggcacgggggacauccugguggacugcuccggcgggcagcagcacuuccucaaggacaaccugaucgaccugggcugcccccacaucccgcuccugggcaagauggcgaucuacaucugccgcaugagcaaccacccccggaccaccauggccuuccuguucugguucuccuucggguacgugaucacgugcaucuucugcaaggcccucuucuacagccugaucaucaucggcacccuggggaagaagaucaagcaguaccgcgagcucaagccccagaccugcaccaucugcgagaccgcccccgucaacgcgaucgacgccgagaugcacgaccugaacugcuccuacaacaucugcccguacugcgccagccggcugaccuccgacggccucgcccgccacgugccccagugccccaagcggaaggagaagguggaggagacggagcuguaccugaaccucgagcgcaucccguggaucguccggaagcugcuccaggugagcgagagcaccgggguggcccugaagcgcuccagcuggcugaucguccugcucgugcugcugaccgugucccucagccccguccaguccgcgcccgugggccacggcaagaccaucgagacguaccagacccgggagggguucaccagcaucugccuguucaugcugggcuccauccucuuccuggugagcugccuggucaaggggcucguggacuccgugagcgacuccuucuuccccggccugagcgucugcaagaccugcacgaucggguccaucaacggcuucgagaucgagagccacaagugcuacugcucccuguucugcugcccguacugccgccacugcagcgccgaccgggagauccaccagcuccaccuguccaucugcaagaagcgcaagaccggcagcaacgugaugcuggccgugugcaagcggaugugcuuccgcgccaccaucgaggccucccggcgcgcgcuccugauccggagcaucaucaacaccacguucgucaucugcauccugacccucaccaucugcguggugagcaccuccgccgucgagauggagaaccugcccagcgggacgugggagcgcgaggaggaccugaccaacuucugccaccaggagugccaggugaccgagaccgagugccucugccccuacgaggcccuggugcugcgcaagccccucuuccuggacuccaucgucaagggcaugaagaacagccugaacuccacgagccucgagaccucccugagcaucgaggccccguggggcgccaucaacgugcaguccaccuucaagcccaccgugagcacggcgaacaucgcccuguccuggagcuccgucgagcaccgggggaacaagauccucgugaccgggcgcagcgaguccaucaugaagcuggaggagcggaccggcgugagcugggaccugggcgucgaggacgccuccgagagcaagcuccugaccguguccaucauggaccugagccagauguacagccccguguucgaguaccucuccggggaccgccaggucgaggaguggcccaaggccacgugcaccggcgacugcccggagcggugcgggugcaccagcuccacgugccugcacaaggaguggccccacagccgcaacuggcggugcaaccccaccuggugcuggggcguggggaccggcugcacgugcugcggcguggacgucaaggaccuguucaccgaccacauguucgugaaguggaagguggaguacaucaagaccgaggcgaucgucugcguggagcucaccucccaggagcgccagugcagccugaucgaggccgggacccgguucaaccugggccccgugaccaucacccucuccgagccgcgcaacauccagcagaagcugccgcccgagaucaucacgcugcaccccaaggucgaggagggguucuucgaccucaugcacgugcagaaggugcugagcgccuccaccgucugcaagcugcagagcugcacccacggcauccccggcgaccuccagguguaccacaucgggaaccugcugaagggcgaccggaucaacgggcaccucauccacaagaucgagccccacuucaacaccuccuggaugagcugggacggcugcgaccuggacuacuacugcaacaugggggacuggcccuccugcacguacaccggcgugacccagcacaaccacgccgccuucgucaaccugcucaacaucgagaccgacuacacgaagaccuuccacuuccacagcaagcgcgugaccgcgcacggcgacacgccccagcuggaccugaaggcccggccgaccuacggggccggcgagaucaccguccucguggagguggccgacauggagcugcacaccaagaaggucgagaucuccgggcugaaguucgccagccucgcgugcaccggcugcuacgccugcuccagcgggaucuccugcaaggugcgcauccacguggacgagcccgacgagcugacgguccacgucaagagcagcgaccccgacgugguggccgccuccaccagccugauggcccggaagcucgaguucggcaccgacuccaccuucaaggcguucagcgccaugcccaagacgucccugugcuucuacaucguggagcgcgaguacugcaagagcugcuccgaggaggacacccagaagugcguggacaccaagcuggagcagccgcagagcauccucaucgagcacaagggcaccaucaucgggaagcagaacgacacgugcaccgccaaggccuccugcuggcuggagagcgucaaguccuucuucuacggccugaagaacaugcucgggagcguguucggcaacuucuucaucgggauccugcuguuccucgcgcccuucgugcugcugguccuguucuucauguucggcuggaagauccucuucugcuucaagugcugccggcgcacccggggccugcugaaguaccgccaccucaaggacgacgaggagaccggguaccggcgcaucaucgagcgccugaacaacaagaagggcaagaaccggcugcucgacggggagcgccuggccgaccggaagaucgccgagcuguucuccacgaagacccacaucggcuga

SEQ ID NO: 11962 - RNA, 5067 nt, Artificial Sequence
  derived and/or modified CDS sequence (opt1) from CCHFV(Drosdov)__DQ211630.1__GP
augcccaucaacaucaugcacgcccugcucgugugcuucauccuguaccugcagcucagcggccucgggggcgcccaccgccaguccaacgcgaccgagcacaacgggaccaacacgaccaccgccccgggcaccagccagucccccaagccgcccgucagcacgacccugccccacacccccgaggccuccaccaucaagcugacgacccccaccagcgagaccgagggguccggcgagacgacgcccccgcccaacaccacccagggccugccccugcccgggaccaccccggagcggagcgccaccaccgccacguccaccagcuccaccgacgacaugaacagcaccacgcagaugaccgacaacacccccaccuccacggugagcaucggccucuccagcucccccagcaugcccuccaccagccaggggauccacuacccggugcgcagccugcuguccgucagcucccccaagaccgcgaccacgcccacccccaugagcccgggcgaggugucccccgagaccagcucccagcacagcgccaugucccggauccccacccucuacacggccacccaggugagcaccgagaacaccaaccgcuccaucccccggcagagcgaguccagcguccagccggccacccagucccccaucacgagccccgcgcagaccauccugcugauguccgccgcccccaccgccauccaggacaugcacccgagccccaagaaccgcuccaagcggaaccucgagguggagaucauccugacccugagccaggggcucaagaaguacuacggcaagauccugaagcugcuccaccugacgcuggaggaggacaccgagggccuccuggaguggugcaagcgcaaccuggggagcaacugcgacgacgacuucuuccagaagcggaucgaggaguucuucaucaccggcgagggguacuucaacgaggugcuccaguucaagacccccuccacgcugagcccgaccgagcccucccacguccgccugcccaccgccgagcccuucaagagcuacuucgcgaagggcuuccucuccaucgacagcggcuacuucuccgccaagugcuacccgcggagcuccaccagcgggcugcagcugaucaacgugacgcagcaccccgcccgcaucgccgagacccccggccccaagaccaccucccucaagacgaucaacugcaucaaccugcgggccagcguguucaaggagcaccgcgaggucgagaucaacgugcugcucccgcagaucgcggugaaccuguccaacugccacgucgugaucaacagccacgugugcgacuacucccuggacaccgacgggcccguccggcucccccgcauccaccacgagggcgccuucauccccgggaccuacaagaucgugaucgacaagaagaacaagcugaacgaccggugcagccuggugaccaacugcgucaucaagggccgcgaggugcggaagggccaguccgugcuccgccaguacaagacggagaucaagaucgggaaggccagcaccggcagccggaagcugcuguccgaggagccgggggacgacugcaucagccgcacccagcuccugaagaccgagacggccgagauccacgacgacaacuacggcgggcccggcgacaagaucaccaucugcaacggcuccaccaucgucgaccagcgccuggggagcgagcucggcugcuacaccaucaaccgggugaaguccuucaagcugugcgagaacagcgccacggggaagaccugcgagaucgacuccacccccgucaagugccgccagggcuucugccugaagaucacccaggaggggcggggccacgugaagcugagccgcggcuccgaggugguccucgacgcgugcgacagcuccugcgaggugaugauccccaaggggacgggcgacauccugguggacugcagcgggggccagcagcacuuccugaaggacaaccucaucgaccugggcugcccgcacaucccccugcucgggaagauggccaucuacaucugccggauguccaaccacccccgcaccaccauggccuuccuguucugguucagcuucggcuacgucaucacgugcaucuucugcaaggcccuguucuacucccucaucaucaucgggacccugggcaagaagaucaagcaguaccgggagcugaagccccagaccugcaccaucugcgagaccgccccggugaacgcgaucgacgccgagaugcacgaccucaagugcagcuacaacaucugccccuacugcgccucccgccugaccagcgacgggcuggcccggcacgugacgcagugccccaagcgcaaggagaaggucgaggagaccgagcucuaccugaaccuggagcggauccccuggaucgugcgcaagcuccuccagguguccgagagcaccggcgucgcgcugaagcggagcuccuggcucaucgugcugcuggugcuccugaccgucagccuguccccggugcagagcgcccccgugggccacgggaagacgaucgagaccuaccagacccgcgagggcuucaccuccaucugccucuucaugcuggggagcauccuguucaucgucuccugccucgugaagggccugguggacagcgucuccgacagcuucuuccccgggcuguccgugugcaagacgugcagcaucggcuccaucaacggcuucgagaucgagagccacaagugcuacugcucccucuucugcugcccguacugccggcacuacagcgccgaccgcgagauccaccagcugcaccuguccaucugcaagaagcggaagaccgggagcaacgugaugcucgccgucugcaagcgcaugugcuucaaggccaccaucgaggcgucccggcgcgcccugcugauccgcagcaucaucaacaccacguucgugaucugcauccucauccuggccaucugcguggucagcaccuccgccguggagauggagaaccugcccgccggcaccugggagcgggaggaggaccucaccaacuucugccaccaggagugccaggugacggagaccgagugccugugccccuacgaggcgcugguccuccgcaagccccuguuccuggacagcaccgugaaggggaugaagaaccuccugaacuccaccagccuggagacgucccucagcaucgaggccccguggggcgccaucaacgugcaguccaccuucaagcccaccgucagcaccgccaacaucgcccuguccuggagcuccguggagcaccgggggaacaagauccuggugacgggccgcagcgaguccaucaugaagcucgaggagcggaccggcgucagcugggaccuggggguggaggacgcguccgagagcaagcugcucaccguguccaucauggaccugagccagauguacucccccgucuucgaguaccugagcggcgaccgccagguggaggaguggcccaaggcgaccugcacgggggacugcccggagcggugcggcugcaccagcagcacgugccuccacaaggaguggccccacucccgcaacuggcggugcaaccccaccuggugcuggggcguggggaccggcugcacgugcugcggggucgacgugaaggaccuguucaccgaccacauguucgugaaguggaaggucgaguacaugaagaccgaggccaucgugugcguggagcugaccucccaggagcgccagugcagccucaucgaggccggcacccgguucaaccuggggcccgucaccaucacccuguccgagccgcgcaacauccagcagaagcucccgcccgagaucaucacccugcaccccaagaucgaggagggcuucuucgaccugaugcacgugcagaaggugcucagcgccuccacggucugcaagcugcagagcugcacccacggcauccccggggaccugcagaucuaccacaucggcaaccuccugaagggggaccgggugaacggccaccugauccacaagaucgagccccacuucaacaccuccuggaugagcugggacgggugcgaccucgacuacuacugcaacaugggcaacuggcccuccugcaccuacacgggcgucacccagcacaaccacgccgccuucgugaaccugcugaacaucgagaccgacuacaccaagacguuccacuuccacagcaagcgcgugaccgcccacggggacacgccccagcucgaccugaaggcccggccgaccuacggcgcgggggagaucaccguccugguggagguggccgacauggagcuccacaccaagaaggucgagaucuccggccugaaguucgccagccuggugugcaccgggugcuacgccugcuccagcggcaucuccugcaaggugcgcauccacgucgacgagcccgacgagcucaccgugcacgucaagagcuccgaccccgacgugguggccgcgagcacgagccugauggcccggaagcuggaguucggcaccgacuccaucuucaaggccuucagcgccaugcccaagaccucccucugcuucuacaucguggagcgcgaguacugcaagagcugcuccgaggacgacaccaagaagugcgucgacacgaagcuggagcagccgcagagcauccugaucgagcacaaggggaccaucaucggcaagcagaacgacacgugcaccgccaaggcguccugcuggcucgagagcgugaaguccuucuucuacgggcugaagaacaugcugggcagcguguucgggaacuucuucgucggcauccuccuguuccuggcccccuucgugcugcucgugcuguucuucauguucggcuggaagauccuguucugcuucaagugcugccggcgcacccggggccucuucaaguaccgccaccugaaggacgacgaggagaccggguaccgccggaucaucgagcgccugaacuccaagaaggggaagaaccggcuccuggacggcgagcgccuggccgaccggaagaucgccgagcuguucagcaccaagacccacaucggcuga

SEQ ID NO: 11963 - RNA, 5067 nt, Artificial Sequence
  derived and/or modified CDS sequence (opt1) from CCHFV(1231-CR/TI-2015)__KU161585.1__GP
augcccaucaacaucaugcacacccugcucgugugcuucauccuguaccugcagcuccugggccuggggggcgcccacgagcagagcaacgccaccgaccacaaccgcacgaacaccaucaccgcgccguccaccagccagaaccccaagccccccgccuccacgaccccgccccacacccccgagagcuccaccaucaagcucaucacgagcaccggggaggccgagggcuccggggagaccacccccccgcugaacacgacccagggccccuucccccccgagaccaccagcgagcacccggccuccacggccaccaacaccagcuccaccaacagcaugaacuccacgacccagaugaccgacaagacccugacgagcaccgucuccaccagccucuccaucagccccuccacccccagcacgagccagggcauccacuaccccauccggucccugcugagcguguccagcccgcgcaccgcggccacccccacccccauguccacgcgggagaugagcuccgagaccaacagccagcacuccgccgugagccgcacccccaccuuccacacggccacccaggucuccaccgagaacgacaaccggagcaccccgcgccaguccgagagcuccgcgcagcccgccacccagagccccaugacgucccccgcccagagcauccuccugguguccgccgccccgaccaccauccagaacauccaccccagccccaccaaccggagcaagcgcaaccuggagauggagaucauccucacgcugccccaggggcugaagaaguacuacggcaagauccucaagcugcugcaccucacccuggaggaggacaccgaggggcugcucgaguggugcaagcggaaccugggcuccaacugcgacgacgaguucuuccagaagcgcaucgaggaguucuucaucaccggggagggcuacuucaacgaggugcugcaguucaagacgcucagcacccuguccccgauggagcccagccacgcgcggcccccgaccgccgagcccuucaaguccuacuucgccaagggcuuccugagcaucgacuccggguacuucagcgccaagugcuacccccgcuccagcuccagcggccuccagcugaucaacaucacccagcaccccgcccggaucgcggagacgccggggcccaagaccaccucccugaagaccaucaacugcaucaaccuccgcgccagcgucuucaaggagcaccgggagguggagaucaacgugcugcugccccagaucgccgucaaccucuccaacugccacguggugaucaacagccacgucugcgacuacucccuggacacggacggccccgugcgccugccgcggaucuaccacgagggcaccuucauccccgggaccuacaagaucgugaucgacaagaagaacaagcucaacgaccgcugcacccuggucacgaacugcgugaccaagggccgggaggugcgcaaggggcagagcguccugcggcaguacaagaccgagaucaagaucggcaaggccagcaccgggucccgcaagcuccugagcgaggagcccggcgacgacugcaucucccgcacgcagcugcuccggaccgagaccgccgagauccacgacgacaacuacggcgggcccggcgacaagaucaccaucugcaacgggagcacgaucguggaccagcgccugggcuccgagcuggggugcuacaccaucaaccgggugaagagcuucaagcucugcgagaacuccgcgaccggcaagaccugcgagaucgacagcacgccggucaagugccgccagggcuucugccugaagaucacccaggaggggcggggccacgugaagcugucccgcgggagcgaggugguccuggacgccugcgacuccagcugcgaggugaugauccccaagggcaccggggacauccucgucgacugcuccggcggccagcagcacuuccugaaggacaaccugaucgaccucgggugcccccacaucccccugcugggcaagauggccaucuacaucugccggaugagcaaccacccgcgcaccacgauggccuuccucuucugguucuccuucggguacgugaucaccugcaucuucugcaaggcccuguucuacagccugaucaucaucggcacccucggcaagaagaucaagcaguaccgggagcugaagccccagaccugcaccaucugcgagacggcgcccgugaacgccaucgacgccgagaugcacgaccugaacugcuccuacaacaucugccccuacugcgccagccgccucaccuccgacgggcuggcgcggcacgucacccagugcccgaagcgcaaggagaagguggaggagaccgagcuguaccucaaccuggagcggauccccuggaucgugcgcaagcugcuccaggucagcgagagcacgggcguggcccugaagcgguccagcuggcugaucgugcuccugguccugcucaccgugucccugagccccgugcaguccgcccccgucgggcacggcaagaccaucgagaccuaccagacgcgcgagggguucaccagcaucugccuguucaugcucggcuccauccuguucaucgugagcugccuggugaagggccucgucgaguccgugagcgacuccuucuucccggggcugagcgugugccggaccugcuccaucggcagcaucaacggguucgagaucgagucccacaagugcuacugcagccuguucugcugccccuacugccgccacugcuccgccgaccgggagauccaccagcuccaccugagcaucugcaagaagcgcaagaccggcuccaacgucaugcuggccgugugcaagcgcaugugcuuccgggcgacgauggaggccagccgccgggcccuccugauccgcagcaucaucaacaccaccuucgugaucugcauccugacccucacgaucugcgucguguccaccagcgccguggagauggagaaccugcccgccgggaccugggagcgggaggaggaccugaccaacuucugccaccaggagugccaggucacggagaccgagugccucugcccguacgaggcgcuggugcugcgcaagccccucuuccuggacuccaucgugaagggcaugaagaaccugcucaacagcaccucccuggagaccagccuguccaucgaggcccccuggggcgccaucaacguccagagcacguucaagcccaccguguccaccgccaacaucgcccucagcugguccagcguggagcaccgggggaacaagauccuggucaccggccgcuccgagagcaucaugaagcuggaggagcggacggggguguccugggaccucggcguggaggacgcgagcgaguccaagcugcugaccgucagcaucauggaccucucccagauguacagcccgguguucgaguaccugagcggggaccgccagguggaggaguggcccaaggccaccugcaccggcgacugccccgagcggugcggcugcacguccagcaccugccugcacaaggaguggccccacucccgcaacuggcggugcaacccgaccuggugcuggggggucggcaccgggugcacgugcugcggcguggacgugaaggaccucuucaccgaccacauguucgucaaguggaagguggaguacaucaagaccgaggccaucgugugcgucgagcugaccagccaggagcgccagugcucccugaucgaggccgggacccgguucaaccucggccccgugacgaucacccugagcgagccccgcaacauccagcagaagcugcccccggagaucaucacccuccaccccaagaucgaggagggcuucuucgaccugaugcacgugcagaagguccuguccgcgagcaccgugugcaagcuccaguccugcacgcacgggauccccggcgaccugcagguguaccacaucgggaaccugcucaagggcgaccgggucaacggccaccugauccacaagaucgagccccacuucaacaccagcuggauguccugggacgggugcgaccuggacuacuacugcaacaugggcgacuggccgagcugcaccuacaccggggugacgcagcacaaccacgccgccuucgugaaccuccugaacaucgagaccgacuacaccaagaccuuccacuuccacuccaagcgcgucacggcccacggcgacaccccccagcuggaccucaaggcccggcccaccuacggggcgggcgagaucaccgugcuggucgagguggccgacauggagcugcacacgaagaagguggagaucagcggccucaaguucgccucccuggccugcaccgggugcuacgccugcagcuccggcaucagcugcaagguccgcauccacguggacgagcccgacgagcugaccgugcacgucaaguccagcgacccggacgugguggcggccagcaccucccucauggcccggaagcuggaguucgggacggacagcaccuucaaggccuucuccgccaugcccaagaccagccugugcuucuacaucgucgagcgcgaguacugcaaguccugcagcgaggacgacaccaagaagugcguggacacgaagcucgagcagccccaguccauccugaucgagcacaagggcaccaucaucgggaagcagaacgacaccugcaccgcgaaggccagcugcuggcuggaguccgugaagagcuucuucuacggccucaagaacaugcugggcuccgucuucgggaacuucuucaucggcauccugcucuuccuggcccccuucgugcugcuggugcucuucuucauguucggguggaagauccuguucugcuucaagugcugccgccggacgcgcggccuguucaaguaccggcaccucaaggacgacgaggagaccggguaccgccggaucaucgagcgccugaacaacaagaagggcaagaaccggcugcucgacggcgagcgccuggccgaccggaagaucgcggagcuguucagcaccaagacccacaucggguga

SEQ ID NO: 11964 - RNA, 5067 nt, Artificial Sequence
  derived and/or modified CDS sequence (opt1) from CCHFV(1-CR/HU-2015)__KU161584.1__GP
augcccaucaacaucaugcacacccugcucgugugcuucauccuguaccugcagcuccugggccucgggggcgcccacgagcagagcaacgccaccgaccacaaccgcacgaacaccaucaccgcgccguccaccagccagaaccccaagccgcccgccuccacgaccccgccccacacccccgagagcuccaccaucaagcugaucacgagcaccggggaggccgagggcuccggggagaccaccccgccccugaacacgacccagggccccuucccgcccgagaccaccagcgagcaccccgccuccacggccaccaacaccagcuccaccaacagcaugaacuccacgacccagaugaccgacaacacccugacgagcaccgucuccaccagccucuccaucagccccuccacccccagcacgagccagggcauccacuaccccgugcggucccugcugagcguguccagccccaagaccgcggccacccccacccccauguccacgcgcgagaugagcuccgagaccagcucccagcacagcgccaugucccggacccccaccuuccacacggccacccaggucagcaccgagaacgcgaaccgcuccaccccgcggcagagcgaguccagcgcccagcccgccacccagucccccaugacgagccccgcccaguccaucuuccucgugagcgccgcgccgaccaccauccagaacauccaccccagccccaccaaccgcuccaagcggaaccuggagauggagaucauccugacgcucccccaggggcugaagaaguacuacggcaagauccugaagcuccugcaccugacccucgaggaggacaccgaggggcugcuggaguggugcaagcgcaaccucggcagcaacugcgacgacgaguucuuccagaagcggaucgaggaguucuucaucaccggggagggcuacuucaacgaggugcugcaguucaagacgcuguccacccucagcccgaccgagcccucccacgcccggcccccgaccgccgagcccuucaagagcuacuucgccaagggcuuccuguccaucgacagcggguacuucuccgccaagugcuacccccgcagcuccacgagcggccugcagcucaucaacaucacccagcaccccgcgcgcaucgccgagaccccggggcccaagaccacgucccugaagaccaucaacugcaucaaccugcgggccagcgucuucaaggagcaccgcgagguggagaucaacgugcuccugccccagaucgccgucaaccuguccaacugccacguggugaucaacagccacgucugcgacuacucccucgacaccgacggccccgugcggcugccgcgcaucuaccacgagggcaccuucauccccgggacguacaagaucgugaucgacaagaagaacaagcugaacgaccggugcacccucgucaccaacugcgugaucaagggccgcgaggugcggaaggggcagagcguccugcgccaguacaagaccgagaucaagaucggcaaggccagcacggggucccggaagcugcucagcgaggagcccggcgacgacugcaucucccgcacccagcugcugcgcaccgagaccgcggagauccacgacgacaacuacggcgggcccggcgacaagaucacgaucugcaacgggagcaccaucguggaccagcggcucggcuccgagcuggggugcuacaccaucaaccgcgucaagagcuucaagcugugcgagaacuccgccaccggcaagacgugcgagaucgacagcaccccggugaagugccggcagggcuucugccucaagaucacccaggaggggcgcggccacgugaagcugucccgggggagcgaggugguccuggacgccugcgacuccagcugcgaggugaugauccccaagggcaccggggacauccuggucgacugcuccggcggccagcagcacuuccucaaggacaaccugaucgaccuggggugcccccacaucccccuccugggcaagauggccaucuacaucugccgcaugagcaaccacccgcggacgaccauggccuuccuguucugguucuccuucggguacgugaucacgugcaucuucugcaaggcccucuucuacagccugaucaucaucggcacccugggcaagaagaucaagcaguaccgcgagcucaagccccagaccugcaccaucugcgagaccgcccccgugaacgccaucgacgccgagaugcacgaccugaacugcuccuacaacaucugccccuacugcgcgagccggcugaccuccgacgggcucgcccgccacgucacccagugcccgaagcggaaggagaagguggaggagacggagcuguaccugaaccucgagcgcauccccuggaucgugcggaagcugcugcaggucagcgagagcaccggcguggcccucaagcgcuccagcuggcugaucgugcugcucguccugcugaccgugucccucagccccgugcaguccgcccccgucgggcacggcaagaccaucgagacguaccagacccgggagggguucaccagcaucugccuguucaugcugggcuccauccucuucaucgugagcugccuggugaagggccuggucgacuccgugagcgacuccuucuucccggggcucagcgugugccggaccugcuccaucggcagcaucaacggguucgagaucgagucccacaagugcuacugcagccuguucugcugccccuacugccggcacugcuccgccgaccgcgagauccaccagcugcaccucagcaucugcaagaagcggaagacgggcuccaacgucaugcuggcggugugcaagcgcaugugcuuccgcgccaccauggaggccagccggcgcgcccugcucauccggagcaucaucaacaccaccuucgugaucugcauccugacgcugaccaucugcgucguguccaccagcgccguggagauggagaaccuccccgcggggaccugggagcgcgaggaggaccugacgaacuucugccaccaggagugccaggucaccgagaccgagugccugugcccguacgaggcccucgugcugcggaagccccuguuccucgacuccaucgugaagggcaugaagaaccugcugaacagcaccucccucgagacgagccuguccaucgaggcccccuggggcgccaucaacguccagagcaccuucaagcccaccguguccaccgccaacaucgcgcugagcugguccagcguggagcaccgcgggaacaagauccucgucacgggccgguccgagagcaucaugaagcuggaggagcgcaccgggguguccugggaccugggcguggaggacgccagcgaguccaagcuccugaccgucagcaucauggaccugucccagauguacagcccgguguucgaguaccucagcggggaccgccagguggaggaguggcccaaggcgaccugcacgggcgacugccccgagcgcugcggcugcaccuccuccacgugccugcacaaggaguggccccacagccggaacuggcgcugcaacccgaccuggugcuggggcgucgggaccgggugcacgugcugcggcguggacgugaaggaccuguucaccgaccacauguucgucaaguggaagguggaguacaucaagaccgaggccaucgugugcgucgagcucaccagccaggagcggcagugcucccugaucgaggcggggacccgcuucaaccugggccccgugaccaucacccucagcgagccccggaacauccagcagaagcugcccccggagaucaucacccugcaccccaagaucgaggagggcuucuucgaccucaugcacgugcagaagguccuguccgccagcacggugugcaagcugcaguccugcacccacgggauccccggcgaccuccagguguaccacaucgggaaccugcugaagggcgaccgcgucaacggccaccucauccacaagaucgagccccacuucaacaccagcuggauguccugggacgggugcgaccuggacuacuacugcaacaugggcgacuggccgagcugcaccuacacgggggugacccagcacaaccacgccgccuucgugaaccugcucaacaucgagaccgacuacaccaagacguuccacuuccacuccaagcgggucaccgcccacggcgacacgccccagcuggaccugaaggcgcgccccaccuacggggccggcgagaucaccgugcucgucgagguggccgacauggagcugcacaccaagaagguggagaucagcggccugaaguucgccucccucgccugcaccgggugcuacgcgugcagcuccggcaucagcugcaagguccggauccacguggacgagcccgacgagcugaccgugcacgucaaguccagcgacccggacgugguggccgccagcacgucccugauggcccgcaagcucgaguucgggaccgacagcaccuucaaggccuucuccgcgaugcccaagaccagccugugcuucuacaucgucgagcgggaguacugcaaguccugcagcgaggacgacacgaagaagugcguggacaccaagcuggagcagccccaguccauccucaucgagcacaagggcaccaucaucgggaagcagaacgacacgugcaccgccaaggccagcugcuggcuggaguccgucaagagcuucuucuacggccugaagaacaugcucggcuccguguucgggaacuucuucaucggcauccugcuguuccucgcccccuucgugcugcuggugcuguucuucauguucggguggaagauccucuucugcuucaagugcugccgccgcacccggggccuguucaaguaccgccaccugaaggacgacgaggagaccggguaccggcgcaucaucgagcggcucaacaacaagaagggcaagaaccgccugcuggacggcgagcggcucgcggaccgcaagaucgccgagcuguucagcaccaagacgcacaucggguga

SEQ ID NO: 11965 - RNA, 5067 nt, Artificial Sequence
  derived and/or modified CDS sequence (opt1) from CCHFV(V42/81)__GU477490.1__GP
augcccaccaacaccaugcacacgcugcucgugugcuucauccuguaccugcagcuccugggccucgggggcgcccacguccagccgaacgccaccgagcacaaccgcaccaacaccacgaccgcgcccgggaccagccacucccucaagccccuggugagcaccacgcccccgcaggcccccgaguccagcaccaucaagcccaccacccccacguccgagaccgagggcagcggggaggccaccccgcuguccaacaccauccaggcccccagcucccccgagacgaccagcgagcggcccgccaccgcggugaucuccaccagcggcacggacuccaccaacagcaccacccagacgaccgacaacaacccgaccaccacggucggcaccucccccagcuccagccccuccacccccagcaccccgcaggggauccaccaccacgcccgcagccuccuguccgugacgagccccgagaccgugaccacccccaagcccacguccccgcgggagaugagcuccgagaccagcaaccagcacuccgccaugagccgcacccccacccaccacaccgucacccagguguccaccgagaacaccagccacuccacgccccggcagcccgagagcuccgcccagccgacgagcuccagccccaugaccucccccgcgcagagcacccugcucauguccgccgcccccaccgccgugcagagcauccacccgagccccacgaaccgcuccaagcggaaccuggagaccgagaucauccugacccucagccagggccugaagaaguacuacgggaagauccugaagcuccugcaccugacccucgaggaggacacggagggccugcuggaguggugcaagcgcaaccucggguccaacugcgacgacgacuucuuccagaagcggaucgaggaguucuucaugaccggcgagggcuacuucaacgagguccugcaguucaagacccccagcaccguguccccgacggagcccagccacgcccgccugcccaccgcggagcccuucaaguccuacuucgccaagggguuccucagcaucgacuccggcuacuucagcgccaagugcuacucccggagcuccaccagcgggcugcagcugaucaacgugacccagcacccggcccgcaucgccgagacgcccggccccaagaccaccucccucaagaccaucaacugcaucaaccugcgggcgagcgucuucaaggagaaccgcgagaucgagaucuccgugcugcucccccagaucgccgugaaccugagcaacugccacgucgugaucaacagccacgugugcgacuacucccuggacacggacggcccgguccggcucccccgcaucaaccacgaggggaccuucauccccggcaccuacaagaucgugaucgacaagaagaacaagcugaacgaccggugcacccuggugacgaacugcgucaucaaggggcgcgaggugcggaagggccagagcgugcuccgccaguacaagaccgagaucaagaucgggaaggccuccaccggcagccggaagcugcuguccaaggagcccggcgacgacugcaucagccgcacccagcucaugcgcacggagaccgccgagauccacgacgacaacuacgggggcccgggggacaagaucaccaucugcaacggcuccaccaucgucgaccagcggcuggggagcgagcugggcugcuacacgaucaaccgcgugaaguccuucaagcucugcgagaacagcgccaccggcaaggcgugcgaggucgacuccacccccgugaagugccggcagggguucugccugaagaucacccaggagggccgcgggcacgugaagcugagccggggcuccgaggucgugcucgacgccugcgacagcuccugcgaggugaugauccccaaggggaccggcgacauccuggucgacugcagcggcgggcagcagcacuuccugaaggacaaccugaucgaccucgagugcccccacaucccgcugcugggcaagcucgccaucuacaucugccgcauguccaaccacccccggacgaccauggccuuccuguucugguucggguucggcuacgugaucacgugcauccugugcaaggcccucuucuacagccugaucaucaucggcacccuggggaagaagaucaagcaguaccgcgagcucaagccccagaccugcaccaucugcgagaccgcgcccgugaacgccaucgacgccgagaugcacgaccugaacugcuccuacaacaucugcccguacugcgccagccggcugaccagcgacggccucgcgcgccacgucacgcagugccccaagcggaaggagaagguggaggagaccgagcuguaccugaaccucgagcgcauccccuggaucgugcggaagcugcugcaggucuccgagagcaccgggguggugcucaagcgcuccagcuggcugaucguccugcucgugcugcugaccgugucccucagccccguccaguccgccccggugggccacgggaagacgaucgagaccuaccagacccgggagggcuucaccagcaucugccuguucaugcugggcuccauccucuucaucgugagcugcaucgucaaggggcugguggacuccgugagcgacuccuucuuccccggccugagcgucugcaagacgugcuccaucagcuccaucaacggguucgagaucgagagccacaagugcuacugcucccucuucugcugccccuacugccgccacugcagcgccgaccgggagauccaccagcugcaccugagcaucugccgcaagcggcgcaccggcuccaacgugaugcucgccgugugcaagcgcaugugcuuccgggccaccaucgaggucagccgccgggcgcugcugauccgcuccaucaucaacaccacguucgugaucugcauccucacccugaccaucugcguggucagcaccuccgccguggagauggagaaccugccggccgggacgugggagcgggaggaggaccucaccaacuucugccaccaggagugccaggugaccgagaccgagugccugugccccuacgaggcccugguccuccgcaagccccuguuccuggacagcaucgugaagggcaagaagaaccuccugaacuccacgagccuggagaccucccucagcaucgaggcccccuggggcgcgaucaacauccaguccaccuucaagccgaccgugagcgccgccaacaucgcccuguccuggagcuccgucgagcaccgggggaacaagauccuggugagcggccgcuccgagagcaucaugaagcucgaggagcggacggggguguccuggaaccugggcgucgaggacgccagcgagagcaagcugcucaccguguccaucauggaccugagccagauguacucccccguguucgaguaccugagcggggaccgccaggucgaggaguggcccaaggcgaccugcaccggcgacugccccgagcggugcggcugcacguccagcacgugccuccacaaggaguggccgcacucccgcaacuggcggugcaaccccaccuggugcuggggcguggggaccgggugcacgugcugcggcguggacgucaaggaccuguucaucgaccacauguucgugaaguggaagguggaguacaucaagaccgaggccaucgucugcguggagcugaccagccaggagcgccagugcucccucaucgaggccgggacccgguucaaccugggccccgugaccaucacccugagcgagccccgcaacauccagcagaagcucccgcccgagaucaucacccugcaccccaagaucgaggagggcuucuucgaccugaugcacguccagaaggugcucuccgccagcaccgucugcaagcugcaguccugcacccacgggauccccggcgaccuccagguguaccacaucgggaaccugcugaagggcgaccgggugaacggccaccugauccacaagaucgagccgcacuucaacacgagcuggauguccugggacgggugcgaccucgacuacuacugcaacaugggcgacuggcccagcugcaccuacaccggggucacccagcacaaccacgcggccuucgugaaccugcugaacaucgagacggacuacaccaagaccuuccacuuccacuccaagcgcgugaccgcccacggcgagacgccccagcucgaccugaaggcccggcccgccuacggggcgggcgagaucaccguccugguggagguggccgacauggagcuccacaccaagaaggucgagaucagcggccugaaguucgccucccuggccugcaccgggugcuacgccugcagcagcggcaucuccugcaaggugcgcauccacguggacgagccggacgagcucacgguccacgucaagagcaacgaccccgacgugguggcggccuccaccagccugauggcccggaagcuggaguccgggaccgacagcaccuucaaggccuucuccgccaugcccaagacgagccucugcuucuacaucguggagcgcgaguacugcaaguccugcagcgaggacgacacccagaagugcguggagaccaagcuggagcagccccaguccauccugaucgagcacaagggcaccaucaucgggaagcagaacgacacgugcaccgcgaaggccagcugcuggcucgaguccgucaagagcuucuucuacggccugaagaacaugcugggcuccguguucgggaacuucuucaucggcauccuccuguuccuggccccguucgugcuccugguccuguucuucauguucggguggaagauccuguucugcuucaagugcugccgccggacccgcggccucuucaaguaccggcaccugaaggaggacgaggagaccggguaccgccggaucaucgagcgccugaacagcaagaagggcaagaaccggcuccuggacggcgagcgccuggccgaccggaagaucgcggagcuguucuccacgaagacccacaucggguga

SEQ ID NO: 11966 - RNA, 5067 nt, Artificial Sequence
  derived and/or modified CDS sequence (opt1) from CCHFV(ROS/HUVLV-100)__DQ206448.1__GP
augcccaccaacaucaugcacacccugcucgugugcuucauccuguaccugcagcuccugggccucgggggcgcccaccgccagagcaacgccacggagcacaacgggaccaacaccaccacggcgccguccaccagccagucccccaagccccuggucagcaccgcgcccccgcacgcccuggaguccagcaccaucaagcccacgacccccguguccgagaccgagggcagcggggagaccacgcccccgcccaacaccacccagggccccuccccgcccgaggccacccccgagcggcccacgaccaccgccaccagcacgcccuccaccgacaacaccaacagcaccacgcacgugaccgacaacaacccgaccuccaccaucagcacgucccccagcuccagccccuccacccccagcaccccgcagggcauccaccaccccgcccgcaaccugcucagcgucuccagccccaagaccgccacgacccccaccccgaccucccccggggagaucagcuccgagacgagcucccugcacagcgccaugucccggaccagcacccuguacaccgccacccagguguccacggagaacgcgaaccacagcgcgccccgccaguccgagagcuccgcccagcagaccaccaccagccccaugacguccccggcccagagcauccucgugauguccgccgcccccaccgccauccagaacauccaccccagcccgaccaaccggagcaagcgcaaccuggagauggagaucauccugacccucucccagggccugaagaaguacuacgggaagauccugaagcuccugcaccugacgcucgaggaggacaccgagggccugcuggaguggugcaagcggaaccucgggagcaacugcgacgacgacuucuuccagaagcgcaucgaggaguucuucaugaccggcgagggcuacuucaacgagguccugcaguucaagacccuguccacgcucagccccaccgagcccucccacgcccggcccccgaccguggagcccuucaagagcuacuucgccaagggguuccuguccaucgacagcggcuacuucuccgccaagugcuacccccgccugagcaccuccgggcuccagcugaucaacgugacgcagcaccccgcgcggaucgccgagaccccgggccccaagaccaccagccugaagacgaucaacugcaucaaccuccgcgccuccgucuucaaggagcaccgggagaucgagaucaacgugcugcugccccagaucgccgugaaccucagcaacugccacgucgugaucaacucccacgugugcgacuacagccuggacaccgacggccccguccgccugccgcacaucuaccacgaggggaccuucauccccggcaccuacaagaucgugaucgacaagaagaacaagcucaacgaccggugcacgcuggugaccaacugcgucaucaaggggcgcgaggugcggaagggccaguccgugcugcgccaguacaagaccgagaucaagaucgggaaggccagcaccggcagccggaagcuccuguccgaggagcccggcgacgacugcaucagccgcacgcagcugcuccggaccgagaccgcggagauccacgacgacaacuacgggggccccggggacaagaucaccaucugcaacggcuccacgaucgucgaccagcgccuggggagcgagcugggcugcuacaccaucaaccgcgugaaguccuucaagcucugcgagaacagcgccaccggcaagaccugcgagaucgacuccacgccggugaagugccggcagggguucugccugaagaucacccaggagggccgcgggcacgucaagcugagccggggcuccgaggugguccuggacgccugcgacagcuccugcgaggugaugauccccaaggggaccggcgacauccucguggacugcagcggcgggcagcagcacuuccugaaggacaaccugaucgaccucggcugcccccacaucccccugcuggggaagauggccaucuacaucugccgcauguccaaccacccgcggaccaccauggccuuccucuucugguucagcuucggcuacgucaucacgugcaucuucugcaaggcgcuguucuacucccugaucaucaucggcacccucgggaagaagaucaagcaguaccgcgagcugaagccccagaccugcaccaucugcgagacggcccccgugaacgccaucgacgccgagaugcacgaccugaacugcagcuacaacaucugccccuacugcgcgucccggcucaccagcgacggccuggcccgccacgugccgcagugccccaagcggaaggagaaggucgaggagaccgagcuguaccucaaccuggagcgcauccccuggaucgugcggaagcugcuccagguguccgagagcaccggggucgcccugaagcgcagcuccuggcugaucgugcuccuggugcugcucacggucagccuguccccggugcagagcgcccccgugggccacgggaagaccaucgagaccuaccagacccgggagggcuucacguccaucugccuguucaugcucggcagcauccuguuccuggucuccugccucgugaaggggcugguggacagcgucuccgacagcuucuuccccggccuguccgugugcaagaccugcagcaucggguccaucaacggcuucgagaucgagagccacaagugcuacugcucccucuucugcugccccuacugccgccacugcagcgccgaccgggagauccaccagcugcaccuguccaucugcaagaagcgcaagaccgggagcaacgugaugcucgcggucugcaagcggaugugcuuccgcgccaccaucgaggccucccggcgcgcccugcugauccgcagcaucaucaacacgaccuucgugaucugcauccucacccugaccaucugcguggucagcacguccgccguggagauggagaaccugccgagcggcaccugggagcgggaggaggaccucaccaacuucugccaccaggagugccaggugaccgagacggagugccugugccccuacgaggcgcugguccuccgcaagccccuguuccuggacuccaucgugaagggcaugaagaaccuccugaacagcaccucccuggagaccagccucuccaucgaggcccccuggggcgccaucaacgugcagagcaccuucaagccgacggucuccaccgccaacaucgcccugagcugguccagcguggagcaccgggggaacaagauccuggugaccgggcgcuccgagagcaucaugaagcucgaggagcggaccggcgucuccugggaccuggggguggaggacgcgagcgaguccaagcugcucacggugagcaucauggaccugucccagauguacagccccgucuucgaguaccugagcggcgaccgccagguggaggaguggcccaaggcgaccugcaccggcgacugccccgagcggugcgggugcaccuccagcacgugccuccacaaggaguggccgcacucccgcaacuggcggugcaaccccaccuggugcuggggcguggggaccggcugcacgugcugcggggucgacgugaaggaccuguucaccgaccacauguucgugaaguggaaggucgaguacaucaagaccgaggccaucgugugcguggagcugaccagccaggagcgccagugcucccucaucgaggccggcacccgguucaaccugggccccgucaccaucacgcugagcgagccccgcaacauccagcagaagcucccgcccgagaucaucacccugcaccccaagguggaggagggguucuucgaccugaugcacgugcagaagguccucuccgccagcaccgugugcaagcugcaguccugcacccacggcauccccggggaccuccagguguaccacaucggcaaccugcugaagggcgaccgggucaacgggcaccugauccacaagaucgagccgcacuucaacacgagcuggauguccugggacggcugcgaccucgacuacuacugcaacaugggggacuggcccagcugcaccuacaccggcgugacccagcacaaccacgccgccuucgucaaccugcugaacaucgagacggacuacaccaagaccuuccacuuccacuccaagcgcgugaccgcccacggggacacgccccagcucgaccugaaggcccggcccaccuacggcgcgggcgagaucaccgugcuggucgagguggccgacauggagcuccacaccaagaagguggagaucagcgggcugaaguucgccucccuggccugcacgggcugcuacgccugcagcuccgggaucagcugcaagguccgcauccacguggacgagccggacgagcucaccgugcacgucaaguccagcgaccccgacgugguggcggccagcaccucccugauggcccggaagcuggaguucggcaccgacagcacguucaaggccuucuccgccaugcccaagaccagccucugcuucuacaucgucgagcgcgaguacugcaaguccugcagcgaggaggacacccagaagugcguggacaccaagcuggagcagccccaguccauccugaucgagcacaaggggacgaucaucggcaagcagaacgacacgugcaccgcgaaggccagcugcuggcucgaguccgucaagagcuucuucuacggccugaagaacaugcugggguccguguucggcaacuucuucaucgggauccuccuguuccuggccccguucgugcugcucgugcuguucuucauguucggcuggaagauccuguucugcuucaagugcugccggcgcacccgggggcuccugaaguaccgccugcucaaggacgacgaggagaccggcuaccgccggaucaucgagcgccugaacaacaagaagggcaagaaccggcugcucgacggggagcgccuggccgaccggaagaucgcggagcuguucagcaccaagacccacaucggcuga

SEQ ID NO: 11967 - RNA, 5067 nt, Artificial Sequence
  derived and/or modified CDS sequence (opt1) from CCHFV(5180-R-2011)__KR814874.1__GP
augcccaccaacaucaugcacacccugcucgugugcuucauccuguaccugcagcuccugggccucgggggcgcccaccgccagagcaacgccacggagcacaacgggaccaacaccaccacggcgccguccaccagccagucccccaagccgcccgucagcaccgccccgcccuacgcccccgaguccagcaccaucaagcccacgacccccgccuccgagaccgagggcagcggggagaccacgcccccgcccaacaccacccagggccccuccccgcccgaggccacccccgagcggcccgcgacgaccgccaccagcacccccuccacggacaacaccaacagcaccacccacgccacggacaacaaccccaccuccaccaucagcaccucccccagcuccagcccguccacgcccagcacgccccagggcauccaccaccccgcccgcaaccugcugagcguguccagcccgaagaccgcgaccacccccacccccaccucccccggggacaucagcuccgagaccagcucccugcacagcgccaugucccggacgccgacccuccacaccgccacccaggccagcaccgagaacgccaaccacuccgcgccccgccagagcgaguccagcgcccagcagacgaccaccucccccaugaccagcccggcccagcccauccuggugauguccgccgcccccacggcgauccagaacauccaccccagcccgaccaaccgguccaagcgcaaccuggagauggagaucauccucacccugagccagggccugaagaaguacuacgggaagauccucaagcugcugcaccucacccuggaggaggacacggagggccugcucgaguggugcaagcggaaccuggggagcaacugcgacgacgacuucuuccagaagcgcaucgaggaguucuucaugaccggcgagggcuacuucaacgagguccugcaguucaagacccucuccacccugagccccacggagcccucccacgcccggcccccgaccguggagcccuucaagagcuacuucgccaagggguuccuguccaucgacagcggcuacuucuccgccaagugcuacccccgccucagcaccuccgggcugcagcugaucaacgugacccagcaccccgcccggaucgcggagacgccgggccccaagaccaccagccucaagaccaucaacugcaucaaccugcgcgccuccgucuucaaggagcaccgggagaucgagaucaacgugcugcucccccagaucgccgugaaccugagcaacugccacgucgugaucaacucccacgugugcgacuacagccuggacacggacggccccguccgccucccgcacaucuaccacgaggggaccuucauccccggcaccuacaagaucgugaucgacaagaagaacaagcugaacgaccggugcacccuggugacgaacugcgucaucaaggggcgcgagauccggaagggccaguccgugcuccgccaguacaagaccgagaucaagaucgggaaggccagcaccggcucccggaagcugcugagcgaggagcccggcgacgacugcaucagccgcacccagcuccugcggacggagaccgccgagauccacgacgacaacuacgggggccccggggacaagaucaccaucugcaacggcuccaccaucguggaccagcgccuggggagcgagcucggcugcuacacgaucaaccgcgucaaguccuucaagcugugcgagaacagcgcgaccggcaagaccugcgagaucgacuccaccccggugaagugccggcagggguucugccugaagaucacgcaggagggccgcgggcacgugaagcucagccggggcuccgaggucgugcuggacgccugcgacaccagcugcgaggugaugauccccaaggggaccggcgacauccuggucgacugcuccggcgggcagcagcacuuccugaaggacaaccucaucgaccugggcugcccccacaucccccugcucgggaagauggccaucuacaucugccgcaugagcaaccacccgcggaccaccauggccuuccuguucugguucuccuucggcuacgugaucacgugcaucuucugcaaggcgcuguucuacagccucaucaucaucggcacccuggggaagaagaucaagcaguaccgcgagcugaagccccagaccugcaccaucugcgagacggcccccgucaacgccaucgacgccgagaugcacgaccucaacugcuccuacaacaucugcccguacugcgccagccggcugaccuccgacggccuggcgcgccacgugccccagugccccaagcggaaggagaagguggaggagaccgagcucuaccugaaccuggagcgcauccccuggaucguccggaagcuccuccaggugagcgaguccaccgggguggcccugaagcgcagcuccuggcucaucguccugcuggugcuccugacggugagccugagcccgguccaguccgcccccgugggccacgggaagaccaucgagaccuaccagacccgggagggcuucacgagcgugugccucuucaugcugggcuccauccuguuccucgucagcugccuggugaaggggcugguggacuccgucagcgacuccuucuuccccggccucagcgugugcaagaccugcuccaucgggagcaucaacggcuucgagaucgagucccacaagugcuacugcagccuguucugcugccccuacugccgccacugcuccgccgaccgggagauccaccagcugcaccucagcaucugcaagaagcgcaagaugggguccaacgugaugcuggccgucugcaagcggaugugcuuccgcgcgaccaucgaggccagccggcgcgcccugcucauccgcuccaucaucaacaccacguucgugaucugcauccugacccugaccaucugcguggucagcaccuccgccguggagauggagaaccucccgagcggcacgugggagcgggaggaggaccugaccaacuucugccaccaggagugccaggugaccgagaccgagugccugugccccuacgaggcccucguccugcgcaagccccuguuccucgacagcaucgugaagggcaugaagaaccugcugaacuccacgagccucgagaccucccugagcaucgaggcgcccuggggcgccaucaacgugcaguccaccuucaagccgaccgucagcacggccaacaucgcccuguccuggagcuccguggagcaccgggggaacaagauccucgugaccgggcgcagcgaguccaucaugaagcuggaggagcggaccggcgucagcugggaccuggggguggaggacgcguccgagagcaagcuccugaccguguccaucauggaccugagccagauguacucccccgucuucgaguaccucagcggcgaccgccagguggaggaguggcccaaggccacgugcaccggcgacugccccgagcggugcgggugcaccuccuccacgugccugcacaaggaguggccgcacagccgcaacuggcggugcaaccccaccuggugcuggggcguggggaccggcugcacgugcugcggggucgacgugaaggaccuguucaccgaccacauguucgugaaguggaaggucgaguacaucaagaccgaggccaucgugugcguggagcucaccagccaggagcgccagugcagccugaucgaggccggcacccgguucaaccugggccccgucaccaucacccucuccgagccccgcaacauccagcagaagcugccgcccgagaucaucacgcugcaccccaagguggaggagggguucuucgaccucaugcacgugcagaagguccugagcgccuccaccgugugcaagcugcagagcugcacccacggcauccccggggaccuccagguguaccacaucggcaaccugcugaagggcgaccgggucaacgggcaccucauccacaagaucgagccgcacuucaacaccuccuggaugagcugggacggcugcgaccuggacuacuacugcaacaugggggacuggcccuccugcacguacaccggcgugacccagcacaaccacgcggccuucgugaaccugcucaacaucgagaccgacuacacgaagaccuuccacuuccacagcaagcgcgucaccgcccacggggacacgccccagcuggaccugaaggcccggcccaccuacggcgccggcgagaucaccgugcucgucgagguggcggacauggagcugcacaccaagaagguggagaucuccgggcugaaguucgccagccucgccugcaccggcugcuacgccugcuccagcgggaucuccugcaagguccgcauccacguggacgagccggacgagcugacggugcacgucaagagcaacgaccccgacgugguggccgcguccaccagccugauggcccggaagcucgaguucggcaccgacuccaccuucaaggccuucagcgccaugcccaagacgagccugugcuucuacaucgucgagcgcgaguacugcaaguccugcagcgaggaggacacccagaagugcguggacaccaagcuggagcagccgcaguccauccucaucgagcacaaggggaccaucaucggcaagcagaacgacacgugcaccgcgaaggccagcugcuggcuggaguccgucaagagcuucuucuacggccugaagaacaugcucggguccguguucggcaacuucuucaucgggauccugcuguuccucgcccccuucgugcugcuggugcuguucuucauguucggcuggaagauccucuucugcuucaagugcugccggcgcacccgggggcugcugaaguaccgccuccugaaggacgacgaggagaccggcuaccgccggaucaucgagcgccugaacaacaagaagggcaagaaccggcuccuggacggggagcgccuggccgaccggaagaucgccgagcuguucagcacgaagacccacaucggcuga

SEQ ID NO: 11968 - RNA, 5067 nt, Artificial Sequence
  derived and/or modified CDS sequence (opt1) from CCHFV(5170-R-2011)__KR814873.1__GP
augcccuucaacaucaugcacacccugcucgugugcuucauccuguaccugcagcucagcggccuggggggcgcccacgggcaguccaacgagaccgagcacaacggcacgaacaccaccaccgucccggggacgagccagucccccaagccccccgccagcaccacccugcagcacaccccggaguccagcacggugaagcucaccacccccaccuccgagacggagggcagcggcgagaccaccccccccccgaacaccacgcaggggcugcccccccccggcaccaccccggagcgcuccgcgaccacggccaccagcaccuccagcaccgacaacaugaacuccacgacccaggugaccgacaacacccccacgagcaccgucuccaucagccccuccagcucccccagcaugccgagcaccucccaggggauccacuaccccauccggagccugcucuccgugagcucccccaagaccgugacgacccccaccccgaucagccccggcgagaugucccccgagaccagcucccagcacagcgccaugucccgcauccccacgcuguacaccgccacccaggucagcaccgagaacaccaaccgguccacgccgcgccagagcgaguccagcgugcagcccgccacccagucccccaucaccagccccgcgcagaccauccugcucauguccgccgccccgaaggccauccaggacaugcaccccagccccacgaaccggagcaagcgcaaccuggagguggagaucauccugacccucucccaggggcugaagaaguacuacggcaagauccugaagcuccugcaccugacccucgaggaggacaccgagggccugcuggaguggugcaagcggaaccucgggagcaacugcgacgacgacuucuuccagaagcgcaucgaggaguucuucaucacgggcgagggguacuucaacgagguccugcaguucaagacccuguccacccucagcccgaccgagcugucccacgugcggcugcccacggcggagcccuucaagagcuacuucgccaagggcuuccucuccaucgacagcggcuacuucuccgccaagugcuacccccgcagcuccaccagcgggcugcagcugaucaacgugacccagcacccggcccggaucgccgagacccccggccccaagacgaccucccucaagaccaucaacugcaucaaccugcgcgcgagcgucuucaaggagcaccgggagguggagaucaacgugcugcucccccagaucgccgucaaccuguccaacugccacguggugaucaacagccacgucugcgacuacucccuggacaccgacgggccggugcgccucccccggauccaccacgagggcacguucauccccgggaccuacaagaucgugaucgacaagaagaacaagcugaacgaccgcugcagccuggucaccaacugcgugaucaagggccgggaggugcgcaagggccagagcguccuccggcaguacaagaccgagaucaagaucgggaaggccuccacgggcagccgcaagcugcuguccgaggagcccggggacgacugcaucagccggacccagcuccugaagaccgagaccgccgagauccacgacgacaacuacggcgggccgggcgacaagaucacgaucugcaacggcuccaccaucguggaccagcgccuggggagcgagcucggcugcuacaccaucaaccgcgucaaguccuucaagcugugcgagaacagcgccaccgggaagacgugcgagaucgacuccacccccgugaagugccggcagggcuucugccugaagaucacccaggaggggcgcggccacgugaagcugagccggggcuccgaggucgugcucgacgugugcgacagcuccugcgagaucaugauccccaaggggaccggcgacauccuggucgacugcagcgggggccagcagcacuuccugaaggacaaccucaucgaccugggcugcccccacaucccgcugcucgggaagauggcgaucuacaucugccgcauguccaaccacccccggacgaccauggccuuccuguucugguucagcuucggcuacgugaucaccugcaucuucugcaaggcccuguucuacucccucaucaucaucgggacccugggcaagaagaucaagcaguaccgcgagcugaagccccagaccugcacgaucugcgagaccgcccccgugaacgccaucgacgcggagaugcacgaccucaacugcagcuacaacaucugcccguacugcgccucccggcugaccagcgaggggcuggcccgccacgucacccagugccccaagcggaaggagaagguggaggagacggagcucuaccugaaccuggagcgcauccccuggaucgugcggaagcuccugcaggucagcgaguccaccggcguggcccugaagcgcagcuccuggcucaucgugcugcugguccuccugaccgugagccugucccccgugcagagcgccccggucggccacgggaagaccaucgagacguaccagacccgggagggcuucaccuccaucugccucuucaugcuggggagcauccuguucaucguguccugccucgugaagggccuggucgacagcguguccgacagcuucuuccccgggcuguccgugugcaagaccugcagcaucggcuccaucaacggcuucgagaucgagagccacaagugcuacugcucccucuucugcugccccuacugccgccacugcagcgcggaccgggagauccaccagcugcaccuguccaucugcaagaagcgcaagacggggagcaacgucaugcucgccgugugcaagcggaugugcuucaaggccaccaucgaggccagccgccgggcgcugcugauccgcuccaucaucaacaccaccuucgugaucugcauccucacgcuggccaucugcgucgugagcaccuccgccguggagauggaggaccugccggccggcaccugggagcgcgaggaggaccucaccaacuucugccaccaggagugccaggucacggagaccgagugccugugccccuacgaggcccuggugcuccggaagccccuguuccuggacagcaucgugaaggggaugaagaaccuccugaacuccaccagccuggagaccucccucagcaucgaggcgcccuggggcgccaucaacguccaguccacguucaagccgaccgugagcaccgccaacaucgcccuguccuggagcuccguggagcaccgcgggaacaagauccuggucaccggccggagcgaguccaucaugaagcucgaggagcgcacgggcgugagcugggaccuggggguggaggacgccuccgagagcaagcugcucaccgucuccaucauggaccugagccagauguacagccccguguucgaguaccuguccggcgaccggcagguggaggaguggcccaaggcgaccugcaccggggacugccccgagcgcugcggcugcacgagcuccaccugccuccacaaggaguggccgcacagccggaacuggcgcugcaaccccaccuggugcuggggggucggcaccggcugcacgugcugcgggguggacgugaaggaccuguucaccgaccacauguucaucaaguggaaggucgaguacaucaagaccgaggccaucgugugcguggagcugaccucccaggagcggcagugcagccucaucgaggccggcacccgcuucaaccuggggcccgucacgaucacccuguccgagccccggaacauccagcagaagcucccgcccgagaucaucacccugcaccccaagaucgaggagggcuucuucgaccugaugcacgugcagaaggugcucagcgccuccaccgucugcaagcugcagagcugcacgcacggcauccccggggaccugcagaucuaccacaucggcaaccuccugaagggggaccgcgugaacggccaccugauccacaagaucgagccgcacuucaacaccuccuggaugagcugggacgggugcgaccucgacuacuacugcaacaugggcgacuggcccuccugcaccuacaccggcgucacgcagcacaaccacgccgcguucgugaaccugcugaacaucgagaccgacuacaccaagaccuuccacuuccacagcaagcgggugacggcccacggggacaccccccagcucgaccugaaggcccgccccaccuacggcgccggggagaucaccguccugguggagguggcggacauggagcuccacacgaagaaggucgagaucuccggccugaaguucgccagccugaccugcaccgggugcuacgccugcuccagcggcaucuccugcaaggugcggauccacguggacgagccggacgagcucaccguccacgugaagagcagcgaccccgacguggucgccgccuccacgagccugauggcgcgcaagcuggaguucggcaccgacuccaccuucaaggccuucagcgccaugcccaagaccucccucugcuucuacaucguggagcgggaguacugcaagagcugcuccgaggacgacacgaagaagugcguggacaccaagcuggagcagccccagagcauccugaucgagcacaaggggaccaucaucggcaagcagaacgacaccugcacggccaaggccuccugcuggcucgagagcgucaaguccuucuucuacgggcugaagaacaugcugggcagcguguucggguccuucuucgugggcauccuccuguuccuggcgccguucguccugcucgugcuguucuucauguucggcuggaagauccuguucugcuucaagugcugccgccggacccgcgggcucuucaaguaccggcaccugaaggacgacgaggagaccggcuaccgccgcaucaucgagcggcugaacagcaagaaggggaagaaccgccuccuggacggcgagcggcuggccgaccgcaagaucgccgagcucuucuccaccaagacgcacaucggcuga

SEQ ID NO: 11969 - RNA, 5067 nt, Artificial Sequence
  derived and/or modified CDS sequence (opt1) from CCHFV(4701-ST-2009)__KR814872.1__GP
augcccaucaacaucaugcacacccugcucgugugcuucauccuguaccugcagcucagcggccucgggggcgcccacgggcaguccaacgccaccgagcacaacggcacgaacaccaccaccgcgccggggacgagccagucccccaagccgcccgccagcaccacccugccccacacccccgaguccagcacggucaagcucaccacccccaccuccgagacggagggcagcggcgagaccacgcccccgcccaacaccacccaggggcugccccugaccggcaccacccccgagcgcuccgccacgaccgccaccagcaccuccagcacggacaacaugaacuccaccacccaggugaccgacaacacgccgaccagcaccguguccaucagccccuccagcuccagcagcaugcccuccacgccccaggggacccaccacccgguccggagccuccuguccgugagcucccccaagaccgugaccacccccacgcccaugagcccgggcgagaugucccccgagaccagcucccagcacagcgccaugucccgcguccccacccuguacaccgcgacccaggugagcacggagaacaccgaccgguccacgccccgccagagcgaguccagcgugcagccggccacccagucccccaucaccagccccgcccagaccauccuccugauguccgccgcgcccaaggccauccaggacaugcacccgagccccaccaaccggagcaagcgcaaccuggaggucgagaucauccucacccugucccaggggcugaagaaguacuacggcaagauccucaagcugcugcaccucacgcuggaggaggacaccgagggccugcucgaguggugcaagcggaaccuggggagcaacugcgacgacgacuucuuccagaagcgcaucgaggaguucuucaucaccggcgagggguacuucaacgaggugcugcaguucaagacccucuccacgcugagccccaccgagccgucccacgugcggcugcccaccgccgagcccuucaagagcuacuucgccaagggcuuccucuccaucgacagcggcuacuucuccgccaagugcuacccccgcagcuccaccagcgggcugcagcugaucaacgucacgcagcacccggcgcggaucgccgagacccccggccccaagaccaccucccucaagacgaucaacugcaucaaccugcgcgccagcguguucaaggagcaccgggagguggagaucaacguccugcucccccagaucgccgugaaccuguccaacugccacguggucaucaacagccacgugugcgacuacucccuggacaccgacgggccggugcgccucccccggauccaccacgagggcaccuucauccccgggaccuacaagaucgucaucgaccgcaagaacaagcugaacgaccggugcagccuggugacgaacugcgugaucaagggccgcgagguccggaagggccagagcgugcuccgccaguacaagaccgagaucaagaucgggaaggccuccaccggcagccggaagcugcuguccgaggagcccggggacgacugcaucagccgcacccagcuccugaagacggagaccgcggagauccacgacgacaacuacggcgggccgggcgacaagaucaccaucugcaacggcuccaccgucguggaccagcgccuggggagcgagcucggcugcuacacgaucaaccgggugaaguccuucaagcugugcgagaacagcgccaccgggaagaccugcgagaucgacuccacccccgucaagugccgccagggcuucugccugaagaucacgcaggaggggcggggccacgugaagcugagccgcggcuccgaggugguccucgacgccugcgacagcuccugcgagaucaugauccccaaggggaccggcgacauccugguggacugcagcgggggccagcagcacuuccugaaggacaaccucaucgaccugggcugcccccacaucccgcugcucgggaagauggccaucuacaucugccggauguccaaccacccccgcaccaccauggccuuccuguucugguucagcuucggcuacgugaucacgugcaucuucugcaaggcgcuguucuacucccucaucaucaucgggacccugggcaagaagaucaagcaguaccgggagcugaagccccagaccugcaccaucugcgagaccgcccccgucaacgccaucgacgccgagaugcacgaccucaacugcagcuacaacaucugcccguacugcgccucccgccugacgagcgacgggcuggcgcggcacgugacccagugccccaagcgcaaggagaagguggaggagaccgagcucuaccugaaccuggagcggauccccuggaucguccgcaagcuccuccaggugagcgaguccaccggcguggcccugaagcggagcuccuggcugaucguccugcuggugcuccugacggugagccugucccccguccagagcgccccggugggccacgggaagaccaucgagaccuaccagacccgcgagggcuucacguccaucugccucuucaugcuggggagcauccuguucaucguguccugccucgucaagggccugguggacagcguguccgacagcuucuuccccgggcuguccgucugcaagaccugcagcaucggcuccaucaacggcuucgagaucgagagccacaagugcuacugcucccucuucugcugccccuacugccggcacugcagcgccgaccgcgagauccaccagcugcaccuguccaucugcaagaagcggaagaccgggagcaacgugaugcucgcggugugcaagcgcaugugcuucaaggccaccaucgaggccagccggcgcgcccugcugauccgcuccaucaucaacacgaccuucgucaugugcauccucacccuggccaucugcguggugagcaccuccgcggucgagauggaggaccugccggccggcacgugggagcgggaggaggaccucaccaacuucugccaccaggagugccaggugaccgagaccgagugccugugccccuacgaggcccuggugcuccgcaagccccuguuccuggacagcaucgucaaggggaugaagaaccuccugaacuccacgagccuggagaccucccucagcaucgaggcccccuggggcgccaucaacgugcaguccaccuucaagccgaccgugagcacggcgaacaucgcccuguccuggagcuccgucgagcaccgggggaacaagauccuggugaccggccgcagcgaguccaucaugaagcucgaggagcggaccggcgugagcugggaccugggggucgaggacgccuccgagagcaagcugcucaccguguccaucauggaccugagccagauguacagccccguguucgaguaccuguccggcgaccgccaggucgaggaguggcccaaggccacgugcaccggggacugccccgagcggugcggcugcaccagcuccacgugccuccacaaggaguggccgcacagccgcaacuggcggugcaaccccaccuggugcuggggcguggggaccggcugcacgugcugcgggguggacgucaaggaccuguucaccgaccacauguucaucaaguggaagguggaguacaucaagaccgaggccaucgugugcgucgagcugaccucccaggagcgccagugcagccucaucgaggcgggcacccgguucaaccuggggcccgugaccaucacccuguccgagccccgcaacauccagcagaagcucccgcccgagaucaucacgcugcaccccaagaucgaggagggcuucuucgaccugaugcacgugcagaagguccucagcgccuccaccgugugcaagcugcagagcugcacccacggcauccccggggaccugcagaucuaccacaucggcaaccuccugaagggggaccgggucaacggccaccugauccacaagaucgagccgcacuucaacaccuccuggaugagcugggacgggugcgaccucgacuacuacugcaacaugggcgacuggcccuccugcacguacaccggcgugacccagcacaaccacgccgccuucgugaaccugcugaacaucgagaccgacuacacgaagaccuuccacuuccacagcaagcgcgucaccgcgcacggggacacgccccagcucgaccugaaggcccggcccaccuacggcgccggggagaucaccgugcugguggaggucgccgacauggagcuccacaccaagaagguggagaucuccggccugaaguucgccagccugaccugcacggggugcuacgcgugcuccagcggcaucuccugcaaggugcgcauccacgucgacgagccggacgagcucaccgugcacgucaagagcagcgaccccgacgugguggccgccuccaccagccugauggcccggaagcuggaguucggcaccgacuccacguucaaggccuucagcgcgaugcccaagaccucccucugcuucuacaucguggagcgcgaguacugcaagagcugcuccgaggacgacaccaagaagugcgucgacaccaagcuggagcagccccagagcauccugaucgagcacaaggggacgaucaucggcaagcagaacgacacgugcaccgccaaggccuccugcuggcucgagagcgugaaguccuucuucuacgggcugaagaacaugcugggcagcguguucgggggcuucuucgucggcauccuccuguuccuggccccguucgugcugcucgugcuguucuucauguucggguggaagauccuguucugcuucaagugcugccggcgcacccggggccucuucaaguaccgccaccugaaggacgacgaggagaccggguaccgccggaucaucgagcgccugaacuccaagaagggcaagaaccggcuccuggacggcgagcgccuggccgaccggaagaucgcggagcuguucagcaccaagacccacaucggguga

SEQ ID NO: 11970 - RNA, 5067 nt, Artificial Sequence
  derived and/or modified CDS sequence (opt1) from CCHFV(4574-ST-2008)__KR814870.1__GP
augcccaccaacaucaugcacacccugcucgugugcuucauccuguaccugcagcuccugggcccggggggcgcccacgggcagcccaacgccacggagcacaaccgcaccaacaccaccacggcgcccagcaccucccagagccccaagccgcccgucuccaccgcccccccccacgcccuggagagcccgaccaucaaguccacgacccccaccagcgagaccgagggcuccggggagacgaccagcccccccaacaccacccagggcccgucccuccccgagacgacccccaagcggcccgccaccaccgccacgagcaccccguccaccgacaacaccaacagcacgacccacgugaccgacaacaaccccaccuccacgaucagcaccucccccagcuccagccccuccaccccgagcaccccccgcggcauccaccaccccgcgcggaaccugcugagcguguccagccccaagacggccaccaccccgacccccacgucccccggggagaucagcuccgagaccagcucccuccacagcgccaugucccgcaccagcacccuguacaccgccacgcaggcguccaccgagaacgccaaccacagcgccccccggcaguccgagagcccggcccagcccaccaccacgucccugaugaccagccccgcccaguccauccucgucaugagcgcggccccgaccgccauccagaacauccaccccucccccaccaaccgcagcaagcggaaccuggagauggagaucauccugacgcucagccagggccugaagaaguacuacgggaagauccugaagcuccugcaccugacccucgaggaggacaccgagggccugcuggaguggugcaagcgcaaccucggguccaacugcgaggacgacuucuuccagaagcggaucgaggaguucuucaugaccggcgagggcuacuucaacgaggugcugcaguucaagacgcugagcacccucucccccaccgagccgagccacgcccgcccccccaccguggagcccuucaaguccuacuucgccaagggguuccugagcaucgacuccggcuacuucagcgcgaagugcuacccgcgguccagcacguccgggcugcagcucaucaacgucacccagcaccccgcccgcaucgccgagacccccggccccaagaccacgagccugaagaccaucaacugcaucaaccugcgggccuccguguucaaggagcaccgcgagaucgagaucaacgugcuccugccgcagaucgccgucaaccugagcaacugccacguggugaucaacucccacgucugcgacuacagccucgacaccgacggccccgugcggcugccccacaucuaccacgaggggaccuucauccccggcacguacaagaucgugaucgacaagaagaacaagcugaacgaccgcugcacccucgucaccaacugcgugaucaaggggcgggaggugcgcaagggccaguccguccugcggcaguacaagaccgagaucaagaucgggaaggugagcacgggcagccgcaagcugcucuccgaggagagcggcgacgacugcaucucccggacccagcugcugcgcaccgagaccgcggagauccacgacgacaacuacgggggcccgggggacaagaucacgaucugcaacggcagcaccaucguggaccagcgccucggguccgagcugggcugcuacaccaucaaccgggucaagagcuucaagcugugcgagaacuccgccaccggcaagacgugcgagaucgacagcacccccgugaagugccgccagggguucugccucaagaucacccaggagggccgggggcacgugaagcugucccgcggcagcgaggucgugcuggacgccugcgacuccagcugcgaggucaugauccccaaggggaccggcgacauccugguggacugcuccggcgggcagcagcacuuccucaaggacaaccugaucgaccugggcugcccccacaucccgcuccuggggaagauggccaucuacaucugccggaugagcaaccacccccgcaccacgauggccuuccuguucugguucuccuucggcuacgugaucaccugccucuucugcaaggcgcuguucuacagccugaucaucaucggcacccucgggaagaagaucaagcaguaccgggagcugcgcccccagaccugcacgaucugcgagaccgcccccgucaacgccaucgacgccgagaugcacgaccugaacugcuccuacaacaucugcccguacugcgcgagccggcucaccuccgacggccuggcccgccacgugccccagugccccaagcggaaggagaagguggaggagaccgagcuguaccucaaccuggagcgcaucccguggaucguccggaagcugcuccaggugagcgagagcacggggguggcccugaagcgcuccagcuggcugaucguccuccuggugcugcucaccgugucccugagccccguccaguccgcccccgugggccacgggaagaccaucgagaccuaccagacgcgggagggcuucaccagcaucugccuguucaugcucggcuccauccuguuccuggugagcugccucgucaaggggcugguggacuccgugagcgacuccuucuuccccggccugagcgucugcaagaccugcuccaucgggagcaucaacggcuucgagaucgagucccacaagugcuacugcagccuccugugcugcccguacugccgccacugcuccgccgaccgggagauccaccagcugcaccucagcaucugcaagaagcgcaagaccggguccaacgugaugcuggcggugugcaagcggaugugcuuccgcgccacgaucgaggccagccgccgggcccugcucauccgcagcaucaucaacaccaccuucgucaucugcauccugacccugacgaucugcgugguguccaccagcgccgucgagauggagaaccuccccuccggcaccugggagaaggaggaggaccugaccaacuucugccaccaggagugccaggugacggagaccgagugccugugccccuacgaggcgcucgugcugcggaagccccuguuccucgacagcaucgucaagggcaugaagaaccugcugaacuccaccagccucgagaccucccugagcaucgaggccccguggggggccaucaacgugcaguccacguucaagcccaccgugagcaccgccaacaucgcccuguccuggagcuccgucgagcaccgcggcaacaagauccucgugaccgggcggagcgaguccaucaugaagcuggaggagcgcacgggcgugagcugggaccugggggucgaggacgcguccgagagcaagcuccugaccguguccaucauggaccugagccagauguacagccccguguucgaguaccucuccggcgaccggcaggucgaggaguggcccaaggccaccugcaccggcgacugcccggagcgcugcgggugcacgagcuccaccugccugcacaaggaguggccccacagccggaacuggcgcugcaaccccaccuggugcuggggcguggggaccggcugcaccugcugcgggguggacgucaaggaccuguucacggaccacauguucgugaaguggaagguggaguacaucaagaccgaggccaucgucugcguggagcucaccucccaggagcggcagugcagccugaucgaggccggcacccgcuucaaccugggccccgugacgaucacccucuccgagccgcggaacauccagcagaagcugccccccgagaucaucacccugcaccccaaggucgaggagggguucuucgaccucaugcacgugcagaaggugcugagcgcguccaccgucugcaagcugcagagcugcacgcacggcaucccgggggaccuccagguguaccacaucggcaaccugcugaagggcgaccgcgugaacgggcaccucauccacaagaucgagccccacuucaacaccuccuggaugagcugggacggcugcgaccuggacuacuacugcaacaugggggacuggcccuccugcaccuacaccggcgucacgcagcacaaccacgccgccuucgugaaccugcucaacaucgagaccgacuacaccaagaccuuccacuuccacagcaagcgggucacggcccacggggacaccccccagcuggaccugaaggcccgcccgaccuacggcgcgggcgagaucaccgugcucguggaggucgccgacauggagcugcacacgaagaagguggagaucuccgggcugaaguucgccagccucgccugcaccggcugcuacgccugcuccagcgggaucuccugcaaggugcggauccacgucgacgagcccgacgagcugaccgugcacgugaagagcagcgaccccgacgucguggcggccuccaccagccugauggcccgcaagcucgaguucggcacggacuccaccuucaaggccuucagcgccaugcccaagaccucccugugcuucuacaucguggagcgggaguacugcaagagcugcuccgaggaggacacccagaagugcgucgacacgaagcuggagcagccgcagagcauccucaucgagcacaaggggaccaucaucggcaagcagaacgacaccugcaccgcgaaggccuccugcuggcuggagagcgugaaguccuucuucuacggccugaagaacaugcucgggagcguguucggcaacuucuucaucgggauccugcuguuccuggcccccuucguccuccuggugcuguucuucauguucggcuggaagauccucuucugcuucaagugcugccgccgggcccgcgggcugcugaaguaccgccaccucaaggacgacgaggagacgggcuaccggaagaucaucgagcgccugaacaacaagaagggcaagaaccggcugcucgacggggagcgccuggcggaccggaagaucgccgagcuguucuccaccaagacccacaucggcuga

SEQ ID NO: 11971 - RNA, 5067 nt, Artificial Sequence
  derived and/or modified CDS sequence (opt1) from CCHFV(4495-ST-2008)__KR814869.1__GP
augcccaccaacaucaugcacacccugcucgugugcuucauccuguaccugcagcuccugggcccggggggcgcccacgggcagcccaacgccacggagcacaaccgcaccaacaccaccacggcgcccagcaccucccagagccccaagccgcccgucuccaccgcccccccccacgcccuggagagcccgaccaucaaguccacgacccccaccagcgagaccgagggcuccggggagacgaccccccccccgaacaccacccagggccccagcccccccgagacgaccccggagcggcccgccaccaccgccacguccacccccagcaccgacaacaccaacuccacgacccacgugaccgacaacaaccccaccagcacgaucuccaccagcccguccagcucccccagcacccccuccaccccccgcggcauccaccacccggcgcggaaccuccugagcgugagcucccccaagacggccaccacccccacccccacgagcccgggggagaucuccagcgagaccuccagccugcacuccgccaugagccgcaccuccacccucuacaccgccacgcaggcgagcaccgagaacgccaaccacuccaccccccggcagagcgagucccccgcccagccgaccacgaccagccugaugaccucccccgcccagagcauccuggucauguccgccgcgcccaccgccauccagaacauccaccccagcccgacgaaccgcuccaagcggaaccucgagauggagaucauccugacccugagccagggccucaagaaguacuacgggaagauccugaagcugcuccaccugacccuggaggaggacaccgagggccuccuggaguggugcaagcgcaaccuggggagcaacugcgacgacgacuucuuccagaagcggaucgaggaguucuucaugacgggcgagggcuacuucaacgaggugcuccaguucaagacccuguccacccugagccccaccgagcccucccacgcccgccccccgacgguggagcccuucaagagcuacuucgccaagggguuccucuccaucgacagcggcuacuucuccgccaagugcuacccccggagcuccaccagcgggcugcagcugaucaacgucacccagcaccccgcgcgcaucgccgagaccccgggccccaagacgaccucccucaagaccaucaacugcaucaaccugcgggccagcguguucaaggagcaccgcgagaucgagaucaacgugcugcucccccagaucgccgucaaccuguccaacugccacguggugaucaacagccacgucugcgacuacucccuggacaccgacggccccgugcggcucccgcacaucuaccacgaggggacguucauccccggcaccuacaagaucgugaucgacaagaagaacaagcugaacgaccgcugcacccuggucaccaacugcgugaucaaggggcgggaggugcgcaagggccagagcguccuccggcaguacaagacggagaucaagaucgggaagguguccaccggcagccgcaagcugcugagcgaggaguccggcgacgacugcaucagccggacccagcuccugcgcaccgagacggccgagauccacgacgacaacuacgggggccccggggacaagaucaccaucugcaacggcuccaccaucguggaccagcgccuggggagcgagcucggcugcuacaccaucaaccgggucaaguccuucaagcugugcgagaacagcgcgacgggcaagaccugcgagaucgacuccacccccgugaagugccgccagggguucugccugaagaucacccaggagggccgggggcacgugaagcucagccgcggcuccgaggucgugcuggacgccugcgacagcuccugcgaggucaugaucccgaaggggaccggcgacauccugguggacugcagcggcgggcagcagcacuuccugaaggacaaccucaucgaccugggcugcccccacaucccccugcucgggaagauggccaucuacaucugccggauguccaaccacccccgcacgaccauggccuuccuguucugguucagcuucggcuacgugaucaccugccuguucugcaaggcccucuucuacucccugaucaucaucggcacccuggggaagaagaucaagcaguaccgggagcuccgcccgcagacgugcaccaucugcgagaccgcgcccgucaacgccaucgacgccgagaugcacgaccugaacugcagcuacaacaucugccccuacugcgccucccggcugaccagcgacggccucgcgcgccacgugccgcagugccccaagcggaaggagaagguggaggagacggagcuguaccugaaccucgagcgcauccccuggaucguccggaagcugcugcagguguccgagagcaccgggguggcccucaagcgcagcuccuggcugaucguccugcucgugcugcugaccgugagccucucccccguccagagcgccccggugggccacgggaagaccaucgagacguaccagacccgggagggcuucaccuccaucugccuguucaugcugggcagcauccucuuccugguguccugccuggucaaggggcucguggacagcguguccgacagcuucuuccccggccuguccgucugcaagaccugcagcaucggguccaucaacggcuucgagaucgagagccacaagugcuacugcucccugcucugcugccccuacugccgccacugcagcgccgaccgggagauccaccagcugcaccuguccaucugcaagaagcgcaagacggggagcaacgugaugcucgccgugugcaagcggaugugcuuccgcgcgaccaucgaggccucccgccgggcccugcugauccgcagcaucaucaacaccaccuucgucaucugcauccucacgcugaccaucugcguggugagcaccuccgccgucgagauggagaaccugcccagcggcaccugggagaaggaggaggaccucacgaacuucugccaccaggagugccaggugaccgagaccgagugccugugcccguacgaggcccuggugcuccggaagccccuguuccuggacuccaucgucaagggcaugaagaaccuccugaacagcaccucccuggagacgagccucuccaucgaggcgcccuggggggccaucaacgugcagagcaccuucaagcccaccguguccaccgccaacaucgcccugagcugguccagcgucgagcaccgcggcaacaagauccuggugacggggcgguccgagagcaucaugaagcucgaggagcgcaccggcaucuccugggaccuggggguggaggacgccagcgaguccaagcugcucaccgucagcaucauggaccugucccagauguacagcccgguguucgaguaccugagcggcgaccggcagguggaggaguggcccaaggcgaccugcacgggcgacugccccgagcgcugcgggugcaccuccagcaccugccuccacaaggaguggccccacucccggaacuggcgcugcaacccgaccuggugcuggggcgucgggaccggcugcacgugcugcgggguggacgugaaggaccuguucaccgaccacauguucgucaaguggaagguggaguacaucaagaccgaggccaucgugugcgucgagcugaccagccaggagcggcagugcucccucaucgaggccggcacgcgcuucaaccugggccccgugaccaucacccugagcgagccccggaacauccagcagaagcuccccccggagaucaucacccugcaccccaagguggaggagggguucuucgaccugaugcacguccagaaggugcucuccgccagcacggugugcaagcugcaguccugcacccacggcauccccggggaccugcaggucuaccacaucggcaaccuccugaagggcgaccgcgugaacgggcaccugauccacaagaucgagccccacuucaacaccagcuggauguccugggacggcugcgaccucgacuacuacugcaacaugggggacuggccgagcugcaccuacacgggcgugacccagcacaaccacgcggccuucgucaaccugcugaacaucgagaccgacuacaccaagacguuccacuuccacuccaagcgggugaccgcccacggggacaccccccagcucgaccugaaggcccgccccaccuacggcgccggcgagaucacgguccugguggagguggcggacauggagcuccacaccaagaaggucgagaucagcgggcugaaguucgccucccuggccugcaccggcugcuacgccugcagcuccgggaucagcugcaaggugcggauccacguggacgagcccgacgagcucaccguccacgugaaguccagcgacccggacguggucgccgcgagcacgucccugauggcccgcaagcuggaguucggcaccgacagcaccuucaaggccuucuccgccaugcccaagaccagccucugcuucuacaucguggagcgggaguacugcaaguccugcagcgaggaggacacgcagcgcugcguggacaccaagcuggagcagccccaguccauccugaucgagcacaaggggaccaucaucggcaagcagaacgacaccugcacggccaaggcgagcugcuggcucgaguccgucaagagcuucuucuacggccugaagaacaugcugggguccguguucggcaacuucuucaucgggauccuccuguuccuggccccguucgugcugcucguccuguucuucauguucggcuggaagauccuguucugcuucaagugcugccggcgcgcccgcgggcuccugaaguaccggcaccugaaggacgacgaggagaccggcuaccgcaagaucaucgagcggcucaacaacaagaagggcaagaaccgccugcuggacggggagcggcucgccgaccgcaagaucgcggagcuguucagcaccaagacccacaucggcuga

SEQ ID NO: 11972 - RNA, 5067 nt, Artificial Sequence
  derived and/or modified CDS sequence (opt1) from CCHFV(3809-ST-2007)__KR814867.1__GP
augcccaccaacaucaugcacacccugcucgugugcuucauccuguaccugcagcuccugggccucgggggcgcccaggggcagagcaacgccacggagcacaacgagaccaacaccaccacggcgccguccaccagccagucccccaagccgcccgucagcaccacgccccugcacgcccuggaguccagcaccaucaagcccaccacccccgcccgcgagaccgagggcuccggggagacgacgcccccgcccaacaccacccagggccccagcccgcccgaggccacccccgagcggcccgccaccaccgcgaccuccgcccccagcacggacaacaccaacuccaccacccacgugacggacaacaacccgaccagcaccaucuccaccagccccuccagcucccccagcacgcccuucaccccgcagggcauccaccaccccgcccgcaaccugcucuccgugagcagccccaagaccgccaccacgcccaccccgaccucccccggggagcugagcuccgagaccagcucccugcacagcgcgaucucccggacgagcacccucuacaccgccacccaggucuccaccgagaacgccaaccacagcgcgccccgccaguccgagagcuccgcccagcccacgaccaccagcccgaugaccucccccgcccagagcauccuggugauguccgccgcccccacggccauccagaacauccacccgagccccaccaaccgguccaagcgcaaccuggagauggagaucauccucacccugagccagggccugaagaaguacuacgggaagauccucaagcugcugcaccucacccuggaggaggacacggagggccugcucgaguggugcaagcggaaccuggggagcaacugcgacgacgacuucuuccagaagcgcaucgaggaguucuucaugaccggcgagggcuacuucaacgaggugcugcaguucaagacccucuccacccugagccccacggagcccucccacgcccggccgcccgcggucgagcccuucaagagcuacuucgccaagggguuccuguccaucgacagcggcuacuucuccgccaagugcuacccccgcagcuccaccagcgggcuccagcugaucaacgugacccagcacccggcccggaucgccgagacccccggccccaagacgaccucccugaagaccaucaacugcaucaaccuccgcgcgagcguguucaaggagcaccgggagaucgagaucaacguccugcugccccagaucgccgugaaccucuccaacugccacguggucaucaacagccacgugugcgacuacucccuggacaccgacggcccggugcgccugccccacaucuaccacgaggggacguucauccccggcaccuacaagaucgucaucgacaagaagaacaagcucaacgaccggugcacccuggugaccaacugcgugaucaaggggcgcgagguccggaagggccagagcgugcugcgccaguacaagacggagaucaagaucgggaaggccuccaccggcagccggaagcuccugagcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcuggacgcgugcgacuccagcugcgaggucaugauccccaaggggacgggcgacauccucguggacugcuccggcgggcagcagcacuuccugaaggacaaccugaucgaccucggcugcccccacaucccgcugcuggggaagauggccaucuacaucugccgcaugagcaaccacccccggaccaccauggccuuccucuucugguucuccuucggcuacgugaucacgugcaucuucugcaaggcccuguucuacagccugaucaucaucggcacccucgggaagaagaucaagcaguaccgcgagcugaagccccagaccugcaccaucugcgagaccgcgcccgucaacgccaucgacgccgagaugcacgaccugaacugcuccuacaacaucugcccguacugcgccagccggcucaccuccgacggccuggcccgccacgugccccagugccccaagcggaaggagaagguggaggagacggagcuguaccucaaccuggagcgcaucccguggaucguccggaagcugcuccaggugagcgaguccaccgggguggcgcugaagcgcagcagcuggcugaucguccuccuggugcugcucaccgugucccugagccccguccaguccgcccccgugggccacgggaagaccaucgagacguaccagacccgggagggcuucaccagcaucugccuguucaugcucggcuccauccuguuccuggugagcugccucgucaaggggcugguggacuccgugagcgacuccuucuuccccggccugagcgucugcaagaccugcuccaucgggagcgugaacggcuucgagaucgagucccacaagugcuacugcagccucuucugcugcccguacugccgccacugcuccgccgaccgggagauccaccagcugcaccugagcgugugcaagaagcgcaagacgggguccaacgucaugcucgccgugugcaagcggaugugcuuccgcgccaccaucgaggcgagccggcgcgcccugcugauccgcuccaucaucaacaccaccuucgugaucugcauccucacgcugaccaucugcgucgugagcaccagcgccguggagauggagaaccugcccgccggcaccugggagcgggaggaggaccucacgaacuucugccaccaggagugccaggucaccgagaccgagugccugugccccuacgaggcccuggugcuccgcaagccccuguuccuggacuccaucgugaagggcaugaagaaccuccugaacagcaccucccuggagacgagccucuccaucgaggcgccguggggcgccaucaacguccagagcaccuucaagcccaccguguccaccgccaacaucgcccugagcugguccagcguggagcaccgggggaacaagauccuggucacggggcgcuccgagagcaucaugaagcucgaggagcggaccggcguguccugggaccuggggguggaggacgcgagcgaguccaagcugcucaccgucagcaucauggaccugucccagauguacagccccguguucgaguaccuguccggcgaccgccagguggaggaguggcccaaggcgaccugcacgggcgacugcccggagcggugcgggugcaccagcuccacgugccuccacaaggaguggccccacagccgcaacuggcggugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcugaccagccaggagcgccagugcucccucaucgaggccggcacccgguucaaccugggccccgugaccaucacccugagcgagccgcgcaacauccagcagaagcucccgcccgagaucaucacccugcaccccaagguggaggagggguucuucgaccugaugcacguccagaaggugcucuccgccagcacggugugcaagcugcaguccugcacccacggcauccccggggaccugcaggucuaccacaucggcaaccuccugaagggcgaccgggugaacgggcaccugauccacaagaucgagccccacuucaacaccagcuggauguccugggacggcugcgaccucgacuacuacugcaacaugggggacuggcccagcugcaccuacacgggcgucacccagcacaaccacgccgccuucgugaaccugcugaacaucgagaccgacuacaccaagacguuccacuuccacuccaagcgcgugaccgcccacggggacacgccccagcucgaccugaaggcccggccgaccuacggcgccggcgagaucaccguccugguggagguggcggacauggagcuccacaccaagaaggucgagaucagcgggcugaaguucgccucccuggccugcaccggcugcuacgccugcagcuccgggaucagcugcaaggugcgcauccacguggacgagcccgacgagcucaccguccacgugaaguccagcgaccccgacguggucgccgcguccacgagccugauggcccggaagcuggaguucggcaccgacagcaccuucaaggccuucuccgccaugcccaagaccagccucugcuucuacaucguggagaaggaguacugccgcuccugcagcgaggaggacacgcagaagugcguggacaccaagcuggagcagccgcaguccauccugaucgagcacaaggggaccaucaucggcaagcagaacgacacgugcaccgcgaaggccagcugcuggcucgaguccgucaagagcuucuucuacggccugaagaacaugcugggguccguguucggcaacuucuucaucgggauccuccuguuccugacccccuucgugcugcucguccuguucuucauguucggcuggaagauccuguucugcuucaagugcugccggcgcacccgggggcuccugaaguaccgccaccugaaggacgacgaggagaccggcuaccgccggaucaucgagcgccucaacaacaagaagggcaagaaccggcugcuggacggggagcgccucgccgaccggaagaucgccgagcuguucagcacgaagacccacaucggcuga

SEQ ID NO: 11973 - RNA, 5067 nt, Artificial Sequence
  derived and/or modified CDS sequence (opt1) from CCHFV(3756-ST-2007)__KR814866.1__GP
augcccaucaacaucaugcacacccugcucgugugcuucauccuguaccugcagcucagcggccuggggggcgcccacgggcaguccaacgccaccgagcacaaccgcacgaacaccaccaccgucccgggcacgagccagucccccaagccccccgcgagcaccacccugccgcacacccccgaguccagcacggugaagcucaccacccccaccuccgagacggaggggagcggcgagaccacccccccgcccaacaccacgcagggccugccccugcccgggaccaccccggagcgguccgccaccacggccaccagcaccuccagcaccgacaacaugaacacgaccacccaggugaccgacaacacgcccaccuccaccgucagcaucucccccagcuccagccccuccaugccgagcaccagccagggcauccacuaccccgugcgcucccuccugagcguguccagccccaagacggucaccacccccaccccgaugucccccggggagaugagccccgagacguccagccagcacuccgccaugagccggauccccacccuguacaccgccacccagguguccaccgagaacaucaaccgcagcacgccgcggcaguccgagagcuccgugcagcccgcgacccagagccccaucaccucccccgcccagaccauccuccugaugagcgccgccccgaaggcgauccaggacaugcaccccucccccacgaaccgcagcaagcggaaccuggaggucgagaucauccucacccugagccagggccugaagaaguacuacgggaagauccucaagcugcugcaccucacccuggaggaggacaccgagggccugcucgaguggugcaagcgcaaccugggcuccaacugcgacgacgacuucuuccagaagcggaucgaggaguucuucaucacgggggagggcuacuucaacgaggugcugcaguucaagacccucagcacccuguccccgaccgagcccagccacgugcgccugcccacggccgagcccuucaaguccuacuucgccaagggguuccucagcaucgacuccggcuacuucagcgccaagugcuacccgcgguccagcaccuccggccugcagcugaucaacgucacccagcaccccgcccgcaucgcggagacccccgggcccaagacgaccagccucaagaccaucaacugcaucaaccugcgggccuccguguucaaggagcaccgcgagguggagaucaacguccugcucccgcagaucgccgugaaccugagcaacugccacguggucaucaacucccacgugugcgacuacagccuggacaccgacggccccgugcggcucccccgcauccaccacgaggggacguucauccccggcaccuacaagaucgucaucgaccggaagaacaagcugaacgaccgcugcucccuggugaccaacugcgugaucaaggggcgggagguccgcaagggccagagcgugcuccggcaguacaagaccgagaucaagaucggcaaggccagcacggggucccgcaagcugcugagcgaggagccgggcgacgacugcaucucccgcacccagcuccugaagaccgagaccgccgagauccacgacgacaacuacgggggccccggggacaagaucacgaucugcaacggcagcaccaucgucgaccagcggcugggcuccgagcucgggugcuacaccaucaaccgcgugaagagcuucaagcugugcgagaacuccgcgaccggcaagacgugcgagaucgacagcacccccgugaagugccggcagggguucugccugaagaucacccaggagggccgcgggcacgucaagcugucccggggcagcgagguggugcucgacgccugcgacuccagcugcgagaucaugauccccaagggcaccggggacauccuggucgacugcuccggcgggcagcagcacuuccugaaggacaaccucaucgaccugggcugcccgcacaucccccugcucggcaagauggccaucuacaucugccgcaugagcaaccacccccggacgaccauggccuuccuguucugguucuccuucggguacgugaucaccugcaucuucugcaaggcccuguucuacagccucaucaucaucggcacccuggggaagaagaucaagcaguaccgcgagcugaagccccagaccugcacgaucugcgagaccgcgccggugaacgccaucgacgccgagaugcacgaccucaacugcuccuacaacaucugccccuacugcgccagccggcugaccuccgacggccuggcccgccacgucacccagugccccaagcggaaggagaagguggaggagacggagcucuaccugaaccuggagcgcauccccuggaucgugcggaagcuccugcaggucagcgagagcaccgggguggcgcugaagcgcuccagcuggcucaucgugcugcugguccuccugaccgugucccugagcccggugcaguccgcccccgucggccacggcaagaccaucgagacguaccagacccgggagggguucaccagcaucugccucuucaugcugggcuccauccuguucaucgugagcugccucgugaaggggcuggucgacuccgugagcgacuccuucuuccccggccugagcgugugcaagaccugcuccaucgggagcaucaacggcuucgagaucgagucccacaagugcuacugcagccucuucugcugcccguacugccgccacugcuccgccgaccgggagauccaccagcugcaccugagcaucugcaagaagcgcaagacgggcuccaacgucaugcucgccgugugcaagcggaugugcuucaaggcgaccaucgaggccagccgccgcgcccugcugauccggagcaucaucaacaccaccuucgugaucugcauccucacgcuggccaucugcgucguguccaccagcgccguggagauggaggaccugcccgcggggaccugggagcgcgaggaggaccucaccaacuucugccaccaggagugccaggucacggagaccgagugccugugccccuacgaggcccuggugcuccggaagccccuguuccuggacuccaucgugaagggcaugaagaaccuccugaacagcaccucccuggagaccagccucuccaucgaggccccguggggggccaucaacguccagagcacguucaagcccaccguguccaccgccaacaucgcgcugagcugguccagcguggagcaccgcggcaacaagauccuggucaccgggcgguccgagagcaucaugaagcucgaggagcgcacgggcguguccugggaccugggcguggaggacgccagcgaguccaagcugcucaccgucagcaucauggaccugucccagauguacagccccguguucgaguaccugagcggggaccggcagguggaggaguggcccaaggccaccugcaccggcgacugcccggagcgcugcgggugcacguccagcaccugccuccacaaggaguggccccacucccggaacuggcgcugcaaccccaccuggugcuggggcgucgggaccggcugcacgugcugcggcguggacgugaaggaccuguucaccgaccacauguucaucaaguggaaggucgaguacaucaagaccgaggccaucgugugcguggagcugaccagccaggagcggcagugcucccucaucgaggccgggacccgcuucaaccugggccccgucacgaucacccugagcgagccgcggaacauccagcagaagcucccccccgagaucaucacccugcaccccaagaucgaggagggguucuucgaccugaugcacgugcagaaggugcucuccgcgagcaccgucugcaagcugcaguccugcacgcacggcaucccgggcgaccugcagaucuaccacaucgggaaccuccugaagggcgaccgcgugaacgggcaccugauccacaagaucgagccccacuucaacaccagcuggauguccugggacggcugcgaccucgacuacuacugcaacaugggggacuggcccagcugcaccuacaccggcgucacgcagcacaaccacgccgccuucgugaaccugcugaacaucgagaccgacuacaccaagaccuuccacuuccacuccaagcgggugacggcccacggcgacaccccccagcucgaccugaaggcgcgcccgaccuacggggccggcgagaucaccguccugguggagguggccgacauggagcuccacacgaagaaggucgagaucagcgggcugaaguucgccucccugaccugcaccggcugcuacgccugcagcuccgggaucagcugcaaggugcggauccacguggacgagcccgacgagcucaccguccacgugaaguccagcgaccccgacguggucgcggccagcacgucccugauggcccgcaagcuggaguucggcaccgacagcaccuucaaggccuucuccgccaugcccaagaccagccucugcuucuacaucguggagcgggaguacugcaaguccugcagcgaggacgacacgaagaagugcguggacaccaagcuggagcagccgcaguccauccugaucgagcacaagggcaccaucaucgggaagcagaacgacaccugcacggcgaaggccagcugcuggcucgaguccgucaagagcuucuucuacggccugaagaacaugcugggguccguguucggcagcuucuucguggggauccuccuguuccugacccccuucguccugcucgugcuguucuucauguucggcuggaagauccuguucugcuucaagugcugccgccggacccgcggccucuucaaguaccgccaccugaaggacgacgaggagaccggguaccggcgcaucaucgagcggcugaacuccaagaagggcaagaaccgccuccuggacggggagcggcuggccgaccgcaagaucgccgagcucuucagcacgaagacccacaucggcuga

SEQ ID NO: 11974 - RNA, 5067 nt, Artificial Sequence
  derived and/or modified CDS sequence (opt1) from CCHFV(81-R-2014)__KR814865.1__GP
augcccaccaacaucaugcacacccugcucgugugcuucauccuguaccugcagcuccugggccuggggggcgcccacgggcagagcaacgccacggagcacaacggcaccaacaccaccacggucccguccaccagccagucccccaagccccucgugagcaccacccccccgcacgcgcuggaguccagcacgaucaagcccaccacccccaccuccgagacggaggggagcggcgagaccgccccccugccgaacaccacccagggccccccccccccggagacgacccccgagcgccccgccaccaccgugacguccacccccagcaccgacaacaccaacuccacgauccacgucaccgacaacaacccgaccagcaccaucuccacgagccccuccagcucccccagcacccccuccaccccgcaggggauccaccaccccgcccggagccuccugagcguguccagccccaagaccgccacgacccccaccccgaccucccccggcgagaucaacagcgagacguccagccugcacuccgcgaugagccgcacccccacccuccacaccgccacccagguguccacggagaacgccaaccacagcgccccccggcaguccgagagcuccgcgcagccgaccaccaccagccugaugacgucccccgcccagagcauccugcucauguccgccgcccccaccgccauccagaacacccacccgagccccaccaaccgcuccaagcggaaccuggagauggagaucauccugacgcucagccaggggcugaagaaguacuacggcaagauccugaagcuccugcaccugacccucgaggaggacaccgaggggcugcuggaguggugcaagcgcaaccucggcagcaacugcgacgacgacuucuuccagaagcggaucggcgaguucuucaugaccggggagggcuacuucaacgagguccugcaguucaagacgcuguccacccucagccccaccgagcccucccacgcgcgccugccgaccguggagcccuucaagagcuacuucgccaagggguuccuguccaucgacagcggcuacuucuccgccaagugcuacccccggagcuccacgagcggccuccagcugaucaacgugacccagcaccccgcccgcaucgccgagaccccggggcccaagaccacgucccugaagaccaucaacugcaucaaccuccgggcgagcgucuucaaggagcaccgcgagaucgagaucaacgugcugcugccccagaucgccgugaaccucuccaacugccacgucgugaucaacagccacgugugcgacuacucccuggacaccgacggccccguccggcugccgcacaucuaccacgaggggaccuucauccccggcacguacaagaucgugaucgacaagaagaacaagcucaacgaccgcugcacccuggugaccaacugcgucaucaaggggcgggaggugcgcaagggccagagcgugcugcggcaguacaagaccgagaucaagaucggcaaggccuccacggggagccgcaagcuccugagcgaggagcccggcgacgacugcaucucccggacccagcugcuccgcaccgagaccgccgagauccacgacgacaacuacgggggccccggggacaagaucacgaucugcaacggcagcaccaucgucgaccagcggcugggcuccgagcuggggugcuacaccaucaaccgcgugaagagcuucaagcugugcgagaacuccgccaccggcaagacgugcgagaucgacagcaccccggugaagugccgccagggguucugccucaagaucacccaggagggccgggggcacgucaagcugucccgcggcagcgaggugguccuggacgcgugcgacuccagcugcgaggugaugauccccaagggcaccggggacauccucguggacugcuccggcgggcagcagcacuuccugaaggacaaccugaucgaccucggcugcccccacaucccccugcugggcaagauggccaucuacaucugccggaugagcaaccacccgcgcaccacgauggccuuccucuucugguucuccuucggguacgucaucaccugcaucuucugcaaggcccuguucuacagccugaucaucaucggcacccucgggaagaagaucaagcaguaccgggagcugaagccccagaccugcacgaucugcgagaccgcccccgugaacgcgaucgacgccgagaugcacgaccugaacugcuccuacaacaucugccccuacugcgccagccgccucaccuccgacggccuggcccggcacgugccgcagugccccaagcgcaaggagaaggucgaggagaccgagcuguaccucaaccuggagcggauccccuggaucgugcgcaagcugcuccaggugagcgaguccacgggggucgcgcugaagcggagcagcuggcugaucgugcuccuggugcugcucaccgucucccugagcccggugcaguccgcccccgugggccacggcaagaccaucgagaccuaccagacgcgcgagggguucaccagcaucugccuguucaugcucggcuccauccuguuccuggucagcugccucgugaaggggcugguggacuccgucagcgacuccuucuuccccggccugagcgugugcaagaccugcuccaucgggagcaucaacggcuucgagaucgagucccacaagugcuacugcagccucuucugcugccccuacugccggcacugcuccgccgaccgcgagauccaccagcugcaccugagcaucugcaagaagcggaagaccggcuccaacgugaugcucgccgucugcaagcgcaugugcuuccgggccacgaucgaggcgagccgccgggcccugcugauccgcuccaucaucaacaccaccuucgugaucugcauccucacccugacgaucugcguggucagcaccagcgccguggagauggagaaccugccggccgggaccugggagcgcgaggaggaccucaccaacuucugccaccaggagugccaggugacggagaccgagugccugugccccuacgaggcccugguccuccggaagccccuguuccuggacuccaucgugaagggcaugaagaaccuccugaacagcaccucccuggagaccagccucuccaucgaggcgcccuggggggccaucaacgugcagagcacguucaagccgaccgucuccaccgccaacaucgcccugagcugguccagcguggagcaccgcggcaacaagauccuggugaccgggcgguccgagagcaucaugaagcucgaggagcgcacgggcgucuccugggaccugggcguggaggacgccagcgaguccaagcugcucaccgugagcaucauggaccugucccagauguacagccccgucuucgaguaccuguccggggaccggcagguggaggaguggcccaaggcgaccugcaccggcgacugccccgagcgcugcgggugcacgagcagcaccugccuccacaaggaguggccgcacucccggaacuggcgcugcaaccccaccuggugcuggggcguggggaccggcugcaccugcugcggcgucgacgugaaggaccuguucacggaccacauguucgugaaguggaaggucgaguacaucaagaccgaggccaucgugugcguggagcugaccagccaggagcggcagugcucccucaucgaggccgggacccgcuucaaccugggccccgucacgaucacccugagcgagccccggaacauccagcagaagcucccgcccgagaucaucacccugcaccccaagguggaggagggguucuucgaccugaugcacgugcagaagguccucuccgccagcaccgugugcaagcugcaguccugcacgcacggcauccccggcgaccugcagguguaccacaucgggaaccuccugaagggcgaccgcaucaacgggcaccugauccacaagaucgagccgcacuucaacaccagcuggauguccugggacggcugcgaccucgacuacuacugcaacaugggggacuggcccagcugcaccuacaccggcgucacgcagcacaaccacgcggccuucgugaaccugcugaacaucgagaccgacuacaccaagaccuuccacuuccacuccaagcgggucacggcccacggcgacaccccccagcucgaccugaaggcccgccccaccuacggggccggcgagaucaccgugcugguggaggucgcggacauggagcuccacacgaagaagguggagaucagcgggcugaaguucgccucccuggccugcaccggcugcuacgccugcagcuccgggaucagcugcaaggugcggauccacgucgacgagccggacgagcucaccgugcacgugaaguccagcgaccccgacgucguggccgcguccaccagccugauggcccgcaagcuggaguucggcacggacagcaccuucaaggccuucuccgccaugcccaagaccagccucugcuucuacaucguggagcgggaguacugcaaguccugcagcgaggaggacacccagaagugcgucgacacgcgccuggagcagccccaguccauccugaucgagcacaagggcaccaucaucgggaagcagaacgacaccugcaccgccaaggcgagcugcuggcucgaguccgugaagagcuucuucuacggccugaagaacaugcugggguccguguucggcaacuucuucaucgggauccugcucuuccuggccccguucguccugcucgugcuguucuucauguucggcuggaagauccuguucugcuucaagugcugccggcgcacgcggggccuccugaaguaccgccaccugaaggacgacgaggagaccggguaccgccggaucaucgagcgccucaacaacaagaagggcaagaaccggcugcuggacggggagcgccucgccgaccggaagaucgccgagcuguucagcaccaagacccacaucggcuga

SEQ ID NO: 11975 - RNA, 5067 nt, Artificial Sequence
  derived and/or modified CDS sequence (opt1) from CCHFV(75-ST-2010)__KR814864.1__GP
augcccaccaacaucaugcacacccugcucgugugcuucauccuguaccugcagcuccugggcccggggggcgcccacgggcagcccaacgccacggagcacaaccgcaccaacaccaccacggcgcccagcaccucccagagccccaagccgcccgucuccaccgcccccccccacgcccuggagagcccgaccaucaaguccacgacccccaccagcgagaccgagggcuccggggagacgaccccccccccgaacaccacccagggccccagccuccccgagacgacccccgagcggccggccaccaccgccacguccacccccagcaccgacaacaccaacuccacgacccacgugaccgacaacaaccccaccagcacgaucuccaccagccccuccagcuccccgagcacccccuccaccccccgcggcauccaccaccccgcgcggaaccugcugagcgugagcuccccgaagacggccaccacccccacccccacgagccccggggagaucuccagcgagaccuccagccuccacuccgccaugagccgcaccuccacccuguacaccgccacgcaggcgagcaccgagaacgccaaccacuccgccccgcggcagagcgagucccccgcccagcccaccaccacgagccugaugaccuccccggcccagagcauccucgucauguccgcggcccccaccgccauccagaacauccaccccagccccaccaaccgcuccaagcggaaccuggagauggagaucauccugacgcucagccagggccugaagaaguacuacgggaagauccugaagcuccugcaccugacccucgaggaggacaccgagggccugcuggaguggugcaagcgcaaccucgggagcaacugcgacgacgacuucuuccagaagcggaucgaggaguucuucaugaccggcgagggcuacuucaacgaggugcugcaguucaagacgcuguccacccucagcccgaccgagcccucccacgcccgcccccccaccguggagccguucaagagcuacuucgccaagggguuccuguccaucgacagcggcuacuucuccgcgaagugcuacccccggagcuccacgagcgggcugcagcucaucaacgucacccagcaccccgcccgcaucgccgagacccccggcccgaagaccacgucccugaagaccaucaacugcaucaaccugcgggccagcguguucaaggagcaccgcgagaucgagaucaacgugcuccugccccagaucgccgucaaccuguccaacugccacguggugaucaacagccacgucugcgacuacucccucgacaccgacggccccgugcggcugccccacaucuaccacgaggggaccuucaucccgggcacguacaagaucgugaucgacaagaagaacaagcugaacgaccgcugcacccucgucaccaacugcgugaucaaggggcgggaggugcgcaagggccagagcguccugcggcaguacaagaccgagaucaagaucgggaagguguccacgggcagccgcaagcugcucagcgaggaguccggcgacgacugcaucagccggacccagcugcugcgcaccgagaccgcggagauccacgacgacaacuacgggggccccggggacaagaucacgaucugcaacggcuccaccaucguggaccagcgccucgggagcgagcugggcugcuacaccaucaaccgggucaaguccuucaagcugugcgagaacagcgccaccggcaagacgugcgagaucgacuccacccccgugaagugccgccagggguucugccucaagaucacccaggagggccgggggcacgugaagcugagccgcggcuccgaggucgugcuggacgccugcgacagcuccugcgaggucaugauccccaaggggaccggcgacauccugguggacugcagcggcgggcagcagcacuuccucaaggacaaccugaucgaccugggcugcccgcacaucccccuccuggggaagauggccaucuacaucugccggauguccaaccacccccgcaccacgauggccuuccuguucugguucagcuucggcuacgugaucaccugccucuucugcaaggcgcuguucuacucccugaucaucaucggcacccucgggaagaagaucaagcaguaccgggagcugcgcccccagaccugcacgaucugcgagaccgccccggucaacgccaucgacgccgagaugcacgaccugaacugcagcuacaacaucugccccuacugcgcgucccggcucaccagcgacggccuggcccgccacgugccccagugcccgaagcggaaggagaagguggaggagaccgagcuguaccucaaccuggagcgcauccccuggaucguccggaagcugcuccagguguccgagagcacggggguggcccugaagcgcagcuccuggcugaucguccuccuggugcugcucaccgugagccugucccccguccagagcgcccccgugggccacgggaagaccaucgagaccuaccagacgcgggagggcuucaccuccaucugccuguucaugcucggcagcauccuguuccugguguccugccucgucaaggggcugguggacagcguguccgacagcuucuucccgggccuguccgucugcaagaccugcagcaucggguccaucaacggcuucgagaucgagagccacaagugcuacugcucccuccugugcugccccuacugccgccacugcagcgccgaccgggagauccaccagcugcaccucuccaucugcaagaagcgcaagaccgggagcaacgugaugcuggcggugugcaagcggaugugcuuccgcgccacgaucgaggccucccgccgggcccugcucauccgcagcaucaucaacaccaccuucgucaucugcauccugacccugacgaucugcguggugagcaccuccgccgucgagauggagaaccuccccagcggcaccugggagaaggaggaggaccugaccaacuucugccaccaggagugccaggugacggagaccgagugccugugccccuacgaggcgcucgugcugcggaagccgcuguuccucgacuccaucgucaagggcaugaagaaccugcugaacagcaccucccucgagaccagccuguccaucgaggcccccuggggggccaucaacgugcagagcacguucaagcccaccguguccaccgccaacaucgcccugagcugguccagcgucgagcaccgcggcaacaagauccucgugaccgggcgguccgagagcaucaugaagcuggaggagcgcacgggcguguccugggaccugggggucgaggacgcgagcgaguccaagcuccugaccgugagcaucauggaccugucccagauguacagccccguguucgaguaccucagcggcgaccggcaggucgaggaguggccgaaggccaccugcaccggcgacugccccgagcgcugcgggugcacguccagcaccugccugcacaaggaguggccccacucccggaacuggcgcugcaaccccaccuggugcuggggcguggggaccggcugcaccugcugcgggguggacgucaaggaccuguucacggaccacauguucgugaaguggaagguggaguacaucaagaccgaggccaucgucugcguggagcucaccagccaggagcggcagugcucccugaucgaggccggcacccgcuucaaccugggcccggugacgaucacccucagcgagccccggaacauccagcagaagcugccccccgagaucaucacccugcacccgaaggucgaggagggguucuucgaccucaugcacgugcagaaggugcuguccgcgagcaccgucugcaagcugcaguccugcacgcacggcauccccggggaccuccagguguaccacaucggcaaccugcugaagggcgaccgcgugaacgggcaccucauccacaagaucgagccccacuucaacaccagcuggauguccugggacggcugcgaccuggacuacuacugcaacaugggggacuggcccagcugcaccuacaccggcgucacgcagcacaaccacgccgccuucgugaaccugcucaacaucgagaccgacuacaccaagaccuuccacuuccacuccaagcgggucacggcccacggggacaccccgcagcuggaccugaaggcccgccccaccuacggcgcgggcgagaucaccgugcucguggaggucgccgacauggagcugcacacgaagaagguggagaucagcgggcugaaguucgccucccucgccugcaccggcugcuacgccugcagcuccgggaucagcugcaaggugcggauccacgucgacgagcccgacgagcugaccgugcacgugaaguccagcgaccccgacgucguggcggccagcaccucccugauggcccgcaagcucgaguucggcacggacagcaccuucaaggccuucuccgccaugccgaagaccagccugugcuucuacaucguggagcgggaguacugcaaguccugcagcgaggaggacacccagaagugcgucgacacgaagcuggagcagccccaguccauccucaucgagcacaaggggaccaucaucggcaagcagaacgacaccugcaccgcgaaggccagcugcuggcuggaguccgugaagagcuucuucuacggccugaagaacaugcucggguccguguucggcaacuucuucaucgggauccugcuguuccuggcccccuucguccuccuggugcuguucuucauguucggcuggaagauccucuucugcuucaagugcugccgccgggcccgcgggcugcugaaguaccgccaccucaaggacgacgaggagacgggcuaccggaagaucaucgagcgccugaacaacaagaagggcaagaaccggcugcucgacggggagcgccuggcggaccggaagaucgccgagcuguucagcaccaagacccacaucggcuga

SEQ ID NO: 11976 - RNA, 5067 nt, Artificial Sequence
  derived and/or modified CDS sequence (opt1) from CCHFV(75-R-2012)__KR814863.1__GP
augcccaccaacaucaugcacacccugcuggugugcuucauccuguaccugcagcuccugggccucggcggggcccaccgccagagcaacgccaccgggcacaacgggaccaacaccaccaccgcccccuccaccagccagucccccaagccccucgugagcaccgcgcccccgcacgcccuggaguccagcaucaucaagcacaccacgcccguguccgagaccgaggggagcggcgagaccacgccgccgcccaacaccacccagggccccagcccccuggagaccacccccgagcggcccgccaccaccgccaccagcacccccuccaccgacaacaccaacagcaccacccacgugacggacaacaaccccaccuccaccaucagcaccucccccagcuccagcccguccacgcccagcacgccccaggggauccaccaccccgcccgcaaccuccugagcgucuccagccugaagaccgccaccacgccgacccccaccucccccggcgagaucagcuccgagaccagcucccuccacagcgccaugucccggacgagcacccuguacaccgccacccagguguccaccgagaacgcgaaccacagcgcgccccgccaguccgagagcuccgcccagcagacgaccaccagcccgaugaccucccccgcccagagcauccuggugauguccgccgcgcccacggccauccagaacacccaccccagcccgaccaaccggagcaagcgcaaccucgagauggagaucauccugacccugucccaggggcucaagaaguacuacggcaagauccugaagcugcuccaccugacgcuggaggaggacaccgaggggcuccuggaguggugcaagcggaaccugggcagcaacugcgacgacgacuucuuccagaagcgcaucgaggaguucuucaugaccggcgagggguacuucaacgagguccuccaguucaagacccuguccacgcagagccccaccgagcccucccacgcccggccgcccaccguggagcccuucaagagcuacuucgccaagggcuuccuguccaucgacagcggguacuucuccgccaagugcuacccccgccucagcaccuccggccugcagcugaucaacgugacgcagcacccggcgcggaucgccgagacccccggccccaagaccaccagccucaagacgaucaacugcaucaaccugcgcgccuccgucuucaaggagcaccgggagaucgagaucaacgugcugcucccccagaucgccgugaaccugagcaacugccacgucgugaucaacucccacgugugcgacuacagccuggacaccgacgggccgguccgccucccccacaucuaccacgagggcaccuucauccccgggaccuacaagaucgugaucgacaagaagaacaagcugaacgaccggugcacgcuggugaccaacugcgucaucaagggccgcgaggugcggaaggggcaguccgugcuccgccaguacaagaccgagaucaagaucggcaaggccagcaccggcagccggaagcugcuguccgaggagcccggggacgacugcaucagccgcacgcagcuccugcggaccgagaccgcggagauccacgacgacaacuacggcgggccgggcgacaagaucaccaucugcaacggguccacgaucgucgaccagcgccugggcagcgagcucggcugcuacaccaucaaccgcgugaaguccuucaagcugugcgagaacagcgccaccgggaagaccugcgagaucgacuccgcccccgugaagugccggcagggcuucugccugaagaucacgcaggaggggcgcggccacgucaagcugagccggggguccgaggugguccucgacgccugcgacagcuccugcgaggugaugauccccaagggcaccggcgacauccugguggacugcagcgggggccagcagcacuuccugaaggacaaccucaucgaccuggggugcccccacaucccgcugcucggcaagauggccaucuacaucugccgcauguccaaccacccccggaccaccauggcguuccuguucugguucagcuucggcuacgucaucacgugcaucuucugcaaggcccuguucuacucccucaucaucaucgggacgcugggcaagaagaucaagcaguaccgcgagcugaagccccagaccugcaccaucugcgagaccgcccccgugaacgccaucgacgcggagaugcacgaccucaacugcagcuacaacaucugcccguacugcgccucccggcugacgagcgacgggcuggcccgccacgugccccagugccccaagcggaaggagaaggucgaggagaccgagcucuaccugaaccuggagcgcauccccuggaucgugcggaagcuccuccagguguccgagagcaccggcgucgcccugaagcgcagcuccuggcucaucgugcugcuggugcuccugaccgucagccuguccccggugcagagcgcccccguggggcacggcaagacgaucgagaccuaccagacccgggagggcuucaccuccaucugccucuucaugcuggggagcauccuguuccucgucuccugccuggugaagggccuggugaacagcgucuccgacagcuucuuccccgggcucuccgugugcaagacgugcagcaucggcuccaucaacggguucgagaucgagagccacaagugcuacugcucccuguucugcugcccguacugccgccacugcagcgcggaccgggagauccaccagcugcaccucuccaucugcaagaagcgcaagaccggcagcaacgugaugcuggccgucugcaagcggaugugcuuccgcgccaccaucgaggccucccggcgcgcccugcucauccgcagcaucaucaacaccacguucgugaucugcauccugacccugaccaucugcguggucagcaccuccgcgguggagauggagaaccuccccagcggcacgugggagcgggaggaggaccugaccaacuucugccaccaggagugccaggugaccgagaccgagugccugugccccuacgaggcccucguccugcgcaagccccuguuccucgacuccaucgugaaggggaugaagaaccugcugaacagcacgucccucgagaccagccuguccaucgaggccccguggggcgccaucaacgugcagagcaccuucaagcccaccgucuccacggccaacaucgcgcugagcugguccagcguggagcaccgggggaacaagauccucgugaccggccgcuccgagagcaucaugaagcuggaggagcggaccggggucuccugggaccugggcguggaggacgccagcgaguccaagcuccugaccgugagcaucauggaccugucccagauguacagccccgucuucgaguaccucagcggcgaccgccagguggaggaguggcccaaggccacgugcaccggggacugcccggagcggugcggcugcaccuccuccacgugccugcacaaggaguggccccacucccgcaacuggcggugcaaccccaccuggugcuggggcgugggcaccgggugcacgugcugcggcgucgacgugaaggaccuguucaccgaccacauguucgugaaguggaaggucgaguacaucaagaccgaggccaucgugugcguggagcucacgagccaggagcgccagugcucccugaucgaggcgggcacccgguucaaccuggggcccgucaccaucacccucagcgagccgcgcaacauccagcagaagcugccgcccgagaucaucacgcugcaccccaagguggaggagggcuucuucgaccucaugcacgugcagaagguccuguccgccagcaccgugugcaagcugcaguccugcacccacgggaucccgggcgaccuccagguguaccacaucggcaaccugcugaagggggaccgggucaacggccaccucauccacaagaucgagccccacuucaacaccagcuggauguccugggacgggugcgaccuggacuacuacugcaacaugggcgacuggcccagcugcacguacaccggggugacccagcacaaccacgccgccuucgucaaccugcucaacaucgagaccgacuacacgaagaccuuccacuuccacuccaagcgcgugaccgcccacggcgacacgccccagcuggaccugaaggcgcggccgacguacggcgccggggagaucaccgugcucgucgagguggccgacauggagcugcacaccaagaagguggagaucagcggccugaaguucgccucccucgccugcaccgggugcuacgcgugcagcuccggcaucagcugcaagguccgcauccacguggacgagcccgacgagcugacggugcacgucaaguccagcgaccccgacgugguggccgccagcaccucccugauggcccggaagcucgaguucgggaccgacagcaccuucaaggccuucuccgcgaugcccaagacgagccugugcuucuacaucgucgagcgcgaguacugcaaguccugcagcgaggaggacacccagaagugcguggacaccaagcuggagcagccgcaguccauccucaucgagcacaagggcaccaucaucggcaagcagaacgacacgugcaccgccaaggccagcugcuggcuggaguccgucaagagcuuccuguacgggcucaagaacaugcugggcuccgucuucgggaacuucuucaucggcauccugcuguuccucgcccccuucgugcugcuggugcuguucuucauguucggguggaagauccuguucugcuucaagugcugccggcgcacccggggccugcucaaguaccgccugcugaaggacgacgaggagaccggcuaccgccggaucaucgagcgccucaacaacaagaaggggaagaaccggcugcuggacggcgagcgccucgcggaccggaagaucgccgagcuguucagcacgaagacccacaucggguga

SEQ ID NO: 11977 - RNA, 5067 nt, Artificial Sequence
  derived and/or modified CDS sequence (opt1) from CCHFV(52-R-2014)__KR814862.1__GP
augcccaccaacaucaugcacacccugcucgugugcuucauccuguaccugcagcuccugggccucgggggcgcccaccgccagagcaacgccacggagcacaacgggaccaacaccaccacggcgccguccaccagccagucccccaagccgcccgucagcaccgccccgccccacgcccccgaguccagcaccaucaagcccacgacccccgccuccgagaccgagggcagcggggagaccacgcccccgcccaacaccacccagggccccuccccgcccgaggccacccccgagcggcccgcgacgaccgccaccagcacccccuccacggacaacaccaacagcaccacccacgccacggacaacaaccccaccuccaccaucagcaccucccccagcuccagcccguccacgcccagcacgccccagggcauccaccaccccgcccgcaaccugcugagcguguccagcccgaagaccgcgaccacccccacccccaccucccccggggacaucagcuccgagaccagcucccugcacagcgccaugucccggacgccgacccuccacaccgccacccaggccagcaccgagaacgccaaccacuccgcgccccgccagagcgaguccagcgcccagcagacgaccaccucccccaugaccagcccggcccagcccauccuggugauguccgccgcccccacggcgauccagaacauccaccccagcccgaccaaccgguccaagcgcaaccuggagauggagaucauccucacccugagccagggccugaagaaguacuacgggaagauccucaagcugcugcaccucacccuggaggaggacacggagggccugcucgaguggugcaagcggaaccuggggagcaacugcgacgacgacuucuuccagaagcgcaucgaggaguucuucaugaccggcgagggcuacuucaacgagguccugcaguucaagacccucuccacccugagccccacggagcccucccacgcccggcccccgaccguggagcccuucaagagcuacuucgccaagggguuccuguccaucgacagcggcuacuucuccgccaagugcuacccccgccucagcaccuccgggcugcagcugaucaacgugacccagcaccccgcccggaucgcggagacgccgggccccaagaccaccagccucaagaccaucaacugcaucaaccugcgcgccuccgucuucaaggagcaccgggagaucgagaucaacgugcugcucccccagaucgccgugaaccugagcaacugccacgucgugaucaacucccacgugugcgacuacagccuggacacggacggccccguccgccucccgcacaucuaccacgaggggaccuucauccccggcaccuacaagaucgugaucgacaagaagaacaagcugaacgaccggugcacccuggugacgaacugcgucaucaaggggcgcgaggugcggaagggccaguccgugcuccgccaguacaagaccgagaucaagaucgggaaggccagcaccggcucccggaagcugcugagcgaggagcccggcgacgacugcaucagccgcacccagcuccugcggacggagaccgccgagauccacgacgacaacuacgggggccccggggacaagaucaccaucugcaacggcuccaccaucgucgaccagcgccucgggagcgagcucggcugcuacacgaucaaccgcgugaaguccuucaagcugugcgagaacagcgcgaccggcaagaccugcgagaucgacuccaccccggugaagugccggcagggguucugccugaagaucacgcaggagggccgcgggcacgucaagcucagccggggcuccgagguggugcuggacgccugcgacaccagcugcgaggucaugauccccaaggggaccggcgacauccugguggacugcuccggcgggcagcagcacuuccugaaggacaaccucaucgaccugggcugcccccacgucccccugcucgggaagauggccaucuacaucugccgcaugagcaaccacccgcggaccaccauggccuuccuguucugguucuccuucggcuacgugaucacgugcaucuucugcaaggcgcuguucuacagccucaucaucaucggcacccuggggaagaagaucaagcaguaccgcgagcugaagccccagaccugcaccaucugcgagacggcccccgugaacgccaucgacgccgagaugcacgaccucaacugcuccuacaacaucugcccguacugcgccagccggcugaccuccgacggccuggcgcgccacgucccccagugccccaagcggaaggagaagguggaggagaccgagcucuaccugaaccuggagcgcauccccuggaucgugcggaagcuccugcaggucagcgaguccaccgggguggcccugaagcgcagcuccuggcucaucgugcugcugguccuccugacggugagccugagcccggugcaguccgcccccgucggccacgggaagaccaucgagaccuaccagacccgggagggcuucacgagcgugugccucuucaugcugggcuccauccuguuccucgugagcugccuggucaaggggcugguggacuccgugagcgacuccuucuuccccggccucagcgucugcaagaccugcuccaucgggagcaucaacggcuucgagaucgagucccacaagugcuacugcagccuguucugcugccccuacugccgccacugcuccgccgaccgggagauccaccagcugcaccucagcaucugcaagaagcgcaagaugggguccaacgugaugcuggccgugugcaagcggaugugcuuccgcgcgaccaucgaggccagccggcgcgcccugcucauccgcuccaucaucaacaccacguucgucaucugcauccugacccugaccaucugcguggugagcaccuccgccgucgagauggagaaccucccgagcggcacgugggagcgggaggaggaccugaccaacuucugccaccaggagugccaggugaccgagaccgagugccugugccccuacgaggcccucgugcugcgcaagccccuguuccucgacagcaucgucaagggcaugaagaaccugcugaacuccacgagccucgagaccucccugagcaucgaggcgcccuggggcgccaucaacgugcaguccaccuucaagccgaccgugagcacggccaacaucgcccuguccuggagcuccgucgagcaccgggggaacaagauccucgugaccgggcgcagcgaguccaucaugaagcuggaggagcggaccggcgugagcugggaccugggggucgacgacgcguccgagagcaagcuccugaccguguccaucauggaccugagccagauguacucccccguguucgaguaccucagcggcgaccgccaggucgaggaguggcccaaggccacgugcaccggcgacugccccgagcggugcgggugcaccuccuccacgugccugcacaaggaguggccgcacagccgcaacuggcggugcaaccccaccuggugcuggggcguggggaccggcugcacgugcugcgggguggacgucaaggaccuguucaccgaccacauguucgugaaguggaagguggaguacaucaagaccgaggccaucgucugcguggagcucaccagccaggagcgccagugcagccugaucgaggccggcacccgguucaaccugggccccgugaccaucacccucuccgagccccgcaacauccagcagaagcugccgcccgagaucaucacgcugcaccccaaggucgaggagggguucuucgaccucaugcacgugcagaaggugcugagcgccuccaccgucugcaagcugcagagcugcacccacggcauccccggggaccuccagguguaccacaucggcaaccugcugaagggcgaccgggugaacgggcaccucauccacaagaucgagccgcacuucaacaccuccuggaugagcugggacggcugcgaccuggacuacuacugcaacaugggggacuggcccuccugcacguacaccggcgucacccagcacaaccacgcggccuucgugaaccugcucaacaucgagaccgacuacacgaagaccuuccacuuccacagcaagcgcgucaccgcccacggggacacgccccagcuggaccugaaggcccggcccaccuacggcgccggcgagaucaccgugcucguggaggucgcggacauggagcugcacaccaagaagguggagaucuccgggcugaaguucgccagccucgccugcaccggcugcuacgccugcuccagcgggaucuccugcaaggugcgcauccacgucgacgagccggacgagcugacggugcacgucaagagcaacgaccccgacgugguggccgcguccaccagccugauggcccggaagcucgaguucggcaccgacuccaccuucaaggccuucagcgccaugcccaagacgagccugugcuucuacaucguggagcgcgaguacugcaaguccugcagcgaggaggacacccagaagugcgucgacaccaagcuggagcagccgcaguccauccucaucgagcacaaggggaccaucaucggcaagcagaacgacacgugcaccgcgaaggccggcugcuggcuggagagcgugaaguccuucuucuacgggcugaagaacaugcucggcagcguguucgggaacuucuucaucggcauccugcuguuccucgcccccuucguccugcuggugcuguucuucauguucggguggaagauccucuucugcuucaagugcugccggcgcacccggggccugcugaaguaccgccuccugaaggacgacgaggagaccggcuaccgccggaucaucgagcgccugaacaacaagaaggggaagaaccggcuccuggacggcgagcgccuggccgaccggaagaucgccgagcuguucuccacgaagacccacaucggguga

SEQ ID NO: 11978 - RNA, 5067 nt, Artificial Sequence
  derived and/or modified CDS sequence (opt1) from CCHFV(47-ST-2013)__KR814861.1__GP
augcccaucaacaucaugcacacccugcuggccugcuucauccuguaccugcagcucagcggccucggcggggcccacgggcaguccaacgcgaccgagcacaacgggaccaacaccaccaccgugccggggaccagccagucccccaagccgcccgccagcaccacccugccgcacacccccgaguccagcacggucaagcucaccacccccaccuccgagaccgagggcagcggcgagaccacgcccccgcccaacaccacccaggggcugcccccgcccggcaccacccccgagcgcuccgccaccaccgccaccagcaccuccagcaccgacaacaugaacuccacgacccagaugaccgggaacacccccacgcccaccgugaacaugagccccuccagcucccccagcaugcccuccaccagccagggcauccacuaccccgugcggagccugcucuccgucccgagccccaagaccgccacgacccccacccccguguccccgggggagaugagccccgagaccuccagccagcacuccgcgacgagccgcauccccacccuguacaccgccacccagguguccaccgagaacacgaaccggagcacgccccgccaguccaagagcuccgugcagccggccacccagagccccaucacgccgcccgcccagacgauccugcucauguccgcggcccccaaggccauccaggacaugcaccccagccccaccaaccgguccaagcgcaaccuggagguggagaucauccugacccucagccagggccugaagaaguacuacggcaagauccugaagcuccugcaccugacccucgaggaggacacggaggggcugcuggaguggugcaagcggaaccucggcuccaacugcgacgacgacuucuuccagaagcgcaucgaggaguucuucaucaccggggagggcuacuucaacgaggugcugcaguucaagacccugagcacccucagccccacggagcccucccacguccggcugcccaccgccgagcccuucaagagcuacuacgccaagggcuuccugucccucgacagcggguacuucuccgcgaagugcuacccgcgcagcuccaccagcggccugcagcugaucaacgugacccagcaccccgcccggaucgccgagacgcccgggcccaagaccaccucccucaagaccaucaacugcaucaaccugcgcgccagcguguucaaggagcaccgggaggucgagaucaacgugcugcucccgcagaucgccgugaaccuguccaacugccacgucgugaucaacagccacgugugcgacuacccccuggacacggacggccccguccgccucccccggauccaccacgaggggaccuucaucccgggcaccuacaagaucgugaucgacaagaagaacaagcugaacgaccgcugcucccuggugaccaacugcgucaucaagggccgggaggugcgcaaggggcagagcgugcuccggcaguacaagacggagaucaagaucggcaaggcguccaccgggagccgcaagcugcuguccgaggagcccggcgacgacugcaucagccggacccagcuccugaagaccgagacggccgagauccacgacgacaacuacgggggccccggcgacaagaucaccaucugcaacgggagcaccaucgucgaccagcgccugggcuccgagcucgggugcuacaccaucaaccgcgucaaguccuucaagcugugcaagaacuccgccacgggcaagaccugcgagaucgacagcacccccgucaagugccggcagggguucugccugaagaucacccaggagggccgcggccacgugaagcugucccgggggagcgaggugguccucgacgccugcgacuccagcugcgagaucaugaucccgaagggcacgggggacauccugguggacugcuccggcggccagcagcacuuccugaaggacaaccucaucgaccuggggugcccccacaucccccugcucggcaagauggccaucuacaucugccgcaugagcaaccacccccggaccaccauggcguuccuguucugguucuccuucggguacgugaucacgugcaucuucugcaaggcccuguucuacagccucaucaucaucggcacccuggggaagaagaucaagcaguaccgcgagcugaagccgcagacgugcaccaucugcgagaccgcccccgucaacgccaucgacgccgagaugcacgaccucaacugcuccuacaacaucugccccuacugcgcgagccggcugaccuccgacggccuggcccgccacgugacgcagugcccgaagcggaaggagaagguggaggagaccgagcucuaccugaaccuggagcgcauccccuggaucguccggaagcuccuccaggugagcgaguccaccggcguggcccugaagcgcagcuccuggcucaucguccugcuggugcuccugaccgugagccugagccccguccaguccgcccccguggggcacggcaagacgaucgagaccuaccagacccgggagggguucaccagcaucugccucuucaugcugggcuccauccuguucaucgugagcugccucgucaaggggcugguggacuccgugagcgacuccuucuucccgggccugagcgucugccgcacgugcuccaucggcagcaucaacggguucgagaucgagucccacaagugcuacugcagccucuucugcugccccuacugccggcacugcuccgcggaccgcgagauccaccagcugcaccugagcaucugcaagaagcggaagaccggcuccaacgugaugcucgccgugugcaagcgcaugugcuucaaggccaccaucgaggccagccggcgcgcccuguucauccgcuccaucaucaacaccacguucgugaccugcauccugacccucgcgaucugcguggugagcaccuccgccgucgagauggaggaccugcccgccgggacgugggagcgggaggaggaccugaccaacuucugccaccaggagugccaggugaccgagaccgagugccucugccccuacgaggcccuggugcugcgcaagccgcuguuccuggacagcaucgucaagggcaugaagaaccugcucaacagcacgucccuggagaccagccuguccaucgaggcccccuggggcgcgaucaacgugcagagcaccuucaagcccaccguguccacggccaacaucgcccucagcugguccagcgucgagcaccggggcaacaagauccuggugaccggccgcuccgagagcaucaugaagcuggaggagcggaccgggguguccugggaccucggcgucgaggacgccagcgaguccaagcugcugaccgugagcaucauggaccucucccagauguacagccccguguucgaguaccuguccggggaccgccaggucgaggaguggccgaaggccacgugcaccggcgagugccccgagcggugcgggugcaccagcagcacgugccugcacaaggaguggccccacagccgcaacuggcggugcaaccccaccuggugcuggggcgugggcaccgggugcacgugcugcggcguggacgucaaggaccucuucaccgaccacauguucaucaaguggaagguggaguacaucaagaccgaggcgaucgugugcgucgagcugacgagccaggagcgccagugcucccugaucgaggccgggacccgguucaaccucggcccggugaccaucacccugagcgagccccgcaacauccagcagaagcugccgcccgagaucaucacgcuccacccgaagaucgaggagggcuucuucgaccugaugcacgugcagaagguccuguccgccagcaccgugugcaagcuccaguccugcacccacgggauccccggcgaccugcagaucuaccacaucgggaaccugcucaagggcgaccgggugaacgggcaccugauccacaagaucgagccccacuucaacaccagcuggauguccugggacggcugcgaccuggacuacuacugcaacaugggcgacuggcccagcugcacguacaccggggucacccagcacaaccacgccgcguucgugaaccuccugaacaucgagaccgacuacacgaagaccuuccacuuccacuccaagcgcgucaccgcccacggcgacaccccgcagcuggaccucaaggcccggcccacguacggggccggcgagaucaccgugcugguggaggucgccgacauggagcugcacaccaagaagguggaggugagcgggcucaaguucgcgucccuggccugcaccggcugcuacgccugcagcuccggcaucagcugcaagguccgcauccacguggacgagcccgacgagcugacggugcacgucaaguccagcgaccccgacgugguggccgccuccaccagccucauggcgcggaagcuggaguucgggaccgacuccaccuucaaggccuucagcgccaugccgaagacgagccugugcuucuacaucgucgagcgcgaguacugcaaguccugcagcgaggacgacaccaagaagugcguggacaccaagcucgagcagccccaguccauccugaucgagcacaagggcaccaucaucgggaagcagaacgacacgugcaccgccaaggccagcugcuggcuggaguccgucaagagcuucuucuacggccucaagaacaugcugggguccgucuucggcaacuucuucgugggcauccuccuguuccuggcgcccuucgugcugcugguccucuucuucauguucggguggaagauccuguucugcuucaagugcugccggcgcacccggggccuguucaaguaccgccaccucaaggacgacgaggagaccggguaccgccggaucaucgagcgccugaacagcaagaagggcaagaaccggcugcucgacggcgagcgccuggccgaccggaagaucgccgagcuguucuccacgaagacccacaucggguga

SEQ ID NO: 11979 - RNA, 5067 nt, Artificial Sequence
  derived and/or modified CDS sequence (opt1) from CCHFV(46-ST-2012)__KR814860.1__GP
augcccaccaacaucaugcacacccugcucgugugcuucauccuguaccugcagcuccugggccucgggggcgcccacgggcagagcaacgccacggagcacaacggcaccaacaccaccacggucccguccaccagccagucccccaagccccuggugagcaccacgcccccgcacgcgcuggaguccagcaccaucaagcccaccacccccaccuccgagacggaggggagcggcgagaccgcgccccugccgaacaccacccaggggcccccgccgcccgagacgacccccgagcgccccgccaccaccgugacguccacccccagcaccgacaacaccuccagcacgauccacgucaccgacaacaaccccaccuccaccaucagcacgucccccagcuccagccccuccacccccagcaccccgcaggggauccaccaccccgcccggagccuccuguccgugagcucccccaagaccgccacgacccccaccccgaccagccccggcgagaucaacuccgagacgagcucccugcacagcgccaugucccgcacccccacccuccacaccgccacccaggugagcacggagaacgccaaccacuccgcgccccggcagagcgaguccagcgcccagccgaccaccaccucccugaugacgagccccgcccaguccauccugcucaugagcgccgcccccaccgccauccagaacauccacccgucccccaccaaccgcagcaagcggaaccuggagauggagaucauccugacccucagccaggggcugaagaaguacuacggcaagauccugaagcuccugcaccugacgcucgaggaggacaccgaggggcugcuggaguggugcaagcgcaaccucggcuccaacugcgacgacgacuucuuccagaagcggaucgaggaguucuucaugaccggcgagggguacuucaacgagguccugcaguucaagacccugagcacgcucucccccaccgagcccagccacgcgcgccugccgaccguggagcccuucaaguccuacuucgccaagggcuuccugagcguggacuccggguacuucagcgccaagugcuacccccgguccagcaccuccggccuccagcugaucaacgucacgcagcaccccgcccgcaucgccgagaccccgggccccaagaccaccagccugaagacgaucaacugcaucaaccuccgggcguccguguucaaggagcaccgcgagaucgagaucaacgugcugcugccccagaucgccgucaaccucagcaacugccacguggugaucaacucccacgucugcgacuacagccuggacaccgacgggcccgugcggcugccgcacaucuaccacgagggcaccuucauccccgggaccuacaagaucgugaucgacaagaagaacaagcucaacgaccgcugcacgcuggucaccaacugcgugaucaagggccgggaggugcgcaaggggcaguccguccugcggcaguacaagaccgagaucaagaucggcaaggccagcaccggcagccgcaagcuccuguccgaggagcccggggacgacugcaucagccggacgcagcugcuccgcaccgagaccgccgagauccacgacgacaacuacggcgggcccggcgacaagaucaccaucugcaacggguccacgaucguggaccagcggcugggcagcgagcugggcugcuacaccaucaaccgcgugaaguccuucaagcugugcgagaacagcgccaccgggaagaccugcgagaucgacuccacgccggucaagugccgccagggcuucugccucaagaucacccaggaggggcggggccacgugaagcugagccgcggguccgaggucgugcuggacgcgugcgacagcuccugcgaggugaugauccccaagggcaccggcgacauccucgucgacugcagcgggggccagcagcacuuccugaaggacaaccugaucgaccucgggugcccccacaucccccugcugggcaagauggccaucuacaucugccggauguccaaccacccgcgcaccaccauggccuuccucuucugguucagcuucggcuacgugaucacgugcaucuucugcaaggcccuguucuacucccugaucaucaucgggacccucggcaagaagaucaagcaguaccgggagcugaagccccagaccugcaccaucugcgagacggcccccgugaacgcgaucgacgccgagaugcacgaccugaacugcagcuacaacaucugccccuacugcgccucccgccucaccagcgacgggcuggcccggcacgucccgcagugccccaagcgcaaggagaagguggaggagaccgagcuguaccucaaccuggagcggauccccuggaucgugcgcaagcugcuccaggucuccgagagcaccggcguggcgcugaagcggagcuccuggcugaucgugcuccugguccugcucacggugagccuguccccggugcagagcgcccccgucgggcacggcaagaccaucgagaccuaccagacccgcgagggcuucacguccaucugccuguucaugcucgggagcauccuguuccugguguccugccucgugaagggccuggucgacagcguguccgacagcuucuuccccgggcuguccgugugcaagaccugcagcaucggcuccaucaacggguucgagaucgagagccacaagugcuacugcucccucuucugcugccccuacugccggcacugcagcgccgaccgcgagauccaccagcugcaccuguccaucugcaagaagcggaagaccggcagcaacgucaugcucgccgugugcaagcgcaugugcuuccgggccaccaucgaggcgucccgccgggcccugcugauccgcagcaucaucaacgccacguucgugaucugcauccucacccugaccaucugcgucgugagcaccuccgccguggagauggagagccugccggccggcacgugggagcgcgaggaggaccucaccaacuucugccaccaggagugccaggucaccgagaccgagugccugugccccuacgaggcgcuggugcuccggaagccccuguuccuggacuccaucgugaaggggaugaagaaccuccugaacagcacgucccuggagaccagccucuccaucgaggcccccuggggcgccaucaacguccagagcaccuucaagccgaccguguccacggccaacaucgcccugagcugguccagcguggagcaccgcgggaacaagauccuggucaccggccgguccgagagcaucaugaagcucgaggagcgcaccgggguguccugggaccugggcguggaggacgcgagcgaguccaagcugcucaccgucagcaucauggaccugucccagauguacagccccguguucgaguaccugagcggcgaccgccagguggaggaguggcccaaggccacgugcaccggggacugccccgagcggugcggcugcaccuccagcacgugccuccacaaggaguggccgcacucccggaacuggcgcugcaaccccaccuggugcuggggcgucggcaccgggugcacgugcugcggcguggacgugaaggaccuguucaccgaccacauguucgucaaguggaagguggaguacaucaagaccgaggccaucgugugcgucgagcugaccagccaggagcggcagugcucccucaucgaggccggcacccgcuucaaccuggggcccgugaccaucacccugagcgagccccggaacauccagcagaagcucccgcccgagaucaucacgcugcaccccaagguggaggagggcuucuucgaccugaugcacguccagaaggugcucuccgcgagcaccgugugcaagcugcaguccugcacccacgggauccccggcgaccugcaggucuaccacaucggcaaccuccugaagggggaccgcaucaacggccaccugauccacaagaucgagccgcacuucaacaccagcuggauguccugggacgggugcgaccucgacuacuacugcaacaugggcgacuggcccagcugcacguacaccggggugacccagcacaaccacgccgccuucgucaaccugcugaacaucgagaccgacuacacgaagaccuuccacuuccacuccaagcgggugaccgcccacggcgacacgccccagcucgaccugaaggcccgccccaccuacggcgcgggggagaucaccgugcuggucgagguggccgacauggagcuccacaccaagaagguggagaucagcggccugaaguucgccucccuggccugcaccgggugcuacgccugcagcuccggcaucagcugcaagguccggauccacguggacgagccggacgagcucacggugcacgucaaguccagcgaccccgacgugguggcggccagcaccucccugauggcccgcaagcuggaguucgggaccgacagcaccuucaaggccuucuccgccaugcccaagacgagccucugcuucuacaucgucgagcgggaguacugcaaguccugcagcgaggaggacacccagaagugcguggacacccgccuggagcagccccaguccauccugaucgagcacaagggcaccaucaucggcaagcagaacgacacgugcaccgcgaaggccagcugcuggcucgaguccgucaagagcuucuucuacgggcugaagaacaugcugggcuccguguucgggaacuucuucaucggcauccuccuguuccuggccccguucgugcugcucgugcuguucuucauguucggguggaagauccuguucugcuucaagugcugccggcgcacccggggccuccugaaguaccgccaccugaaggacgacgaggagaccggcuaccgccggaucaucgagcgccucaacaacaagaaggggaagaaccggcugcuggacggcgagcgccucgccgaccggaagaucgcggagcuguucagcacgaagacccacaucggguga

SEQ ID NO: 11980 - RNA, 5067 nt, Artificial Sequence
  derived and/or modified CDS sequence (opt1) from CCHFV(44-ST-2010)__KR814859.1__GP
augcccaucaacaucaugcacacccugcucgugugcuucauccuguaccugcagcucagcggccuggggggcgcccacgggcaguccaacgccaccgagcacaacggcacgaacaccaccaccgucccggggacgagccagucccccaagccccccgcgagcaccacccugccgcacacccccgaguccagcacggugaagcucaccacccccaccuccgagacggagggcagcggcgagaccacccccccgcccaacaccacgcaggggcugccccccccgggcaccacccccgagcgccccgccaccacggccaccuccaugagcuccaccgacaacaugaacagcaccacgcaggugaccgacaacacccccaccuccacggucagcaucuccccgagcuccagccccuccaugcccagcaccagccaggggauccacuaccccgugcggucccugcucagcguguccagcccgaagaccgucaccacgcccacccccaugucccccggcgagaugagcccggagaccuccagccagcacuccgccaugagccgcauccccacccuguacacggccacccagguguccaccgagaacaccaaccggagcaccccccgccaguccgagagcuccgcgcagcccgccacgcagagcccgaccaccucccccacccagacgauccugcucaugagcgccgcccccaaggcgauccaggacaugcacccgucccccaccaaccggagcaagcgcaaccuggagguggagaucauccugacccucagccaggggcugaagaaguacuacggcaagauccugaagcuccugcaccugacccucgaggaggacacggagggccugcuggaguggugcaagcggaaccucggguccaacugcgacgacgacuucuuccagaagcgcaucgaggaguucuucaucaccggcgagggguacuucaacgagguccugcaguucaagacccugagcacccucucccccacggagcccagccacgugcggcugccgaccgccgagcccuucaaguccuacuucgccaagggcuuccugagcaucgacuccggcuacuucagcgccaagugcuacccccgcuccagcaccuccgggcuccagcugaucaacgugacccagcaccccgcccggaucgcggagacgccgggccccaagaccaccagccugaagaccaucaacugcaucaaccuccgcgccuccgucuucaaggagcaccgggagguggagaucaacgugcugcugccccagaucgccgucaaccucagcaacugccacguggugaucaacucccacgucugcgacuacagccuggacacggacgggcccgugcgccugccgcggauccaccacgagggcaccuucauccccgggaccuacaagaucgugaucgacaagaagaacaagcucaacgaccgcugcucccuggucaccaacugcgugaucaagggccgggaggugcgcaagggccagagcguccugcggcaguacaagacggagaucaagaucgggaaggccagcaccggcucccgcaagcuccugagcgaggagcccggggacgacugcaucucccggacccagcugcucaagaccgagacggccgagauccacgacgacaacuacggcgggcccggcgacaagaucaccaucugcaacggcagcaccaucguggaccagcgccugggguccgagcugggcugcuacaccaucaaccgcgucaagagcuucaagcucugcgagaacuccgcgacggggaagaccugcgagaucgacagcaccccggugaagugccggcagggcuucugccugaagaucacccaggaggggcgcggccacgugaagcugucccggggcagcgaggucgugcuggacgccugcgacuccagcugcgagaucaugauccccaaggggacgggcgacauccucguggacugcuccgggggccagcagcacuuccugaaggacaaccugaucgaccucggcugcccccacaucccccugcuggggaagauggccaucuacaucugccgcaugagcaaccacccgcggaccaccauggccuuccuccugugguucuccuucggcuacgucaucaccugcaucuucugcaaggcccuguucuacagccucaucaucaucgggacccugggcaagaagaucaagcaguaccgcgagcugaagccccagacgugcaccaucugcgagaccgcgcccgugaacgccaucgacgccgagaugcacgaccucaacugcuccuacaacaucugccccuacugcgccagccggcugaccuccgacgggcuggcccgccacgugacgcagugcccgaagcggaaggagaaggucgaggagaccgagcucuaccugaaccuggagcgcauccccuggaucgugcggaagcuccugcaggugagcgagagcaccggcgucgcgcugaagcgcuccagcuggcucaucgugcugcuggugcuccugaccgucucccugagccccgugcaguccgccccggugggccacgggaagacgaucgagaccuaccagacccgggagggcuucaccaacaucugccucuucaugcuggggagcauccuguucaucgucuccugccucgugaagggccugguggacagcgucuccgacagcuucuuccccgggcuguccgugugcaagacgugcagcuucggcuccaucaacggcuucgagaucgagagccacaagugcuacugcucccucuucugcugccccuacugccgccacugcagcgccgaccgggagauccaccagcugcaccuggggaucugcaagaagcgcaagaccggcuccaacgugaugcucgccgucugcaagcggaugugcuucaaggcgaccaucgaggccagccgccgggcccugcugauccgcuccaucaucaacaccacguucgugaucugcauccucacccuggccaucugcguggucagcaccagcgccguggagauggagaaccugcccgcggggaccugggagcgcgaggaggaccucacgaacuucugccaccaggagugccagguguccgagaccgagugccugugcccguacgaggcccugguccuccggaagccccuguuccuggacagcaucgugaagggcaugaagaaccuccugaacuccaccagccuggagaccucccucagcaucgaggcccccuggggggccaucaacgugcaguccacguucaagcccaccgucagcaccgccaacaucgcgcuguccuggagcuccguggagcaccgcggcaacaagauccuggugaccggccggagcgaguccaucaugaagcucgaggagcgcacgggggucagcugggaccugggcguggaggacgccuccgagagcaagcugcucaccguguccaucauggaccugagccagauguacuccccggucuucgaguaccugagcggggaccggcagguggaggaguggcccaaggccaccugcaccggcgacugccccgagcgcugcgggugcacgagcuccaccugccuccacaaggaguggccccacagccggaacuggcgcugcaacccgaccuggugcuggggcgugggcaccgggugcacgugcugcggcgucgacgugaaggaccuguucaccgaccacauguucaucaaguggaagguggaguacaucaagaccgaggccaucgucugcguggagcugaccucccaggagcggcagugcagccucaucgaggccgggacccgcuucaaccugggccccgugacgaucacccuguccgagccccggaacauccagcagaagcuccccccggagaucaucacccugcaccccaagaucgaggagggcuucuucgaccugaugcacguccagaaggugcucagcgcguccaccgugugcaagcugcagagcugcacgcacgggauccccggcgaccugcagaucuaccacaucgggaaccuccugaagggcgaccgccugaacgggcaccucauccacaagaucgagccccacuucaacaccuccuggaugagcugggacggcugcgaccuggacuacuacugcaacaugggcgacuggccguccugcaccuacaccggggucacgcagcacaaccacgccgccuucgugaaccugcucaacaucgagaccgacuacaccaagaccuuccacuuccacagcaagcgggucacggcccacggcgacaccccccagcuggaccugaaggcgcgccccaccuacggggccggcgagaucaccgugcucguggaggucgccgacauggagcugcacacgaagaagguggagaucuccgggcugaaguucgccagccucgccugcaccggcugcuacgcgugcuccagcggcaucuccugcaaggugcggauccacgucgacgagcccgacgagcugaccgugcacgugaagagcuccgacccggacgucguggccgccagcaccagccugauggcccgcaagcucgaguucgggacggacuccaccuucaaggccuucagcgcgaugcccaagaccucccugugcuucuacaucguggagcgggaguacugcaagagcugcuccgaggacgacaccaagaagugcgucgacacgaagcuggaccagccccagagcauccucaucgagcacaagggcaccaucaucgggaagcagaacgacaccugcaccgccaaggccuccugcuggcuggagagcgugaaguccuucuucuacggccugaagaacaugcucgggagcguguucggcaacuucuucgucggcauccugcuguuccuggcccccuucgugcuccuggugcuguucuucaugugcggguggaagauccucuucugcuucaagugcugccgccggacgcgcggccuguucaaguaccggcaccugaaggacgacgaggagaccggguaccgccgcaucaucgagcggcucaacuccaagaagggcaagaaccgccugcuggacggcgagcggcucgccgaccgcaagaucgcggagcuguucagcaccaagucccacaucggguga

SEQ ID NO: 11981 - RNA, 5067 nt, Artificial Sequence
  derived and/or modified CDS sequence (opt1) from CCHFV(37-R-2013)__KR814858.1__GP
augcccaccaacaucaugcacacccugcucgugugcuucauccuguaccugcagcuccugggccuggggggcgcccaccgccagagcaacgccacggagcacaacgggaccaacaccaccacggcgccguccaccagccagucccccaagccccccgucagcaccgccccgccccacgcccccgagaccuccacgaucaagcccaccaccccggccagcgagaccgagggcuccggggagacgacccccccccccaacaccacccagggcccgagcccccccgaggccacgcccgagcggccggcgaccaccgugaccuccacgcccagcaccgacaacaccaacuccaccacgcacgccaccgacaacaaccccaccagcaccaucuccacgagccccuccagcuccccgagcacccccuccaccccccagggcauccaccaccccgcccgcaaccuccugagcgugagcuccccgaagaccgccacgacccccacccccaccagccccggggacaucuccagcgagacguccagccugcacuccgcgaugagccggaccccgacccuccacaccgccacccaggccuccacggagaacgccaaccacagcgccccccgccaguccgagagcuccgcgcagcagaccaccaccagccccaugacguccccggcccagcccauccuggucaugagcgccgcccccaccgccauccagaacauccaccccuccccgaccaaccggagcaagcgcaaccuggagauggagaucauccucacccugucccagggccugaagaaguacuacgggaagauccucaagcugcugcaccucacgcuggaggaggacaccgagggccugcucgaguggugcaagcggaaccuggggagcaacugcgacgacgacuucuuccagaagcgcaucgaggaguucuucaugaccggcgagggcuacuucaacgaggugcugcaguucaagacccucagcacgcugucccccaccgagcccagccacgcgcggcccccgaccguggagcccuucaaguccuacuucgccaagggguuccugagcaucgacuccggcuacuucagcgccaagugcuacccccgccucaccacguccgggcugcagcugaucaacgucacccagcaccccgcccggaucgccgagaccccgggccccaagaccacgagccucaagaccaucaacugcaucaaccugcgcgcguccguguucaaggagcaccgggagaucgagaucaacgugcugcucccccagaucgccgucaaccugagcaacugccacguggugaucaacucccacgucugcgacuacagccuggacaccgacggccccgugcgccucccgcacaucuaccacgaggggaccuucauccccggcacguacaagaucgugaucgacaagaagaacaagcugaacgaccggugcacccuggucaccaacugcgugaucaaggggcgcgaggugcggaagggccaguccguccuccgccaguacaagaccgagaucaagaucgggaaggccagcacgggcucccggaagcugcugagcgaggagcccggcgacgacugcaucucccgcacccagcuccugcggaccgagaccgccgagauccacgacgacaacuacgggggccccggggacaagaucacgaucugcaacggcagcaccaucguggaccagcgccuggggagcgagcucggcugcuacaccaucaaccgcgugaaguccuucaagcugugcgagaacagcgccaccggcaagacgugcgagaucgacuccaccccggucaagugccggcagggguucugccugaagaucacccaggagggccgcgggcacgugaagcucagccggggcuccgaggugguccuggacgcgugcgacaccagcugcgaggugaugauccccaaggggaccggcgacauccuggucgacugcuccggcgggcagcagcacuuccugaaggacaaccucaucgaccugggcugcccccacaucccccugcucgggaagauggccaucuacaucugccgcaugagcaaccacccgcggacgaccauggccuuccuguucugguucuccuucggcuacgugaucaccugcaucuucugcaaggcccuguucuacagccucaucaucaucggcacccuggggaagaagaucaagcaguaccgcgagcugaagccccagacgugcaccaucugcgagaccgcgcccgugaacgccaucgacgccgagaugcacgaccucaacugcuccuacaacaucugcccguacugcgccagccggcugaccuccgacggccuggcccgccacgucccccagugccccaagcggaaggagaagguggaggagacggagcucuaccugaaccuggagcgcauccccuggaucgugcggaagcuccugcaggucagcgaguccaccgggguggcgcugaagcgcagcuccuggcucaucgugcugcugguccuccugaccgugagccuguccccggugcagagcgcccccgucggccacgggaagaccaucgagacguaccagacccgggagggcuucaccagcgugugccucuucaugcugggcuccauccuguuccucgugagcugccuggucaaggggcugguggacuccgugagcgacuccuucuuccccggccucagcgucugcaagaccugcuccaucgggagcaucaacggcuucgagaucgagucccacaagugcuacugcagccuguucugcugccccuacugccgccacugcuccgccgaccgggagauccaccagcugcaccucagcaucugcaagaagcgcaagaugggguccaacgugaugcuggccgugugcaagcggaugugcuuccgcgccacgaucgaggcgagccggcgcgcccugcucauccgcuccaucaucaacaccaccuucgucaucugcauccugacccugacgaucugcguggugagcaccuccgccgucgagauggagaaccucccgagcggcaccugggagcgggaggaggaccugaccaacuucugccaccaggagugccaggugacggagaccgagugccugugccccuacgaggcccucgugcugcgcaagccccuguuccucgacuccaucgucaagggcaugaagaaccugcugaacagcaccagccucgagaccucccugagcaucgaggcccccuggggggcgaucaacgugcaguccacguucaagccgaccgugagcaccgccaacaucgcccuguccuggagcuccgucgagcaccggggcaacaagauccucgugaccgggcgcagcgaguccaucaugaagcuggaggagcggacgggcgugagcugggaccugggggucgacgacgccuccgagagcaagcuccugaccguguccaucauggaccugagccagauguacucccccguguucgaguaccucagcggcgaccgccaggucgaggaguggcccaaggcgaccugcaccggcgacugccccgagcggugcgggugcacguccagcaccugccugcacaaggaguggccgcacucccgcaacuggcggugcaaccccaccuggugcuggggcguggggaccggcugcaccugcugcgggguggacgucaaggaccuguucacggaccacauguucgugaaguggaagguggaguacaucaagaccgaggccaucgucugcguggagcucaccagccaggagcgccagugcagccugaucgaggccggcacccgguucaaccugggccccgugacgaucacccucuccgagccccgcaacauccagcagaagcugccgcccgagaucaucacccugcaccccaaggucgaggagggguucuucgaccucaugcacgugcagaaggugcugagcgccuccaccgucugcaagcugcagagcugcacgcacggcauccccggggaccuccagguguaccacaucggcaaccugcugaagggcgaccgggugaacgggcaccucauccacaagaucgagccgcacuucaacaccuccuggaugagcugggacggcugcgaccuggacuacuacugcaacaugggggacuggcccuccugcaccuacaccggcgucacgcagcacaaccacgccgcguucgugaaccugcucaacaucgagaccgacuacaccaagaccuuccacuuccacagcaagcgcgucacggcccacggggacaccccccagcuggaccugaaggcccggcccaccuacggcgccggcgagaucaccgugcucguggaggucgccgacauggagcugcacacgaagaagguggagaucuccgggcugaaguucgcgagccucgccugcaccggcugcuacgccugcuccagcgggaucuccugcaaggugcgcauccacgucgacgagccggacgagcugaccgugcacgugaagagcaacgaccccgacgucguggccgccuccaccagccugauggcgcggaagcucgaguucggcacggacuccaccuucaaggccuucagcgccaugcccaagaccucccugugcuucuacaucguggagcgcgaguacugcaagagcugcagcgaggaggacacccagaagugcgucgacacgaagcuggagcagccgcaguccauccucaucgagcacaaggggaccaucaucggcaagcagaacgugaccugcaccgccaaggcgagcugcuggcuggaguccgugaagagcuucuucuacggccugaagaacaugcucggguccgucuucggcaacuucuucaucgggauccugcuguuccucgcccccuucgugcugcuggugcuguucuucauguucggcuggaagauccucuucugcuucaagugcugccggcgcacgcgggggcugcugaaguaccgccuccugaaggacgacgaggagaccggcuaccgccggaucaucgagcgccugaacaacaagaagggcaagaaccggcuccuggacggggagcgccuggccgaccggaagaucgccgagcucuucagcaccaagacccacaucggcuga

SEQ ID NO: 11982 - RNA, 5067 nt, Artificial Sequence
  derived and/or modified CDS sequence (opt1) from CCHFV(36-ST-2014)__KR814857.1__GP
augcccaucaacaucaugcacacccugcucgugugcuucauccuguaccugcagcucagcggccuggggggcgcccacgggcaguccaacgccaccgagcacaacggcacgaacaccaccaccgucccggggacgagccagucccccaagccccccgcgagcaccacccugccgcacacccccgaguccagcacggugaagcucaccacccccaccuccgagacggagggcagcggcgagaccacccccccgcccaacaccacgcaggggcugccccccccgggcaccacccccgagcgccccgccaccacggccaccuccaugagcuccaccgacaacaugaacagcaccacgcaggugaccgacaacacccccaccuccacggucagcaucuccccgagcuccagccccuccaugcccagcaccagccaggggauccacuaccccgugcggucccugcucagcguguccagcccgaagaccgucaccacgcccacccccaugucccccggcgagaugagcccggagaccuccagccagcacuccgccaugagccgcauccccacccuguacacggccacccagguguccaccgagaacaccaaccggagcaccccccgccaguccgagagcuccgcgcagcccgccacgcagagcccgaccaccucccccacccagacgauccugcucaugagcgccgcccccaaggcgauccaggacaugcacccgucccccaccaaccggagcaagcgcaaccuggagguggagaucauccugacccucagccaggggcugaagaaguacuacggcaagauccugaagcuccugcaccugacccucgaggaggacacggagggccugcuggaguggugcaagcggaaccucggguccaacugcgacgacgacuucuuccagaagcgcaucgaggaguucuucaucaccggcgagggguacuucaacgagguccugcaguucaagacccugagcacccucucccccacggagcccagccacgugcggcugccgaccgccgagcccuucaaguccuacuucgccaagggcuuccugagcaucgacuccggcuacuucagcgccaagugcuacccccgcuccagcaccuccgggcuccagcugaucaacgugacccagcaccccgcccggaucgcggagacgccgggccccaagaccaccagccugaagaccaucaacugcaucaaccuccgcgccuccgucuucaaggagcaccgggagguggagaucaacgugcugcugccccagaucgccgucaaccucagcaacugccacguggugaucaacucccacgucugcgacuacagccuggacacggacgggcccgugcgccugccgcggauccaccacgagggcaccuucauccccgggaccuacaagaucgugaucgacaagaagaacaagcucaacgaccgcugcucccuggucaccaacugcgugaucaagggccgggaggugcgcaagggccagagcguccugcggcaguacaagacggagaucaagaucgggaaggccagcaccggcucccgcaagcuccugagcgaggagcccggggacgacugcaucucccggacccagcugcucaagaccgagacggccgagauccacgacgacaacuacggcgggcccggcgacaagaucaccaucugcaacggcagcaccaucguggaccagcgccugggguccgagcugggcugcuacaccaucaaccgcgucaagagcuucaagcucugcgagaacuccgcgacggggaagaccugcgagaucgacagcaccccggugaagugccggcagggcuucugccugaagaucacccaggaggggcgcggccacgugaagcugucccggggcagcgaggucgugcuggacgccugcgacuccagcugcgagaucaugauccccaaggggacgggcgacauccucguggacugcuccgggggccagcagcacuuccugaaggacaaccugaucgaccucggcugcccccacaucccccugcuggggaagauggccaucuacaucugccgcaugagcaaccacccgcggaccaccauggccuuccucuucugguucuccuucggcuacgucaucaccugcaucuucugcaaggcccuguucuacagccugaucaucaucgggacccucggcaagaagaucaagcaguaccgcgagcugaagccccagacgugcaccaucugcgagaccgcgcccgugaacgccaucgacgccgagaugcacgaccugaacugcuccuacaacaucugccccuacugcgccagccggcucaccuccgacgggcuggcccgccacgugacgcagugcccgaagcggaaggagaaggucgaggagaccgagcuguaccucaaccuggagcgcauccccuggaucgugcggaagcugcuccaggugagcgagagcaccggcgucgcgcugaagcgcuccagcuggcugaucgugcuccuggugcugcucaccgucucccugagccccgugcaguccgccccggugggccacgggaagacgaucgagaccuaccagacccgggagggcuucaccaacaucugccuguucaugcucgggagcauccuguucaucgucuccugccuggugaagggccucguggacagcgucuccgacagcuucuuccccgggcuguccgugugcaagacgugcagcaucggcuccaucaacggcuucgagaucgagagccacaagugcuacugcucccuguucugcugccccuacugccgccacugcagcgccgaccgggagauccaccagcuccaccuggggaucugcaagaagcgcaagaccggcuccaacgugaugcuggccgucugcaagcggaugugcuucaaggcgaccaucgaggccagccgccgggcccuccugauccgcuccaucaucaacaccacguucgugaucugcauccugacccucgccaucugcguggucagcaccagcgccguggagauggagaaccugcccgcggggaccugggagcgcgaggaggaccugacgaacuucugccaccaggagugccagguguccgagaccgagugccucugcccguacgaggcccugguccugcggaagccccucuuccuggacagcaucgugaagggcaugaagaaccugcucaacuccaccagccuggagaccucccugagcaucgaggcccccuggggggccaucaacgugcaguccacguucaagcccaccgucagcaccgccaacaucgcgcucuccuggagcuccguggagcaccgcggcaacaagauccuggugaccggccggagcgaguccaucaugaagcuggaggagcgcacgggggucagcugggaccucggcguggaggacgccuccgagagcaagcugcugaccguguccaucauggaccucagccagauguacuccccggucuucgaguaccugagcggggaccggcagguggaggaguggcccaaggccaccugcaccggcgacugccccgagcgcugcgggugcacgagcuccaccugccugcacaaggaguggccccacagccggaacuggcgcugcaacccgaccuggugcuggggcgugggcaccgggugcacgugcugcggcgucgacgugaaggaccucuucaccgaccacauguucaucaaguggaagguggaguacaucaagaccgaggccaucgucugcguggagcugaccucccaggagcggcagugcagccugaucgaggccgggacccgcuucaaccucggccccgugacgaucacccuguccgagccccggaacauccagcagaagcugcccccggagaucaucacccuccaccccaagaucgaggagggcuucuucgaccugaugcacguccagaaggugcugagcgcguccaccgugugcaagcuccagagcugcacgcacgggauccccggcgaccugcagaucuaccacaucgggaaccugcucaagggcgaccgccugaacgggcaccugauccacaagaucgagccccacuucaacaccuccuggaugagcugggacggcugcgaccucgacuacuacugcaacaugggcgacuggccguccugcaccuacaccggggucacgcagcacaaccacgccgccuucgugaaccugcugaacaucgagaccgacuacaccaagaccuuccacuuccacagcaagcgggucacggcccacggcgacaccccccagcucgaccugaaggcgcgccccaccuacggggccggcgagaucaccgugcugguggaggucgccgacauggagcuccacacgaagaagguggagaucuccgggcugaaguucgccagccuggccugcaccggcugcuacgcgugcuccagcggcaucuccugcaaggugcggauccacgucgacgagcccgacgagcucaccgugcacgugaagagcuccgacccggacgucguggccgccagcaccagccugauggcccgcaagcuggaguucgggacggacuccaccuucaaggccuucagcgcgaugcccaagaccucccucugcuucuacaucguggagcgggaguacugcaagagcugcuccgaggacgacaccaagaagugcgucgacacgaagcuggaccagccccagagcauccugaucgagcacaagggcaccaucaucgggaagcagaacgacaccugcaccgccaaggccuccugcuggcucgagagcgugaaguccuucuucuacggccugaagaacaugcuggggagcguguucggcaacuucuucgucggcauccuccuguuccuggcccccuucgugcugcucgugcuguucuucaugugcggguggaaguuccuguucugcuucaagugcugccgccggacgcgcggccucuucaaguaccggcaccugaaggacgacgaggagaccggguaccgccgcaucaucgagcggcugaacuccaagaagggcaagaaccgccuccuggacggcgagcggcuggccgaccgcaagaucgcggagcucuucagcaccaagucccacaucggguga

SEQ ID NO: 11983 - RNA, 5067 nt, Artificial Sequence
  derived and/or modified CDS sequence (opt1) from CCHFV(24-R-2012)__KR814856.1__GP
augcccaccaacaucaugcacacccugcucgugugcuucauccuguaccugcagcuccugggccucgggggcgcccaccgccagagcaacgccacggagcacaacgggaccaacaccaccacggcgccguccaccagccagucccccaagccgcccgucagcaccgccccgccccacgcccccgaguccagcaccaucaagcccacgacccccgccuccgagaccgagggcagcggggagaccacgcccccgcccaacaccacccagggccccuccccgcccgaggccacccccgagcggacggcgaccaccgccaccagcacgcccuccaccgacaacaccaacagcaccacgcacgccaccgacaacaaccccaccuccaccaucagcacgucccccagcuccagccccuccaccccgagcacgccccagggcauccaccaccccgcccgcaaccugcugagcguguccagccccaagaccgcgaccaccccgacccccaccucccccggggacaucagcuccgagacgagcucccugcacagcgccaugucccggacccccacccuccacaccgccacccaggccagcacggagaacgccaaccacuccgcgccgcgccagagcgaguccagcgcccagcagaccaccaccucccccaugacgagccccgcccagccgauccuggugauguccgccgcccccaccgcgauccagaacauccaccccagccccaccaaccgguccaagcgcaaccuggagauggagaucauccucacccugagccagggccugaagaaguacuacgggaagauccucaagcugcugcaccucacgcuggaggaggacaccgagggccugcucgaguggugcaagcggaaccuggggagcaacugcgacgacgacuucuuccagaagcgcaucgaggaguucuucaugaccggcgagggcuacuucaacgagguccugcaguucaagacccucuccacgcugagcccgaccgagcccucccacgcccggccgcccaccguggagcccuucaagagcuacuucgccaagggguuccuguccaucgacagcggcuacuucuccgccaagugcuacccccgccucagcaccuccgggcugcagcugaucaacgugacgcagcaccccgcccggaucgcggagacccccggcccgaagaccaccagccucaagacgaucaacugcaucaaccugcgcgccuccgucuucaaggagcaccgggagaucgagaucaacgugcugcucccccagaucgccgugaaccugagcaacugccacgucgugaucaacucccacgugugcgacuacagccuggacaccgacggccccguccgccucccccacaucuaccacgaggggaccuucaucccgggcaccuacaagaucgugaucgacaagaagaacaagcugaacgaccggugcacgcuggugaccaacugcgucaucaaggggcgcgaggugcggaagggccaguccgugcuccgccaguacaagaccgagaucaagaucgggaaggccagcaccggcucccggaagcugcugagcgaggagcccggcgacgacugcaucagccgcacgcagcuccugcggaccgagaccgccgagauccacgacgacaacuacgggggccccggggacaagaucaccaucugcaacggcuccacgaucgucgaccagcgccuggggagcgagcucggcugcuacaccaucaaccgcgugaaguccuucaagcugugcgagaacagcgcgaccggcaagaccugcgagaucgacuccacgcccgugaagugccggcagggguucugccugaagaucacccaggagggccgcgggcacgucaagcucagccggggcuccgagguggugcuggacgccugcgacaccagcugcgaggucaugaucccgaaggggaccggcgacauccugguggacugcuccggcgggcagcagcacuuccugaaggacaaccucaucgaccugggcugcccccacaucccccugcucgggaagauggccaucuacaucugccgcaugagcaaccacccccggaccacgauggccuuccuguucugguucuccuucggcuacgucaucacgugcaucuucugcaaggcgcuguucuacagccucaucaucaucggcacccuggggaagaagaucaagcaguaccgcgagcugaagccgcagaccugcaccaucugcgagaccgcccccgugaacgccaucgacgccgagaugcacgaccucaacugcuccuacaacaucugccccuacugcgccagccggcugaccuccgacggccuggcgcgccacgugccgcagugccccaagcggaaggagaaggucgaggagaccgagcucuaccugaaccuggagcgcauccccuggaucgugcggaagcuccuccaggugagcgaguccacgggggucgcccugaagcgcagcuccuggcucaucgugcugcuggugcuccugaccgucagccugagccccgugcaguccgccccggugggccacgggaagaccaucgagaccuaccagacgcgggagggcuucaccagcgucugccucuucaugcugggcuccauccuguuccucgugagcugccuggugaaggggcuggucgacuccgugagcgacuccuucuuccccggccucagcgugugcaagaccugcuccaucgggagcaucaacggcuucgagaucgagucccacaagugcuacugcagccuguucugcugccccuacugccgccacugcuccgccgaccgggagauccaccagcugcaccucagcaucugcaagaagcgcaagaugggguccaacgucaugcuggccgugugcaagcggaugugcuuccgcgcgaccaucgaggccagccggcgcgcccugcucauccgcuccaucaucaacacgaccuucgugaucugcauccugacccugaccaucugcgucgugagcacguccgccguggagauggagaaccuccccagcggcaccugggagcgggaggaggaccugaccaacuucugccaccaggagugccaggucaccgagacggagugccugugcccguacgaggcccucgugcugcgcaagccccuguuccucgacagcaucgugaagggcaugaagaaccugcugaacuccaccagccucgagaccucccugagcaucgaggcgcccuggggcgccaucaacguccaguccaccuucaagcccacggugagcaccgccaacaucgcccuguccuggagcuccguggagcaccgggggaacaagauccucgucaccgggcgcagcgaguccaucaugaagcuggaggagcggaccggcgugagcugggaccuggggguggaggacgcguccgagagcaagcuccugacggucuccaucauggaccugagccagauguacuccccgguguucgaguaccucagcggcgaccgccagguggaggaguggcccaaggcgaccugcaccggcgacugccccgagcggugcgggugcaccuccagcacgugccugcacaaggaguggccccacagccgcaacuggcggugcaacccgaccuggugcuggggcgucgggaccggcugcacgugcugcgggguggacgugaaggaccuguucaccgaccacauguucgucaaguggaagguggaguacaucaagaccgaggccaucgugugcgucgagcucaccucccaggagcgccagugcagccugaucgaggccggcacccgguucaaccugggccccgugaccaucacgcucuccgagccccgcaacauccagcagaagcugcccccggagaucaucacccugcaccccaagguggaggagggguucuucgaccucaugcacguccagaaggugcugagcgccuccaccgugugcaagcugcagagcugcacccacggcauccccggggaccuccaggucuaccacaucggcaaccugcugaagggcgaccgggugaacgggcaccucauccacaagaucgagccccacuucaacacguccuggaugagcugggacggcugcgaccuggacuacuacugcaacaugggggacuggccguccugcaccuacaccggcgugacccagcacaaccacgccgccuucgucaaccugcucaacaucgagacggacuacaccaagaccuuccacuuccacagcaagcgcgugaccgcccacggggacacgccccagcuggaccugaaggcccggcccaccuacggcgccggcgagaucaccguccucguggagguggcggacauggagcugcacaccaagaaggucgagaucuccgggcugaaguucgccagccucgccugcacgggcugcuacgccugcuccagcgggaucuccugcaaggugcgcauccacguggacgagcccgacgagcugaccguccacgucaagagcaacgacccggacgugguggccgcguccaccagccugauggcccggaagcucgaguucggcaccgacuccacguucaaggccuucagcgccaugcccaagaccagccugugcuucuacaucguggagcgcgaguacugcaaguccugcagcgaggaggacacccagaagugcguggacaccaagcuggagcagccccaguccauccucaucgagcacaaggggacgaucaucggcaagcagaacgacacgugcaccgcgaaggccagcugcuggcuggaguccgucaagagcuucuucuacggccugaagaacaugcucggguccguguucggcaacuucuucaucgggauccugcuguuccucgccccguucgugcugcugguccuguucuucauguucggcuggaagauccucuucugcuucaagugcugccggcgcacccgggggcugcugaaguaccgccuccugaaggacgacgaggagaccggcuaccgccggaucaucgagcgccugaacaacaagaagggcaagaaccggcuccuggacggggagcgccuggccgaccggaagaucgccgagcuguucagcaccaagacccacaucggcuga

SEQ ID NO: 11984 - RNA, 5064 nt, Artificial Sequence
  derived and/or modified CDS sequence (opt1) from CCHFV(Oman-199809166)__KR864901.1__GP
augcccgugaacaccaugcacacccugcucgucuacgccguguucugccugcagcuguggagcccgggcgggacgcgcggccucuccaacgagacccagcacaacgagaccgggaucacccgggcccccgagggcagccaggggcccucccugcccgugagcacggcguccccgaucaugagcgaccccuccaucaccacccugagcgccuccaccagcggccucgagggcuccggggacacgaccccgcccgccaucacccagggcccgacccugcccgagacgacccccgagcccagcaccaccacggggaccaacgccuucuccaccgccaucgcgaacgucagcacccagacggugaaggacaccccgacccccaccgugcagacguccccgcccagcacccccgacgccuccaccaucccccagggcacccaccacacggcccgcgggcugcucagcgucaccgugaccaagcccgaggaggugcccaccccgacgggccccgagcaggccuccaucgagaccaacagcagccggcuggcgaccuccaagacccccagccccuccccgacggcccaggucaccaccgagaacagcaaccccaacaccucccgccagcuggugcucagcacccagcccgccacguccagccccgugaccuccccggcccagcugaacuucguccagagcgccaccaccaucgcggugcaggacgcccaccccucccccacgaaccggagcaagcgcaaccuggagauggaggugauccucacccugucccagggccugcggaaguacuacgggcgcauccucaagcugcuggaccucacccuggaggaggacaccgagggccugcucgaguggugcaagcggaaccuggggcugacgugcgacgacaacuucuuccagaagcgcaucgaggaguucuuccucaccggcgagggccacuucaacgagguccugcaguucaagaccccgagcacccugucccccacggagagcgccuccguggggcuccccaccguggagcccuucaagagcuacuucgccaagggcuuccuguccaucgacagcggguacuucagcgccaagugcuacccgcgggcguccaacagcggccugcagcucaucaacgucacccagcacuccgcccgcaucgccgacacccccgggcccaagaucacgaaccugaagaccaucaacugcaucaaccugaaggcccucguguucaaggagcaccgggagaucgagaucaacgugcugcugccccaggucgccgugaaccucagcaacugccacgugcacaucaagucccacgucugcgacuacagccuggacaucgacggcaccgugcgccugccgcggauccaccacgagggcaccuucauccccgggacguacaagaucgucaucgacaagaagaacaagcagaacgaccgcugcaaccucgugaccaacugcgugaucaagggccgggagguccgcaaggggcaguccgugcugcggcaguaccgcaccgagauccggaucggcaaggcgagcuccgggagccgccgccugcucuccgaggagagcggcgaggacugcaucucccggacccagcugcugcgcacggagaccgccgagauccacggcgacaacuacgggggccccggggacaagaucaccaucugcaacggcagcaccaucguggaccagcggcucggguccgagcugggcugcuacacgaucaaccgcgucaagagcuucaagcugugcgagaacuccgccaccggcaagagcugcgagaucgacaacacccccgugaagugcaagcagggguucugccugaagaucacccaggagggccgggggcacgugaagcucagccgcgacuccgaggucgugcuggacgccugcgacagcuccugcgagaucaugaucccgaagggcacgggcgacauccugguggacugcagcgggggccagcagcacuuccucaaggacaaccugaucgaccuggggugccccaacaucccccuccugggcaagauggccaucuacaucugccggauguccaaccaccccaagaccaccauggcguuccuguucugguucagcuucggguacgucaucacgugcauccucugcaaggugaucuucuaccugcugaucguggucggcacccucggcaagaaguucaagcaguaccgcgagcugaagccgcagaccugcaccaucugcgagaccacccccgugaacgccaucgacgccgagaugcacgaccugaacugcuccuacaacaucugccccuacugcgccagccggcucacguccgacgggcuggcgcgccacgugaugcagugccccaagcggaaggagaagaucgaggagaccgagcuguaccucaaccuggagcgcaucccgugggucgugcggaagcugcuccaggugagcgaguccaccggcgucgcccugaagcgcagcuccuggcugaucgugcuccuggugcugcucaccgucagccugucccccgugcagagcgcccccaucgggcacggcaagacgaucgagaccuaccagacccgggagggguacaccuccaucugccuguucgugcucggcagcauccuguucaucgucucccaccugaugaagggccucguggacagcguggggaacagcuucuuccccggccuguccaucugcaagacgugcagcaucggguccaucaacggcuucgagaucgagagccacaagugcuacugcucccuguucugcugcccguacugccgccacugcagcgccgacaaggagauccacaagcuccaccuguccaucugcaagaagcggaaggccgggagcaacgucaugcuggcggugugcaagcgcaugugcuuccgggccaccauggagguguccaacaaggcccuccugauccgcagcgucaucaacaccaccuucguggugugcauccugauccucgccgucugcgugguguccacgagcgccgucgagauggagucccugcccgcgggcaccugggagcgcgaggaggaccugaccaacuucugccaccaggagugccaggugaccgagacggagugccucugccccuacgaggcccuggugcugcggaagccccucuuccuggacagcaucgccaagggcaugaagaaccugcucaacuccaccagccuggagaccucccugagcaucgaggcccccuggggcgccaucaacguccaguccaccuucaagcccacggugagcaccgcgaacaucgcccucagcugguccagcguggagcaccgcgggaacaagauccuggucuccgggcggagcgaguccaucaugaagcuggaggagcgcaccggcaucagcugggaccucgggguggaggacgccuccgagagcaagcugcugaccguguccgucauggaccucagccagauguacucccccguguucgaguaccugagcggcgaccgccagguggaggaguggccgaaggccacgugcaccggcgacugccccgagcggugcgggugcaccuccuccacgugccugcacaaggaguggccccacagccggaacuggcgcugcaaccccaccuggugcuggggcgucgggaccggcugcacgugcugcggccucgacgugaaggaccuguucaccgacuacauguucgucaaguggaagguggaguacaucaagaccgaggcgaucgugugcgucgagcugaccagccaggagcggcagugcucccucaucgaggccgggacccgcuucaaccugggcccggugaccaucacgcugagcgagccccggaacauccagcagaagcucccgcccgagaucgugacccugcacccccgcaucgaggagggguucuucgaccugaugcacguccagaaggugcucuccgccagcaccgugugcaagcugcagagcugcacccacggcguccccggggaccuccagguguaccacaucggcaaccugcugaagggcgacaaggugaacgggcaccugauccacaaggucgagccccacuucaacaccuccuggaugagcugggacggcugcgaccucgacuacuacugcaacaugggggacuggcccuccugcacguacaccggcgugacccagcacaaccacgccgccuucgugaaccugcugaacaucgagaccgacuacacgaagaacuuccacuuccacagcaagcgggucaccgcgcacggggacaccccgcagcucgaccugaaggcccgccccaacuacggcgccggcgagaucaccgugcugguggaggucgccgacauggagcuccacacgaagaagaucgagaucuccgggcugaaguucgccagccugaccugcaccggcugcuacgcgugcuccagcgggaucuccugcaaggugcggauccacguggacgagcccgacgagcucaccguccacgucaagagcgaggaccccgacaucguggccgccuccagcucccugauggcccgcaagcuggaguucggcacggacagcaccuucaaggccuucuccgcgaugccgaagaccagccucugcuucuacaucguggagcgggaguacugcaaguccugcagcaaggaggacacccagaagugcgugaacgccaagcuggagcgcccccaguccauccugaucgagcacaaggggacgaucaucggcaagcagaacgacacgugcaccgccaaggccagcugcuggcucgagagcgugaaguccuucuucuacggccugaagaacaugcugagcgggaucuucggcaacgucuucaucgggaucuuccuguuccucgcgcccuucauccugcugauccucuucuucauguucggcuggcggauccuguucugcuucaagugcugccgccggacccgcggccuguucaaguaccgccaccucaaggacgacgaggagaccggguaccggaagaucaucgagcgccugaacaacaagaagggcaagaacaagcugcucgacggggagcggcuggccgaccgcaagaucgccgagcuguucuccaccaagacccacaucggcuga

SEQ ID NO: 11985 - RNA, 5064 nt, Artificial Sequence
  derived and/or modified CDS sequence (opt1) from CCHFV(Oman_812956)__KY362518.1__GP
augcccgugaacaccaugcacacccugcucgucuacgccguguucugccugcagcuguggagcccgggcgggacgcgcggccucuccaacgagacccagcacaacgagaccgggaucacccgggcccccgagggcagccaggggcccucccugcccgugagcacggcguccccgaucaugagcgaccccuccaucaccacccugagcgccuccaccagcggccucgagggcuccggggacacgaccccgcccgccaucacccagggccccacccugcccgagacgacccccgagcccagcaccaccacggggaccaacgccuucuccaccgccaucgcgaacgucagcacccagacggugaaggacaccccgacccccaccgugcagacguccccgcccagcacccccgacgccuccaccaucccccagggcacccaccacacggcccgcgggcugcucagcgucaccgugaccaagcccgaggaggugcccaccccgacgggccccgagcaggccuccaucgagaccaacagcccccggcuggcgaccagcaagacccccuccccgagccccacggcccaggucaccaccgagaacuccaaccccaacaccagccgccagcuggugcucuccacccagcccgccacgagcuccccggugaccagccccgcccagcugaacuucguccaguccgccaccaccaucgcggugcaggacgcccaccccagcccgacgaaccgguccaagcgcaaccuggagauggaggugauccucacccugagccagggccugcggaaguacuacgggcgcauccucaagcugcuggaccucacccuggaggaggacaccgagggccugcucgaguggugcaagcggaaccuggggcugacgugcgacgacaacuucuuccagaagcgcaucgaggaguucuuccucaccggcgagggccacuucaacgagguccugcaguucaagacccccuccacccugagccccacggaguccgccagcguggggcuccccaccguggagccguucaaguccuacuucgccaagggcuuccugagcaucgacuccggguacuucagcgccaagugcuacccccgggcgagcaacuccggccugcagcucaucaacgucacccagcacagcgcccgcaucgccgacacccccgggcccaagaucacgaaccugaagaccaucaacugcaucaaccugaaggcccucguguucaaggagcaccgggagaucgagaucaacgugcugcugccgcaggucgccgugaaccucuccaacugccacgugcacaucaagagccacgucugcgacuacucccuggacaucgacggcaccgugcgccugccccggauccaccacgagggcaccuucauccccgggacguacaagaucgucaucgacaagaagaacaagcagaacgaccgcugcaaccucgugaccaacugcgugaucaagggccgggagguccgcaaggggcagagcgugcugcggcaguaccgcaccgagauccggaucggcaaggcguccagcgggucccgccgccugcucagcgaggaguccggcgaggacugcaucagccggacccagcugcugcgcacggagaccgccgagauccacggcgacaacuacgggggccccggggacaagaucaccaucugcaacggcuccaccaucguggaccagcggcucgggagcgagcugggcugcuacacgaucaaccgcgucaaguccuucaagcugugcgagaacagcgccaccggcaaguccugcgagaucgacaacaccccggugaagugcaagcagggguucugccugaagaucacccaggagggccgggggcacgugaagcucagccgcgacagcgaggucgugcuggacgccugcgacuccagcugcgagaucaugauccccaagggcacgggcgacauccugguggacugcuccgggggccagcagcacuuccucaaggacaaccugaucgaccuggggugccccaacaucccccuccugggcaagauggccaucuacaucugccggaugagcaaccacccgaagaccaccauggcguuccuguucugguucuccuucggguacgucaucacgugcauccucugcaaggugaucuucuaccugcugaucguggucggcacccucggcaagaaguucaagcaguaccgcgagcugaagccccagaccugcaccaucugcgagaccacccccgugaacgccaucgacgccgagaugcacgaccugaacugcagcuacaacaucugccccuacugcgccucccggcucacgagcgacgggcuggcgcgccacgugaugcagugcccgaagcggaaggagaagaucgaggagaccgagcuguaccucaaccuggagcgcauccccugggucgugcggaagcugcuccagguguccgagagcaccggcgucgcccugaagcgcuccagcuggcugaucgugcuccuggugcugcucaccgucucccugagccccgugcaguccgcccccaucgggcacggcaagacgaucgagaccuaccagacccgggagggguacaccagcaucugccuguucgugcucggcuccauccuguucaucgucagccaccugaugaagggccucguggacuccguggggaacagcuucuucccgggccugagcaucugcaagacgugcuccaucgggagcaucaacggcuucgagaucgagucccacaagugcuacugcagccuguucugcugccccuacugccgccacugcuccgccgacaaggagauccacaagcuccaccugagcaucugcaagaagcggaaggccggguccaacgucaugcuggcggugugcaagcgcaugugcuuccgggccaccauggaggugagcaacaaggcccuccugauccgcuccgucaucaacaccaccuucguggugugcauccugauccucgccgucugcguggugagcacguccgccgucgagauggagagccugcccgcgggcaccugggagcgcgaggaggaccugaccaacuucugccaccaggagugccaggugaccgagacggagugccucugcccguacgaggcccuggugcugcggaagccccucuucuucgacuccaucgccaagggcaugaagaaccugcugaacagcaccucccucgagaccagccuguccaucgaggcccccuggggcgccaucaacguccagagcaccuucaagcccacgguguccaccgcgaacaucgcccugagcuggagcuccguggagcaccgcgggaacaagauccucgucagcgggcgguccgagagcaucaugaagcuggaggagcgcaccggcaucuccugggaccuggggguggaggacgccagcgaguccaagcuccugaccgugagcgucauggaccugucccagauguacagcccgguguucgaguaccucuccggcgaccgccagguggaggaguggcccaaggccacgugcaccggcgacugccccgagcggugcgggugcaccagcuccacgugccugcacaaggaguggccccacagccggaacuggcgcugcaacccgaccuggugcuggggcgucgggaccggcugcacgugcugcggccuggacgugaaggaccucuucaccgacuacauguucgucaaguggaagguggaguacaucaagaccgaggcgaucgugugcgucgagcugaccucccaggagcggcagugcagccugaucgaggccgggacccgcuucaaccucggccccgugaccaucacgcuguccgagccccggaacauccagcagaagcugcccccggagaucgugacccuccacccccgcaucgaggagggguucuucgaccugaugcacguccagaaggugcugagcgccuccaccgugugcaagcuccagagcugcacccacggcguccccggggaccuccagguguaccacaucggcaaccugcugaagggcgacaaggugaacgggcaccugauccacaaggucgagccccacuucaacaccagcuggauguccugggacggcugcgaccuggacuacuacugcaacaugggggacuggccgagcugcacguacaccggcgugacccagcacaaccacgccgccuucgugaaccuccugaacaucgagaccgacuacacgaagaacuuccacuuccacuccaagcgggucaccgcgcacggggacacgccccagcuggaccucaaggcccgccccaacuacggcgccggcgagaucaccgugcugguggaggucgccgacauggagcugcacaccaagaagaucgagaucagcgggcucaaguucgccucccugaccugcaccggcugcuacgcgugcagcuccgggaucagcugcaaggugcggauccacguggacgagcccgacgagcugaccguccacgugaaguccgaggacccggacaucguggccgccagcuccagccucauggcccgcaagcuggaguucggcacggacuccaccuucaaggccuucagcgcgaugcccaagaccucccugugcuucuacaucgucgagcgggaguacugcaagagcugcuccaaggaggacacccagaagugcgugaacgccaagcucgagcgcccccagagcauccugaucgagcacaaggggacgaucaucggcaagcagaacgacacgugcaccgccaaggccuccugcuggcuggagagcgucaagagcuucuucuacggccucaagaacaugcuguccgggaucuucggcaacguguucaucgggaucuuccuguuccuggcgcccuucauccuccugauccuguucuucauguucggcuggcggauccucuucugcuucaagugcugccgccggacccgcggccuguucaaguaccgccaccugaaggacgacgaggagaccggguaccggaagaucaucgagcgccucaacaacaagaagggcaagaacaagcugcuggacggggagcggcucgccgaccgcaagaucgccgagcuguucagcaccaagacccacaucggcuga

SEQ ID NO: 11986 - RNA, 5064 nt, Artificial Sequence
  derived and/or modified CDS sequence (opt1) from CCHFV(Oman)__DQ211632.1__GP
augcccgugaacaccaugcacacccuccucgucuacgccguguucugccugcagcuguggagcccgggcgggacgcgcggccucuccaacgagacccagcacaacgagaccgggaucacccgggcccccgagggcagccaggggcccucccugcccgugagcacggcguccccgaucaugagcgaccccuccaucaccacccccagcgccuccaccagcggccuggagggcuccggggacacgacgcccccggccaucacccagggccccaccccgcccgagaccacccccgagcccagcaccaccacggggaccaacgccuucuccaccgccaucgcgaacgucagcacccagacggugaaggacacccccacccccaccgugcagacguccccgcccagcacccccgacgccuccaccaucccccagggcacccaccacacggcccgcgggcuccugagcgucaccgugaccaagccggaggaggugcccacccccacgggccccgagcaggccuccaucgagaccaacagcccgcggcuggcgaccagcaagacccccucccccagccccacggcccaggucaccaccgagaacuccaacccgaacaccagccgccagcucgugcuguccacccagcccgccacgagcucccccgugaccagcccggcccagcugaucuucguccaguccgccaccaccguggcggugcaggacgcccaccccagccccacgaaccgguccaagcgcaaccucgagauggaggucauccugacccugagccagggccuccggaaguacuacgggcgcauccugaagcugcucgaccugacccuggaggaggacaccgagggccuccuggaguggugcaagcggaaccuggggcucacgugcgacgacaacuucuuccagaagcgcaucgaggaguucuuccugaccggcgagggccacuucaacgaggugcugcaguucaagacccccuccacccucagcuccacggagagcgccuccguggggcugccgaccgucgagcccuucaagagcuacuucgccaagggcuuccuguccaucgacagcggguacuucagcgccaagugcuacccccgggcguccaacagcggccuccagcugaucaacgugacccagcacuccgcccgcaucgccgacacccccgggccgaagaucacgaaccugaagaccaucaacugcaucaaccucaaggcccugguguucaaggagcaccgggagaucgagaucaacguccugcucccccagguggccgugaaccugagcaacugccacguccacaucaagucccacgugugcgacuacagccuggacaucgacggcaccguccgccucccccggauccaccacgagggcaccuucauccccgggacguacaagaucgugaucgacaagaagaacaagcagaacgaccgcugcaaccuggugaccaacugcgucaucaagggccgggaggugcgcaaggggcaguccgugcugcggcaguaccgcaccgagauccggaucggcaaggcgagcuccgggagccgccgccuccuguccgaggagagcggcgaggacugcaucucccggacccagcugcuccgcacggagaccgccgagauccacggcgacaacuacgggggcccgggggacaagaucaccaucugcaacggcagcaccaucgucgaccagcggcugggguccgagcugggcugcuacacgaucaaccgcgucaagagcuucaagcucugcgagaacuccgccaccggcaagagcugcgagaucgacaacacccccgugaagugcaagcagggguucugccugaagaucacccaggagggccgggggcacgugaagcugagccgcgacuccgagguggugcuggacgccugcgacagcuccugcgagaucaugauccccaagggcacgggcgacauccucgucgacugcagcgggggccagcagcacuuccugaaggacaaccugaucgaccucgggugccccaacaucccgcugcugggcaagauggccaucuacaucugccggauguccaaccaccccaagaccaccauggcguuccucuucugguucagcuucggguacgugaucacgugcauccugugcaaggugaucuucuaccugcucaucgucgugggcacccugggcaagaaguucaagcaguaccgcgagcugaagccccagaccugcaccaucugcgagaccacccccgugaacgccaucgacgccgagaugcacgaccucaacugcuccuacaacaucugcccguacugcgccagccggcugacguccgacgggcuggcgcgccacgucaugcagugccccaagcggaaggagaagaucgaggagaccgagcucuaccugaaccuggagcgcauccccuggguggugcggaagcuccugcaggucagcgaguccaccggcguggcccugaagcgcagcuccuggcucaucgugcugcugguccuccugaccgugagccugucccccgugcagagcgccccgaucgggcacggcaagacgaucgagaccuaccagacccgggagggguacaccuccaucugccucuucguccugggcagcauccuguucaucgugucccaccucaugaagggccugguggacagcgucgggaacagcuucuuccccggccuguccaucugcaagacgugcagcaucggguccaucaacggcuucgagaucgagagccacaagugcuucugcucccucuucugcugccccuacugccgccacugcagcgccgacaaggagauccacaagcugcaccuguccaucugcaagaagcggaaggccgggagcaacgugaugcucgcggugugcaagcgcaugugcuuccgggccaccauggaggucuccaacaaggcccugcugauccgcagcgugaucaacaccaccuucguggucugcauccucauccuggccgugugcguggucuccacgagcgccguggagauggagucccugccggcgggcaccugggagcgcgaggaggaccucaccaacuucugccaccaggagugccaggugaccgagacggagugccugugccccuacgaggcccugguccuccggaagccccuguuccuggacagcaucgccaagggcaugaagaaccuccugaacuccaccagccuggagaccucccucagcaucgaggcccccuggggcgccaucaacgugcaguccaccuucaagccgacggugagcaccgcgaacaucgcccugagcugguccagcgucgagcaccgcgggaacaagauccugguguccgggcggagcgaguccaucaugaagcucgaggagcgcaccggcaucagcugggaccuggggguggaggacgccuccgagagcaagcugcucaccgucuccgugauggaccugagccagauguacucccccguguucgaguaccugagcggcgaccggcaggucgaggaguggcccaaggccacgugcaccggcgacugccccgagcgcugcgggugcaccuccagcacgugccuccacaaggaguggccgcacucccggaacuggcgcugcaaccccaccuggugcuggggcguggggaccggcugcacgugcugcggccuggacgucaaggaccuguucaccgacuacauguucgugaaguggaagguggaguacaucaagaccgaggcgaucgucugcguggagcucaccagccaggagcggcagugcucccugaucgaggccgggacccgcuucaaccugggccccgugaccaucacgcucagcgagccccggaacauccagcagaagcugccgcccgagaucgucacccugcacccccgcaucgaggagggguucuucgaccucaugcacgugcagaaggugcuguccgccagcaccgucugcaagcugcagagcugcacccacggcgugcccggggaccuccagguguaccacaucggcaaccugcugaagggcgacaaggucaacgggcaccucauccacaagguggagccgcacuucaacaccuccuggaugagcugggacggcugcgaccuggacuacuacugcaacaugggggacuggcccuccugcacguacaccggcgugacccagcacaaccacgccgccuucgucaaccugcucaacaucgagaccgacuacacgaagaacuuccacuuccacagcaagcgggugaccgcgcacggggacacgccccagcuggaccugaaggcccgccccaacuacggcgccggcgaggugaccguccucguggagguggccgacauggagcugcacaccaagaagaucgagaucuccgggcugaaguucgccagccugaccugcaccggcugcuacgcgugcuccagcgggaucuccugcaagguccggauccacguggacgagccggacgagcucaccgugcacgucaagagcgaggaccccgacaucguggccgccuccagcucccugauggcccgcaagcucgaguucggcacggacagcaccuucaaggccuucuccgcgaugcccaagaccagccugugcuucuacaucguggagcgggaguacugcaaguccugcagcaaggaggacacccagaagugcgucaacgccaagcuggagcgcccccaguccauccucaucgagcacaaggggacgaucaucggcaagcagaacgacacgugcaccgccaaggccagcugcuggcuggagagcgugaaguccuucuucuacggccugaagaacaugcucagcgggaucuucggcaacguguucaucgggaucuuccuguuccuggcgccguucauccugcucauccuguucuucauguucggcuggcggauccuguucugcuucaagugcugccgccggacccgcggccucuucaaguaccgccaccugaaggacgacgaggagaccggguaccggaagaucaucgagcgccugaacaacaagaagggcaagaacaagcuccuggacggggagcggcuggccgaccgcaagaucgccgagcuguucuccaccaagacccacaucggcuga

SEQ ID NO: 11987 - RNA, 5064 nt, Artificial Sequence
  derived and/or modified CDS sequence (opt1) from CCHFV(3820-ST-2007)__KR814868.1__GP
augcccaucaacaucaugcacacccugcucgugugcuucauccuguaccugcagcucagcggccuggggggcgcccacgggcaguccaacgccaccgagcacaacggcacgaacaccaccaccgucccggggacgagccagucccccaagccccccgcgagcaccacccugccgcacacccccgaguccagcacggugaagcucaccacccccaccuccgagacggagggcagcggcgagaccacccccccgaacaccacgcaggggcugccccugcccggcaccacccccgagcgcuccgccaccacggccaccagcaccuccagcaccgacaacaugaacuccacgacccaggugaccgacaacaccccgacgagcaccgucuccaucagccccuccagcuccagcagcaugcccuccaccagccaggggauccaccaccccgugcggucccuccugagcguguccagcccgaagaccgucacgacccccacccccaugucccccggcgagaugagcccggagaccuccagccagcacuccgccaugagccgcgugcccacgcuguacaccgccacccagaucuccaccgagaacaccgaccggagcacgccccgccaguccgagagcuccgugcagcccgcgacccagagcccgaucaccucccccgcccagaccauccuccugaugagcgccgcccccaaggcgauccaggacaugcaccccagcccgacgaaccgguccaagcgcaaccuggaggucgagaucauccucacccugagccaggggcugaagaaguacuacggcaagauccucaagcugcugcaccucacccuggaggaggacaccgagggccugcucgaguggugcaagcggaaccugggguccaacugcgacgacgacuucuuccagaagcgcaucgaggaguucuucaucacgggcgagggguacuucaacgaggugcugcaguucaagacccucagcacccugucccccaccgagcccagccacgugcggcugccgacggccgagcccuucaaguccuacuucgccaagggcuuccucagcaucgacuccggcuacuucagcgccaagugcuacccccgcuccagcaccuccgggcugcagcugaucaacgucacccagcaccccgcccggaucgcggagaccccgggccccaagacgaccagccucaagaccaucaacugcaucaaccugcgcgccuccguguucaaggagcaccgggagguggagaucaacguccugcucccccagaucgccgugaaccugagcaacugccacguggucaucaacucccacgugugcgacuacagccuggacaccgacgggcccgugcgccucccgcggauccaccacgagggcacguucauccccgggaccuacaagaucgucaucgaccgcaagaacaagcugaacgaccggugcagccuggugaccaacugcgugaucaagggccgcgagguccggaagggccaguccgugcuccgccaguacaagaccgagaucaagaucgggaagacgagcaccggcucccggaagcugcugagcgaggagcccggggacgacugcaucucccgcacccagcuccugaagaccgagacggccgagauccacgacgacaacuacggcagccccggggacaagaucaccaucugcaacggcuccaccaucgucgaccagcgccugggcagcgagcucgggugcuacaccaucaaccgggugaaguccuucaagcugugcgagaacagcgccacgggcaagaccugcgagaucgacuccaccccggugaagugccgccagggguucugccugaagaucacccaggagggccgggggcacgucaagcugagccgcggcuccgagguggugcucgacgcgugcgacagcuccugcgagaucaugauccccaagggcacgggggacauccuggucgacugcagcggcgggcagcagcacuuccugaaggacaaccucaucgaccugggcugcccccacaucccccugcucggcaagauggccaucuacaucugccggauguccaaccacccgcgcaccaccauggccuuccuguucugguucagcuucggguacgugaucaccugcaucuucugcaaggcccuguucuacucccucaucaucaucggcacccuggggaagaagaucaagcaguaccgggagcugaagccccagacgugcaccaucugcgagaccgcccccgugaacgcgaucgacgccgagaugcacgaccucaacugcagcuacaacaucugccccuacugcgccagccgccugaccuccgacggccuggcccggcacgucacgcagugcccgaagcgcaaggagaagguggaggagaccgagcucuaccugaaccuggagcggauccccuggaucgugcgcaagcuccugcaggucagcgaguccaccgggguggcccugaagcggagcuccuggcucaucgugcugcugguccuccuggcggugagccugucccccgugcagagcgcccccgucggccacggcaagaccaucgagacguaccagacccgcgagggguucaccuccaucugccucuucaugcugggcagcauccuguucaucguguccugccucgugaaggggcuggucgacagcguguccgacagcuucuucccgggccuguccgugugcaagaccugcagcaucggguccaucaacggcuucgagaucgagagccacaagugcuacugcucccucuucugcugccccuacugccggcacugcagcgccgaccgcgagauccaccagcugcaccugagcaucugcaagaagcggaagacgggcuccaacgucaugcucgccgugugcaagcgcaugugcuucaaggcgaccaucgaggccagccggcgcgcccugcugauccgcuccaucaucaacaccaccuucgugaugugcauccucacgcuggccaucugcgucgugagcaccuccgccguggagauggaggaccugcccgcggggaccugggagcgggaggaggaccucaccaacuucugccaccaggagugccaggucacggagaccgagugccugugcccguacgaggcccuggugcuccgcaagccccuguuccuggacagcaucgugaagggcaugaagaaccuccugaacuccaccagccuggagaccucccucagcaucgaggcccccuggggggccaucaacguccaguccacguucaagcccaccgugagcaccgccaacaucgcgcuguccuggagcuccguggagcaccggggcaacaagauccuggucaccgggcgcagcgaguccaucaugaagcucgaggagcggacgggcgugagcugggaccugggcguggaggacgccuccgagagcaagcugcucaccgucagcaucauggaccugucccagauguacagcccgguguucgaguaccuguccggggaccgccagguggaggaguggcccaaggccaccugcaccggcgacugccccgagcggugcgggugcacgagcuccaccugccuccacaaggaguggccccacagccgcaacuggcggugcaacccgaccuggugcuggggcgucgggaccggcugcacgugcugcggcguggacgugaaggaccuguucaccgaccacauguucaucaaguggaaggucgaguacaucaagaccgaggccaucgugugcguggagcugaccucccaggagcgccagugcagccucaucgaggccgggacccgguucaaccugggccccgucacgaucacccuguccgagccccgcaacauccagcagaagcuccccccggagaucaucacccugcaccccaagaucgaggagggguucuucgaccugaugcacgugcagaaggugcucagcgcguccaccgucugcaagcugcagagcugcacgcacggcauccccggcgaccugcagaucuaccacaucgggaaccuccugaagggcgaccgggugaacgggcaccugauccacaagaucgagccccacuucaacaccuccuggaugagcugggacggcugcgaccucgacuacuacugcaacaugggggacuggccguccugcaccuacaccggcgucacgcagcacaaccacgccgccuucgugaaccugcugaacaucgagaccgacuacaccaagaccuuccacuuccacagcaagcgcgugacggcccacggcgacaccccccagcucgaccugaaggcgcggcccaccuacggggccggcgagaucaccguccugguggagguggccgacauggagcuccacacgaagaaggucgagaucuccgggcugaaguucgccagccugaccugcaccggcugcuacgccugcuccagcgggaucagcugcaaggugcgcauccacguggacgagcccgacgagcucaccguccacgugaaguccagcgacccggacguggucgcggccuccacgagccugauggcccggaagcuggaguucggcaccgacuccaccuucaaggccuucagcgccaugcccaagaccucccucugcuucuacaucguggagcgcgaguacugcaagagcugcuccgaggacgacacgaagaagugcguggacaccaagcuggagcagccccagagcauccugaucgagcacaagggcaccaucaucgggaagcagaacgacaccugcacggcgaaggccuccugcuggcucgagagcgucaaguccuucuucuacggccugaagaacaugcuggggagcguguucggcuccuucuucguggggauccuccuguuccuggcccccuucguccugcucgugcuguucuucauguucggcuggaagauccuguucugcuucaagugcugccggcgcacccggggccucuucaaguaccgccaccugaaggacgacgaggagaccggguaccgccggaucaucgagcgccugaacagcaagaagggcaagaaccggcuccuggacggggagcgccuggccgaccggaagaucgccgagcucuucuccaccaagacgcacaucggcuga

SEQ ID NO: 11988 - RNA, 5058 nt, Artificial Sequence
  derived and/or modified CDS sequence (opt1) from CCHFV(SR3)__AJ538199.1__GP
augcacaucagccugauguacgccguguucugccuccagcugugcggccuggggaagaccaacggcccccacaacgggaccgagcacaacaacacgcacgucaugaccaccccggacgacucccagagccccgagccccccguguccaccgcccucccggugacgcccgaccccagcaccgucacccccuccaccccggcgagcggccuggagggguccggcgagguguacacgagcucccccaucaccaccaagggccugagccuccccgaggccaccuccgagcccccggccacgaccagcguggucaccuccagcgccuccgacaccgacagcuccacgcaggccgcgggggacacccccacccccaccgugcgcacgagccugcccuccagcccgagcacccccuccaccagccagggcacccacuaccccgugcggucccugcucagcgucacgucccccaagccggaggagacccccacccccagcaaguccgggaaggacgaccuggccaccaacagcccccacccggccacgucccgccccaccaccccccccaccacggcccagaagccgaccgagaacaacagccacaacaccaccgagcagcuggagucccucacgcaccuggcgacccugggccucaugaucagccccacccagaccgugcugccccaguccgugaccagcaucgccauccaggacauccacaacuccccgacgaaccggagcaagcgcaaccuggacauggagaucauccucacccugucccaggggcugaagaaguacuacggcaagauccucaagcugcugcaccucacccuggaggaggacaccgagggccugcucgaguggugcaagcggaaccuggggcuggacugcgacgacacguucuuccagaagcgcaucgaggaguucuucaucaccggcgaggggcacuucaacgagguccuccaguuccggacccugggcacccugagcacgaccgaguccacccacgccggcagccccaccguggagcccuucaagagcuacuucgccaagggguuccucuccaucgacagcggcuacuucuccgccaagugcuacagccgcacguccaacagcgggcugcagcugaucaacgugacccggcacuccacccgcaucgcggacacccccggcccgaagaucacgaaccucaagaccaucaacugcaugaaccugaaggccagcgucuucaaggagcaccgggagguggagaucaacgugcugcucccccaggucgccgugaaccuguccaacugccacguggccaucaagagccacaucugcgacuacucccuggacaccgacggggccauccgccucccccagauccaccacgagggcaccuucauccccggcacguacaagaucgucaucgacaagaagagccggcugaacgaccgcugcacccuguucaccaacugcgugaucaaggggcgggaggugcgcaagggccaguccguccuccggcaguacaagaccgagauccgcaucgggcgggcgagcacgggcucccgccggcugcugagcgaggaguccggggacgacugcaucagccgcacccagcuccugcgcaccgagaccgccgaggugcacggcgacaacuacggcgggccgggcgacaagaucacgaucugcaacgggagcaccgucguggaccagcggcugggcuccgagcuggggugcuacaccaucaaccgcgugcggagcuucaagcucugcgagaacuccgccaccggcaagagcugcgagaucgacuccauccccgucaagugcaagcagggcuacugccugaagaucacgcaggaggggcgcggccacgugaagcugagccggggguccgaggugguccucgacgugugcgacagcuccugcgaggugaugauccccaagggcaccggcgacauccuggucgacugcagcgggggccagcagcacuuccugaaggacaaccucguggaccuggggugccccaagaucccgcugcucggcaagauggccaucuacaucugccgcauguccaaccaccccaagaccaccauggccuuccuguucugguucagcuucggguacgugaucacgugcauccugugcaaggcgaucuucuuccuccugaucaucuucggcacccugggcaagcgguucaagcaguaccgcgagcucaagccccagaccugcaccaucugcgagaccacgcccgucaacgccaucgacgccgagaugcacgaccugaacugcuccuacaacaucugcccguacugcgccagccggcugaccuccgacgggcucgcccgccacgugacccagugcccccggcgcaaggagaagguggaggagaccgagcuguaccugaaccucgagcggauccccugggucgugcgcaagcugcugcaggugagcgaguccacgggcaccguccucaagcggagcuccuggcugaucgugcugcucgugcuguucaccgucagccugagccccgugcaguccgcgccgaucgggcacggcaagaccaucgagacguaccgcgugcgggaggaguacaccagcaucugccucuucguccugggguccauccuguucaucgugagcuuccucaugaagggccugguggacggcgucgggaacaucuucuuccccggccuguccgugugcaagaccugcagcaucggguccaucaacggcuucgagaucgagagccacaagugcuacugcucccucuucugcugccccuacugccgccacugcagcgccgacggggagauccaccagcugcaccuguccaucugcaagaagcggaagaccggcagcaacgugaugcucgccgucugcaagcgcaugugcuuccgcgccacgauggagguguccaacaaggcgcuguucauccggagcaucaucaacaccaccuucgugaugugcauccugaagggcgaguucgccgccgucaaguccauccaccccaucgagauggagagccucccggccgggaccugggagcgcgaggaggaccugacgaacuucugccaccaggagugccaggugaccgagaccgagugccugugccccuacgaggcccucgugcugcggcgcccccuguuccucgacuccaucgucaagggcaugaagaaccugcugaacagcaccucccucgagacgagccugagcaucgaggcgccguggggggccaucaacgugcaguccaccuacaagcccaccgugagcaccgccaacaucgcccuguccuggagcuccgucgagcaccggggcaacaaggugcucgugagcgggcgcuccgagagcaucaugaagcuggaggagcggacgggcaucuccugggaccugggcgucgaggacgccagcgaguccaagcuccugaccgugagcgugauggaccugucccagauguacagccccgucuucgaguaccucuccggggaccgccagguggaggaguggcccaaggcgaccugcaccggcgacugcccggagcggugcgggugcacgagcuccaccugccugcacaaggaguggccccacagccgcaacuggcggugcaaccccaccuggugcuggggcgugggcaccgggugcacgugcugcggccuggacgucaaggaccucuucaccgacuacauguucgugaaguggaagguggaguacaucaagaccgaggccaucgucugcguggagcugaccucccaggagcgccagugcagccugaucgaggccgggacgcgguucaaccucggcagcgucaccaucacccuguccgagccccgcaacauccagcagaagcugccgcccgagaucaucacccuccaccccaagaucgaggagggguucuucgaccugaugcacgugcagaaggugcugagcgccuccaccgucugcaagcuccagagcugcacgcacggcgugcccggcgaccugcagguguaccacaucgggaaccugcucaagggcgaccgggucaacgggcaccugauccacaagaucgagcagcacuucaacaccuccuggaugagcugggacggcugcgaccuggacuacuacugcaacaugggggacuggccguccugcaccuacaccggcgugacgcagcacaaccacgccagcuucgugaaccuccugaacaucgagaccgacuacaccaagaccuuccacuuccacuccaagcgcgucacggcgcacggcgacaccccccagcuggaccucaaggcccggcccaccuacggggccggcgagaucaccgugcugguggaggucgccgacauggagcugcacacgaagaagaucgagaucagcgggcucaaguucgcgggccugaccugcaccgggugcuacgccugcuccagcggcaucuccugcaaggugcgcauccacguggacgagcccgacgagcugaccguccacgugaagagcgacgacccggacguggucgccgccuccagcucccucauggcccggaagcuggaguucggcacggacagcaccuucaaggcguucuccgccaugcccaagaccagccugugcuucuacaucguggagcgcgaguacugcaagagcugcaacaaggaggacacccagaagugcgugaacacgaagcucgagcagccccaguccauccugaucgagcacaaggggaccaucaucggcaagcagaacaacaccugcaccgccaaggccagcugcuggcuggaguccgucaagagcuucuucuacgggcucaagaacaugcugggcggcaucuucgggaacguguucaucggcaucuucacguuccugacccccuucauccugcucauccuguucuucauguucggguggcggauccuguucugcuucaagugcugccgccgcacccggggccucuucaaguaccgccaccugaaggacgacgaggagaccggguaccggaagaucaucgagcgccugaacaacaagaagggcaagaaccggcuccuggacggcgagcgccuggccgaccggaagaucgcggagcucuucuccacgaagacccacaucggguga

SEQ ID NO: 11989 - RNA, 5055 nt, Artificial Sequence
  derived and/or modified CDS sequence (opt1) from CCHFV(SPU 187/90)__KJ682814.1__GP
augcacaucagccucauguacgccgugcucugccugcagcugugcucccucggcgagacccaccgcagccacaacgagaucgggcacaacaagaccgacgucaugacgacccccggcgacaaccuguccagcgagcagccgguguccaccgcccugagcaucacccccgaccccuccacggugacccccaccaccccggcgagcggguccgagggcagcggggaggucuacacguccagccccaucaccaccgagucccucagccugcccgagaccacgcccgagcugccggccaccaccggcaucgacuccagcuccgccagcggcguggacuccagcacccaggccgccgggggcacgagcgcgcucaccgugcggaccucccugcccaacagccccuccacccccagcacgccgcaggacaccuaccaccccguccgcauccugcucuccgugaccgggcccggccccgaggagaccagcacgccguccgggagcggcaaggaguccagcgccaccuccagccugcaccccaucuccgaccggcugcccacgcccccggccaccgcccagggccccaccgagaacaacagccacaacgcgaccgagcaccccaagccccucacccaguccgccaccccggggcugaugacgagccccacccagaucgugcacccccaguccgccaccagcaucaccguccaggacacguaccccuccccgaagaaccgcagcaagcggaaccuggagauggagaucauccucacccugagccagggccugaagaaguacuacgggaagauccuccgccugcugcggcucacccuggaggaggacaccgagggccugcucgaguggugcaagcgcaaccugggccuggacugcgacgacaccuucuuccagaagcggaucgaggaguucuucaucacgggggagggccacuucaacgaggugcuccaguucaagacccccgggacccuguccaccacggagagcacccccgccgagcugccgaccgccgagcccuucaaguccuacuucgcgaagggcuuccucagcaucgacuccggguacuacagcgccaagugcuacuccggcaccagcaacuccggccugcagcugaucaacaucacgcgccacagcacccggaucguggacacccccgggcccaagaucaccaaccucaagacgaucaacugcaucaaccugaaggccuccaucuucaaggagcaccgcgaggucgagaucaacgugcugcucccgcagaucgccgugaaccugagcaacugccacgucgugaucaagucccacgugugcgacuacagccuggacaucgacggcaccguccggcucccccacaucuaccacgaggggguguucauccccggcaccuacaagaucgugaucgacaagaagaacaagcugaacgaccgcugcacccuguucacgaacugcgucaucaaggggcgggaggugcgcaagggccaguccgugcuccggcaguacaagaccgagauccgcaucggcaaggccagcaccgggucccggcgccugcugagcgaggagcccagcgacgacugcaucucccggacccagcuccugcgcacggagaccgcggagauccacggcgacaacuacgggggcccgggggacaagaucaccaucugcaacggcagcaccaucgucgaccagcgccugggcuccgagcuggggugcuacacgaucaaccgggucaagagcuucaagcucugcgagaacuccgccaccggcaagagcugcgagaucgacuccgugcccgugaagugccgccagggguacugccugcggaucacccaggagggccgcggccacgugaagcugagccggggguccgaggucgugcucgacgccugcgacaccagcugcgagaucaugauccccaagggcacgggggacauccugguggacugcuccggcgggcagcagcacuuccugaaggacaaccucaucgaccugggcugccccaagaucccgcugcucggcaagauggccaucuacaucugccgcaugagcaaccaccccaagaccaccauggccuuccuguucugguucuccuucggguacgucaucacgugcauccugugcaaggcgaucuucuaccuccugaucaucaucggcacccuggggaagcgguucaagcaguaccgcgagcucaagccccagaccugcaccaucugcgagaccacgcccgugaacgccaucgacgccgagaugcacgaccugaacugcagcuacaacaucugcccguacugcgccucccggcugaccagcgacggccucgcccgccacgugacccagugccccaagcggaaggagaaggucgaggagaccgagcuguaccugaaccucgagcgcauccccuggguggugcggaagcugcugcaggucuccgagagcaccgggguggcgcucaagcgcuccagcuggcugaucgugcugcucguccuguucacggugagccugucccccgugcagagcgccccgaucggccacggcaagaccaucgaggccuaccgggcccgcgagggguacaccuccaucugccucuucguccugggcagcauccuguucgugguguccugccucaugaaggggcuggucgacagcgugggcaacuccuucuuccccgggcugagcaucugcaagaccugcuccaucggcagcaucaacggcuucgagaucgagucccacaagugcuacugcagccucuucugcugccccuacugccggcacugcuccgcggacaaggagauccacaagcugcaccugagcaucugcaagaagcgcaagacgggguccaacgugaugcucgccgucugcaagcggaugugcuuccgcgccaccauggaggugagcaaccgcgcccuguucauccgguccaucaucaacaccaccuucgugcugugcauccucauccuggccgucugcguggugagcacguccgcggucgagauggagaaccugcccgccggcaccugggagcgcgaggaggaccucaccaacuucugccaccaggagugccaggugaccgagacggagugccugugcccguacgaggcccuggugcuccggcgcccccuguuccuggacagcaucgucaaggggaugaagaaccuccugaacagcaccucccuggagaccagccucuccaucgaggcccccuggggcgccaucaacgugcagagcaccuacaagccgacgguguccaccgcgaacaucgcccugagcugguccagcgucgagcaccgggggaacaagauccugguguccggccgcagcgaguccaucaugaagcucgaggagcggaccggcaucagcugggaccuggggguggaggacgccuccgagagcaagcugcucaccgucuccgugauggaccugagccagauguacucccccguguucgaguaccugagcggcgaccgccaggucgaggaguggcccaaggccacgugcaccggggacugccccgagcggugcggcugcaccuccagcacgugccuccacaaggaguggccgcacagccgcaacuggcggugcaaccccaccuggugcuggggcguggggaccggcugcacgugcugcgggcuggacgugaaggaccuguucaccgacuacauguucgucaaguggaagguggaguacaucaagaccgaggccaucgugugcgucgagcucaccucccaggagcgccagugcagccugaucgaggcgggcacccgguucaaccuggggcccgugaccaucacgcucuccgagccccgcaacauccagcagaagcugccgcccgagaucaucacccugcacccccggaucgaggagggcuucuucgaccucaugcacgugcagaagguccugagcgccuccaccgugugcaagcugcagagcugcacccacggcguccccggggaccuccagguguaccacaucggcaaccugcugaagggggacaaggugaacggccaccucauccacaagaucgagccgcacuucaacacguccuggaugagcugggacgggugcgaccuggacuacuacugcaacaugggcgacuggcccuccugcaccuacaccggcgucacccagcacaaccacgccagcuucgugaaccugcucaacaucgagaccgacuacacgaagaacuuccacuuccacuccaagcgcgugaccgcccacggggacacgccccagcuggaccugaaggcgcggcccaccuacggcgccggggagaucaccguccucguggagguggccgacauggagcugcacaccaagaagaucgagaucagcggccugaaguucgccucccugaccugcaccgggugcuacgccugcagcuccggcaucagcugcaagguccgcauccacguggacgagccggacgagcucacggugcacgucaaguccgacgaccccgacgugguggcggccagcuccagccugauggcccggaagcucgaguucggcaccgacagcaucuucaaggccuucuccgccaugcccaagaccagccugugcuucuacaucgucgagcgcgagcacugcaaguccugcagcgaggaggacaccaagaagugcgugaacacgaagcuggagcagccccaguccauccucaucgagcacaaggggaccaucaucggcaagcagaacagcacgugcaccgcgaagaccuccugcuggcuggagagcgugaaguccuucuucuacgggcugaagaacaugcugagcggcaucuucggcaacgucuucaucgggaucuuccucuuccuggccccguucauccugcucauccuguucuucauguucggcuggcggauccuguucugcuucaagugcugccgccgcacccggggccucuucaaguaccgccaccugaaggacgacgaggagaccggguaccggcgcaucaucgagcggcugaacaacaagaaggggaagaacaagcuccuggacggcgagcgccuggccgaccggcgcaucgccgagcuguucuccaccaagacgcacaucggcuga

SEQ ID NO: 11990 - RNA, 5055 nt, Artificial Sequence
  derived and/or modified CDS sequence (opt1) from CCHFV(SPU 48/90)__KJ682813.1__GP
augcacaucagccugauguacgccgugcucugccugcagcugugcggccucggggagacccaccgcucccacaacgagaccggccacaacaagacggacgucgccaccacccccggggacaaccugagcuccgagcagcuggugagcaccgcgcucuccaucacgccggaccccagcaccgugacccccaccacguccgccagcggccuggagggguccggcgaggucuacaccagcucccugaucaccaccgagagccucucccugcuggagacgacccccaagcucccgaccaccacgggcaucgacaccagcuccgccagcgacguggacuccagcacccaggccgccggggacaccuccgcgcugacggugcggaccagcccgcccagcaaccccuccacccccagcacgccccaggacacccaccaccccaugcgcaaccugcucuccgucaccagccccggcccggaggagaccuccacccccagcggguccggcaaggagagccccgccacguccagcccccacccgguguccaaccggagccagaccccgcccgccaccgcccaggggcccaccgaggacaacuccuacaacgcgacggagcaccccgagcaccugacccagagcgccaccuccggccugaugaccagccccacgcagaucgugcacccccaguccgccaccagcaucaccguccaggacaccuaccccuccccgaccaaccgcagcaagcggaaccucgagauggagaucauccugacgcugagccagggccucaagaaguacuacgggaagauccugcgccugcuccggcugacccuggaggaggacaccgagggccuccuggaguggugcaagcgcaaccuggggcucgacugcgacgacaccuucuuccagaagcggaucgaggaguucuucaucacgggcgagggccacuucaacgaggugcugcaguucaagacccccgggacccuguccaccacggagagcacccccgccgagcccccgaccgccgagcccuucaaguccuacuucgcgaagggcuuccucagcaucgacuccggguacuacagcgccaagugcuacuccggcaccagcaacuccgggcugcagcugaucaacaucacgcgccacagcaccaagaucgccgacacccccggcccgaagaucaccaaccucaagacgaucaacugcaucaaccugaaggccuccaucuucaaggagcaccgggagguggagaucaacguccugcucccccagguggccgugaaccugagcaacugccacgucgugaucaagucccacgugugcgacuacccccuggacaucgacggcaccguccgccucccccacaucuaccacgaggggguguucaucccgggcaccuacaagaucgugaucgacaagaagaccaagcugaacgaccggugcacgcuguucaccgacugcgucaucaaggggcgcgaggugcggaagggccagagcgugcuccgccaguacaagaccgagauccggaucgggaagaccuccacgggcagccgccggcugcuguccgaggagcccagcgacgacugcaucagccgcacccagcuccugcggaccgagaccgcggagauccacggcgacaacuacgggggccccggggacaagaucacgaucugcaacggcuccaccaucgucgaccagcgccuggggagcgagcugggcugcuacaccaucaaccgcgugaaguccuucaagcucugcgagaacagcgccaccggcaaguccugcgucaucgacagcgugcccgugaagugccggcagggguacugccugcgcaucacgcaggagggccgggggcacgucaagcugucccgcggcagcgagguggugcucgacgccugcgacaccuccugcgagaucaugaucccgaagggcaccggggacauccuggucgacugcagcggcgggcagcagcacuuccugaaggacaaccucaucgaccugggcugccccaagaucccccugcucgggaagauggccaucuacaucugccggauguccaaccaccccaccacgaccauggccuuccuguucugguucagcuucggcuacgugaucacgugcauccugugcaaggcgaucuucuaccuccugaucaucaucggcacccuggggaagcgcuuccggcaguaccgcgagcucaagccgcagaccugcaccaucugcgagaccacccccgugaacgccaucgacgccgagaugcacgaccugaacugcuccuacaacaucugccccuacugcgccagccggcugaccuccgacggccucgcccgccacgucacgcagugccccaagcggaaggagaagguggaggagaccgagcuguaccugaaccucgagcgcaucccgugggugguccggaagcugcuccaggugagcgaguccaccgggguggcgcucaagcgcagcuccuggcugaucguccugcucgugcuguucaccgugagccugagccccguccaguccgcccccaucggccacgggaagacgaucgaggccuaccgggcccgcgagggcuacaccagcaucugccucuucgugcugggcuccauccuguucguggucagcugccucaugaagcggcugguggacuccguggggaacagcuucuuccccggccuguccaucugcaagaccugcagcaucuccagcaucaacggguucgagaucgagucccacaagugcuacugcagccucuucugcugcccguacugccgccacugcuccgcggacaaggagauccacaagcugcaccugagcaucugcaagaagcggaagaccggcuccaacgucaugcucgccgugugcaagcgcaugugcuuccgcgccacgauggaggugagcgaccgggcccuguucauccgcuccaucaucaacaccaccuucguccugugcauccucauccuggccgugugcguggucagcaccuccgcgguggagauggagaaccugcccgccgggacgugggagcgggaggaggaccucaccaacuucugccaccaggagugccaggugaccgagaccgagugccugugccccuacgaggcccugguccuccgcaagccccuguuccgggacagcaucgugaagggcaugaagaaccugcucaacagcacgucccuggagaccagccuguccaucgaggccccguggggcgccaucaacgugcagagcaccuacaagcccaccgucuccacggcgaacaucgcccucagcugguccagcguggagcaccgcgggaacaagauccugguguccggccggagcgaguccaucaugaagcuggaggagcgcaccgggaucagcugggaccucggcgucgaggacgccuccgagagcaagcugcugaccguguccgugauggaccucagccagauguacucccccgucuucgaguaccugagcggggaccgccagguggaggaguggccgaaggcgaccugcacgggcgacugccccgagcggugcggcugcaccuccagcacgugccugcacaaggaguggccccacagccggaacuggcgcugcaaccccaccuggugcuggggcguggggaccgggugcacgugcugcggccucgacgucaaggaccuguucaccgacuacauguucgugaaguggaagguggaguacaucaagaccgaggccaucgucugcguggagcugaccucccaggagcggcagugcagccucaucgaggccggcacccgcuucaaccuggggccggugaccaucacccuguccgagccccggaacauccagcagaagcucccgcccgagaucaucacccugcacccccgcaucgaggagggcuucuucgaccugaugcacguccagaaggugcucagcgccuccacggucugcaagcugcagagcugcacccacggggugcccggcgaccuccagguguaccacaucgggaaccugcugaagggcgacaaggucaacggccaccugauccacaagaucgagccccacuucaacaccuccuggaugagcugggacgggugcgaccucgacuacuacugcaacaugggcgacuggcccuccugcaccuacacgggggugacccagcacaaccgggccagcuucgugaaccugcugaacaucgagaccgacuacaccaagaacuuccacuuccacuccaagcgcgucacggcccacggcgacaccccgcagcucgaccugaaggcgcggcccaccuacggggccggcgagaucaccgugcugguggaggucgccgacauggagcuccacacgaagaagaucgagaucagcggccugaaguucgccucccugaccugcaccgggugcuacgccugcagcuccggcaucagcugcaaggugcgcauccacguggacgagcccgacgagcucaccguccacgugaaguccgacgaccccgacguggucgcggccagcuccagccugauggcccggaagcuggaguucgggacggacagcaccuucaaggccuucuccgccaugccgaagaccagccucugcuucuacaucguggagaaggaguacugcaaguccugcagcgaggaggacaccaagaagugcgugaacacgaagcuggagcagccccaguccauccugaucgagcacaagggcaccaucaucgggaagcagaacuccacgugcaccgcgaaggucagcugcuggcucgagagcgccaaguccuucuucuacggccugaaggacaugcugagcggcaucuucgggaacguguucaucggcaucuuccuguuccucgcccccuucauccugcugauccucuucuucauguucggguggcgcauccugcugugcuucaagugcugccgccggacccgcggccucuucaaguaccggcaccugaaggacgacgaggagaccggcuaccgccggaucaucgagcgccugaacaacaagaaggggaagaacaagcuccuggacggcgagcggcuggccgaccgccggaucgccgagcuguucuccaccaagacccacaucggguga

SEQ ID NO: 11991 - RNA, 5055 nt, Artificial Sequence
  derived and/or modified CDS sequence (opt1) from CCHFV(Sudan AB1-2009)__HQ378187.1__GP
augcacaucagccucaucuacgccauccucugccugcagcugugcggccucggggagacccacggcucccacaacgagacccgccacaacaagacggacaccaucaccacccccggggacaaccugagcuccgagccgagcguguccacggcccugagcaucacccccgaccccuccaccgucacccccacgaccccggcgagcggccucgagggguccggcgagguguacaccagcccgcccaucaccacgggcucccugccccugcccgggaccacccccgagcuccccgccaccacgggcaccgacaccagcuccgccagcgacguggacuccagcacccagacggccgggggcaccuucacccugaccguccggacgucccugccccgcagcccguccacccccagcacgccccaggacacccaccaccccgugcggaaccuccugagcgugaccuccccggggcccgacgagaccagcacccccuccggcaccggcaaggagagccccgccacguccagcccgcaccccgucuccaaccgcccgcccaccccgcccgcgaccgcccaggggcccaccgagaacgacagccacaacgccacggagcaccccgagucccugacccagagcgccaccaccggccccaugaccucccccacgcagaucgugcacccccagagcgcgaccccgaucaccgugcaggacacccaccccucccccacgaaccggagcaagcgcaaccucgagauggagaucauccugacccugucccaggggcucaagaaguacuacggcaagauccugcggcugcuccaccugacccuggaggaggacaccgagggccuccuggaguggugcaagcgcaaccuggggcucgacugcgacgacacguucuuccagaagcggaucgaggaguucuucaucaccggcgaggggcacuucaacgagguccugcaguuccgcacccccggcacccugagcacgaccgaguccaccccggccgggcuccccaccgccgagcccuucaagagcuacuucgccaagggcuuccuguccaucgacagcggcuacuacagcgccaagugcuacuccgggacgagcaacuccggccugcagcucaucaacaucacccggcacagcacccgcaucguggacacccccgggccgaagaucacgaaccugaagaccaucaacugcaucaaccugaaggcguccaucuucaaggagcaccgggagguggagaucaacguccuccugccccagguggccgugaaccugagcaacugccacgucgugaucaagucccacgugugcgacuacagccucgacaucgacggcgccguccgccugccccacaucuaccacgaggggguguucauccccggcaccuacaagaucgugaucgacaagaagaacaagcugaacgaccggugcacccucuucacgaacugcgucaucaagggccgcgaggugcggaaggggcaguccgugcugcgccaguacaagaccgagguccggaucggcaaggccagcaccgggucccgccggcugcucagcgaggagccguccgacgacugcaucagccgcacccagcugcugcgcacggagaccgccgagauccacggcgacaacuacgggggccccggcgacaagaucaccaucugcaacggguccaccaucguggaccagcggcucggcagcgagcuggggugcuacacgaucaaccgcgucaaguccuucaagcugugcgagaacagcgcgaccggcaagaacugcgagaucgacagcgugcccgugaagugccggcagggcuacugccugcgcaucacccaggaggggcggggccacgucaagcucucccgcgggagcgagguggugcuggacgccugcgacaccuccugcgagaucaugauccccaagggcacgggggacauccuggucgacugcagcggcggccagcagcacuuccucaaggacaaccugaucgaccuggggugcccgaagaucccccuccugggcaagauggccaucuacaucugccggauguccaaccaccccaagaccaccauggccuuccuguucugguucagcuucggguaccucaucacgugcauccugugcaaggccaucuucuaccugcucaucaucaucggcacccuggggaagcgccugaagcaguaccgggagcucaagccccagaccugcaccaucugcgagaccaccccggugaacgcgaucgacgccgagaugcacgaccugaacugcuccuacaacaucugccccuacugcgccagccgccugacguccgacggccucgcccggcacgugauccagugccccaagcgcaaggagaaggucgaggagaccgagcuguaccugaaccucgagcggauccccuggguggugcgcaagcugcugcaggucagcgaguccaccggcguggcccucaagcggagcuccuggcugaucgugcugcucguccuguucaccgugagccuguccccggugcagagcgcgcccaucgggcagggcaagacgaucgaggccuaccgcgcccgggagggguacaccuccaucugccucuucguccugggcagcauccuguucaucguguccugccucaugaaggggcugguggacagcgucggcaacagcuucuuccccggccuguccaucugcaagaccugcagcaucuccagcaucaacggguucgagaucgagucccacaagugcuacugcagccucuucugcugcccguacugccgccacugcuccaccgacaaggagauccacaagcugcaccugagcaucugcaagaagcggaagacgggcuccaacgugaugcucgccgugugcaagcgcaugugcuuccgcgcgaccauggaggucagcaaccgggcccuguucauccgcuccaucaucaacaccaccuucgugcugugcauccucauccuggccgugugcgucgugagcacguccgccguggagauggagaaccugcccgccgggaccugggagcgggaggaggaccucaccaacuucugccaccaggagugccaggucaccgagacggagugccugugccccuacgaggcgcuggugcuccgcaagccccuguuccuggacagcaucgccaagggcaugaagaaccuccugaacuccaccagccuggagaccucccucagcaucgaggccccguggggcgccaucaacgugcaguccaccuacaagcccacggucagcaccgccaacaucgcgcugagcugguccagcguggagcaccgggggaacaagauccugguguccggccgcagcgaguccaucaugaagcucgaggagcggaccgggaucagcugggaccugggcgucgaggacgccuccgagagcaagcugcucaccguguccgugauggaccugagccagauguacucccccgucuucgaguaccugagcggggaccgccagguggaggaguggcccaaggccacgugcaccggcgacugcccggagcggugcggcugcaccuccagcacgugccuccacaaggaguggccccacucccgcaacuggcggugcaaccccaccuggugcuggggcguggggaccgggugcacgugcugcggccuggacgucaaggaccuguucaccgacuacauguucgugaaguggaagguggaguacaucaagaccgaggccaucgucugcguggagcucaccagccaggagcgccagugcucccugaucgaggccgggacccgguucaaccugggccccgugaccaucacccucagcgagccgcgcaacauccagcagaagcugccgcccgagaucaucacgcugcacccccggaucgaggagggcuucuucgaccucaugcacguccagaaggugcuguccgcgagcaccgugugcaagcugcagagcugcacccacgggguccccggcgaccuccagguguaccacaucgggaaccugcugaagggcgacaaggucaacgggcaccucauccacaagaucgagccccacuucaacaccuccuggaugagcugggacggcugcgaccuggacuacuacugcaacaugggcgacuggcccuccugcacguacaccggggugacccagcacaaccacgccagcuucgugaaccugcucaacaucgagaccgacuacacgaagaacuuccacuuccacuccaagcgcgucaccgcccacggcgacacgccccagcuggaccugaaggcccggccgaccuacggggcgggcgagaucaccgugcucguggaggucgccgacauggagcugcacaccaagaagaucgagaucagcgggcugaaguucgccucccugaccugcaccggcugcuacgccugcagcuccggcaucagcugcaaggugcgcauccacguggacgagcccgacgagcucacgguccacgugaaguccgacgaccccgacguggucgccgcgagcuccagccugauggcccggaagcucgaguucgggaccgacuccaccuucaaggccuucagcgccaugcccaagaccucccugugcuucuacaucguggagcgcgagcacugcaagagcugcaacgaggaggacacgaagaagugcgugaacaccaagcuggagcagccgcaguccauccucaucgagcacaagggcaccaucaucgggaagcagaacagcacgugcaccgcccgggcgagcugcuggcuggaguccgucaagagcuucuucuacggccugaagaacaugcuguccggcaucuucgggaacguguucaugggcaucuuccucuuccuggcccccuucauccugcucauccuguucuucauguucggguggcgcauccuguucugcuucaagugcugccgccggacccgcggccucuucaaguaccggcaccugaaggacgacgaggagaccggguaccgccggaucaucgagcgccugaacaacaagaagggcaagaacaagcuccuggacggcgagcggcuggccgaccgccggaucgccgagcuguucagcaccaagacgcacaucggguga

SEQ ID NO: 11992 - RNA, 5055 nt, Artificial Sequence
  derived and/or modified CDS sequence (opt1) from CCHFV(Sudan Al-Fulah 9-2008)__HQ378185.1__GP
augcacaucagccugauguacgccgugcucugccugcagcugugcggccucggggagacccaccgcucccacaacgagaccguccacaacaagacggacaucgugaccacccccagcgacgaccuguccagcgagcagcugguguccaccgcccucagcaucacgccggaccccuccaccgucacccccaccacgagcgcguccggccuggaggggagcggcgagguguacaccuccagccccaucaccaccgagucccugagccagccggagacgacccccaagcuccccgccaccaccgggaucgacacguccagcgccuccgacguggacagcuccacccaggccgccggcgacaccagcacccugacgguccggaccagccccccgaacucccccagcacccccuccaccccccaggacacgcaccacccgaugcgcaaccugcucagcgugaccucccccggccccgaggagaccagcacccccuccgggagcggcaaggaguccagcgcgacguccagcccgcaccccguguccaaccggccccagacccccccggccaccgcccaggggcccaccgaggacaacagccacaacgccacggagcaccccgagcaccugacccaguccgcgaccagcggccccaugaccuccccgacgcagaucguccacccccagagcgccaccaccaucaccgugcaggacaccuaccccucccccacgaaccgcagcaagcggaaccuggagauggagaucauccucacccugagccaggggcugaagaaguacuacggcaagauccuccgccugcugcggcucacccuggaggaggacaccgagggccugcucgaguggugcaagcgcaaccuggggcuggacugcgacgacacguucuuccagaagcggaucgaggaguucuucaucaccggcgaggggcacuucaacgacgugcuccaguucaagaccccgggcacccuguccacgaccgagagcacccccgccaagcccccgaccgccgagcccuucaaguccuacuucgccaagggcuuccugacgaucgacagcggguacuacuccgcgaagugcuacagcggcaccuccaacagcgggcuccagcugaucaacaucacccgccacuccacccggaucgucgacacgcccggccccaagaucaccaaccugaagaccaucaacugcaucaaccucaaggccagcaucuucaaggagcaccgcgagguggagaucaacgugcugcugccgcaggucgccgugaaccucuccaacugccacguggucaucaagagccacgugugcgacuacccccuggacaucgacgggaccgugcggcugccccacaucuaccacgagggcgucuucauccccggcacguacaagaucgugaucgacaagaagaacaagcucaacgaccgcugcacccuguucaccgacugcgugaucaaggggcgggagguccgcaagggccaguccgugcugcggcaguacaagaccgagauccgcaucgggaaggccagcacgggcucccggcgccuccugagcgaggagccguccgacgacugcaucagccggacccagcugcuccgcaccgagaccgccgagauccacggggacaacuacggcggccccggggacaagaucacgaucugcaacggcagcaccaucgucgaccagcgccugggguccgagcugggcugcuacaccaucaaccgggugaagagcuucaagcucugcgagaacuccgcgaccgggaagagcugcgugaucgacuccguccccgugaagugccgccagggcuacugccugcggaucacgcaggagggccgcgggcacgugaagcugagccggggcuccgaggucgugcuggacgccugcgacaccagcugcgagaucaugauccccaaggggaccggcgacauccucguggacugcuccggcgggcagcagcacuuccugaaggacaaccuggucgaccucggcugcccgaagaucccccugcuggggaagauggccaucuacaucugccgcaugagcaaccaccccaagaccacgauggccuuccucuucugguucuccuucggcuacgugaucaccugcauccugugcaaggccaucuucuaccugcucaucaucaucgggacccugggcaagcgguuccgccaguaccgggagcugaagccccagaccugcaccaucugcgagacgaccccggugaacgcgaucgacgccgagaugcacgaccucaacugcagcuacaacaucugccccuacugcgccucccgccugaccagcgacggccuggcccggcacgucacccagugccccaagcgcaaggagaagguggaggagacggagcucuaccugaaccuggagcggauccccugggugguccgcaagcuccugcagguguccgagagcaccgggguggcccugaagcgguccagcuggcucaucguccugcuggugcucuucaccgugucccugagcccgguccagagcgcgcccaucggccacgggaagaccaucgaggccuaccgcgcccgggagggcuacacguccaucugccuguucgugcucgggagcauccuguucaucguguccugccugaugaagggccucgucgacagcgugggcaacuccuucuuccccgggcugagcaucugcaagaccugcuccaucagcuccaucaacggcuucgagaucgagagccacaagugcuacugcucccuguucugcugccccuacugccgccacugcagcgccgacaaggagauccacaagcuccaccuguccaucugcaagaagcggaagaccgggagcaacgugaugcuggcggucugcaagcgcaugugcuuccgcgccaccauggagguguccaaccgggcccucuucauccgcagcaucaucaacacgaccuucgugcugugcauccugauccucgccgucugcgugguguccaccagcgccgucgagauggagaaccugccggcgggcaccugggagcgggaggaggaccugacgaacuucugccaccaggagugccaggugaccgagaccgagugccucugccccuacgaggcccuggugcugcgccggccccucuuccuggacuccaucgucaaggggaugaagaaccugcucaacagcaccagccuggagacgucccugagcaucgaggccccguggggcgccaucaacgugcaguccaccuacaagcccaccgugagcaccgccaacaucgcgcucuccuggagcuccgucgagcaccgcggcaacaagauccuggugagcgggcgguccgagagcaucaugaagcuggaggagcgcacgggcaucuccugggaccucgggguggaggacgccagcgaguccaagcugcugaccgucagcgugauggaccucucccagauguacagccccguguucgaguaccuguccggcgaccggcaggucgaggaguggcccaaggccaccugcaccggggacugcccggagcgcugcggcugcacgagcuccaccugccugcacaaggaguggccccacagccggaacuggcgcugcaaccccaccuggugcuggggcguggggaccggcugcacgugcugcgggcucgacgugaaggaccuguucaccgacuacauguucgucaaguggaagguggaguacaucaagaccgaggccaucgugugcgucgagcugaccagccaggagcggcagugcucccucaucgaggccggcacgcgcuucaaccugggccccgugaccaucacccugagcgagccgcggaacauccagcagaagcucccccccgagaucaucacccugcacccccgcaucgaggagggguucuucgaccugaugcacguccagaaggugcucuccgcgagcaccgugugcaagcugcaguccugcacgcacggcgucccgggggaccugcagguguaccacaucggcaaccuccugaagggggacaaggugaacggccaccugauccacaagaucgagccccacuucaacaccagcuggauguccugggacggcugcgaccucgacuacuacugcaacaugggggacuggcccagcugcaccuacaccggcgucacgcagcacaaccacgccuccuucgugaaccugcugaacaucgagaccgacuacaccaagaacuuccacuuccacagcaagcgggugaccgcccacggggacacgccccagcucgaccugaaggcccgcccgaccuacggcgcgggggagaucaccguccugguggagguggccgacauggagcuccacaccaagaagaucgagaucuccggccugaaguucgccagccugacgugcaccggcugcuacgccugcuccagcgggaucuccugcaagguccggauccacguggacgagcccgacgagcucaccgugcacgucaagagcgacgaccccgacgugguggccgcguccagcucccugauggcccgcaagcuggaguucggcaccgacagcacguucaaggccuucagcgccaugcccaagaccucccucugcuucuacaucgucgagaaggaguacugcaagagcugcuccgaggaggacaccaagaagugcgugaacaccaagcuggagcagccgcagagcauccugaucgagcacaaggggacgaucaucggcaagcagaacuccaccugcaccgccaaggugagcugcuggcucgaguccgcgaagagcuucuucuacgggcugaaggacaugcuguccggcaucuucggcaacgucuucaucgggaucuuccucuuccuggcccccuucgugcugcuggugcucuucuucauguucggcuggcggauccugcugugcuuccgcugcugccgccggacccgcgggcucuucaaguaccggcaccugaaggacgacgaggagacgggcuaccgccggaucaucgagcgccugaacaacaagaagggcaagaacaagcuccuggacggggagcggcuggccgaccgcaagaucgccgagcucuucagcaccaagacccacaucggcuga

SEQ ID NO: 11993 - RNA, 5055 nt, Artificial Sequence
  derived and/or modified CDS sequence (opt1) from CCHFV(SPU4/81)__DQ157175.1__GP
augcacaucagccugauguacgccgugcucugccugcagcugugcggccucggggagacccacggcuccuacaacgagaccgggcacaacaagacggacgucaugaccacccccggcgacaaccugagcuccgagcagccggugagcaccgcccuguccaucacgcccgaccccagcaccgugacccccaccacgccggcgaacgggcucgagggcuccggcgaggucuacaccagcucccccaucaccaccgagagccugucccugcccgagacgacccccgagcucccggccaccgccgggaucgacaccagcuccgccagcgacguggacuccagcacgcaggccgcgggcgggaccuccgcccccaccgugcgcaccagccugcccaacucccccagcacgccgagcacgccccaggagacccaccaccccguccggaaccugcucuccgugaccagccugggccccgaggagaccuccaccccgagcgggcccggcaaggaguccagcgccaccuccagcccccaccccguguccaacaagccgcccaccccgcccgcccgcgcgcagggccccacggagaacaacagccacaacgccaccgagcaccccgagccccugacccaguccgccacccccgggcucaugacgagcccgacccaggucgugcacccccaguccgccaccagcaucaccgugcaggacacguaccccuccccgaccaaccggagcaagcgcaaccuggagaccgagaucauccugacccucucccagggccugaagaaguacuacgggaagauccugcggcuccugcgccugacccucgaggaggacacggagggccugcuggaguggugcaagcggaaccucggccuggacugcgacgacaccuucuuccagaagcgcaucgaggaguucuucaucaccggggagggccacuucaacgagguccugcaguucaagacccccgggacgcucagcaccaccgaguccacccccgccgagcugcccacggcggagccguucaagagcuacuucgccaagggcuuccugagcaucgacuccggguacuacagcgccaagugcuacuccggcaccagcaacuccggccuccagcugaucaacaucacccggcacagcacccgcaucguggacacgcccgggcccaagaucaccaaccugaagaccaucaacugcaucaaccucaaggccuccaucuucaaggagcaccgggagguggagaucaacguccugcugccccaggccgcggugaaccucagcaacugccacguggucaucaagucccacgugugcgacuacagccuggacaucgacggcaccgugcgccugccgcacaucuaccacgagggggucuucauccccggcacguacaagaucgugaucgacaagaaggacaagcucaacgaccggugcacccuguucaccgacugcgugaucaaggggcgcgagguccggaagggccaguccgugcugcgccaguacaagaccgagauccggaucggcaaggccagcaucgggucccgccggcuccugagcgaggagcccuccgacgacugcaucagccgcacgcagcugcuccggaccgagaccgccgagauccacggcgacaacuacgggggccccggggacaagaucaccaucugcaacggcuccacgaucgucgaccagcgccugggcagcgagcuggggugcuacaccaucaaccgcgucaagagcuucaagcugugcgagaacuccgccaccggcaagagcugcgagaucgaguccgugccggugaagugccggcagggguacugccuccgcaucacccaggagggccggggccacgugaagcugagccgcggguccgaggugguccuggacgccugcgacacgagcugcgagaucaugauccccaagggcaccggggacauccucguggacugcuccggcgggcagcagcacuuccugaaggacaaccugaucgaccucggcugccccaagaucccccugcugggcaagauggcgaucuacaucugccggaugagcaaccacccgaagaccaccauggccuuccucuucugguucuccuucggguacgugaucacgugcauccugugcaaggccaucuucuaccugcucaucaucaucggcacccuggggaagcgcuucaagcaguaccgggagcugaagccccagaccugcaccaucugcgagacgacccccgucaacgccaucgacgccgagaugcacgaccucaacugcagcuacaacaucugccccuacugcgcgucccgccugaccagcgacggccuggcccggcacgugacccagugcccgaagcgcaaggagaagguggaggagaccgagcucuaccugaaccuggagcggauccccugggucgugcgcaagcuccuccagguguccgagagcacgggggucgcccugaagcgguccagcuggcucaucgugcugcugguccucuucaccgugucccugagccccgugcaguccgcccccaucggccacggcaagaccaucgaggcguaccgcgcccgggagggguacaccagcaucugccuguucgugcucggcagcauccuguucaucgucuccugccugaugaaggggcucguggacagcgugggcaacuccuucuucccggggcugagcaucugcaagacgugcuccaucagcuccaucaacggcuucgagaucgagagccacaagugcuacugcucccuguucugcugccccuacugccgccacugcagcgccgacaaggagauccacaagcuccaccuguccaucugcaagaagcggaagaccggcagcaacgucaugcuggccgugugcaagcgcaugugcuuccgggccaccauggagguguccaaccgcgcccucuucauccgcagcaucaucaacaccacguucguccugugcauccugauccucgcggugugcguggucuccaccagcgccguggagauggagaaccugcccgccgggaccugggagcgggaggaggaccugaccaacuucugccaccaggagugccaggugacggagaccgagugccucugcccguacgaggcccugguccugcgcaagccccucuuccuggacuccaucgugaagggcaugaagaaccugcucaacagcaccucccuggagaccagccugagcaucgaggcgcccuggggcgccaucaacgugcaguccacguacaagcccaccgucagcaccgccaacaucgcccucuccuggagcuccguggagcaccgggggaacaagauccuggugagcgggcgcuccgagagcaucaugaagcuggaggagcggaccggcaucuccugggaccucggcgucgaggacgccagcgaguccaagcugcugacggugagcgugauggaccucucccagauguacagcccggucuucgaguaccuguccggggaccgccagguggaggaguggcccaaggcgaccugcaccggcgacugccccgagcggugcgggugcaccagcuccacgugccugcacaaggaguggccccacagccgcaacuggcggugcaacccgaccuggugcuggggcgugggcaccgggugcacgugcugcggccucgacgucaaggaccuguucaccgacuacauguucgugaaguggaagguggaguacaucaagaccgaggccaucgucugcguggagcugaccucccaggagcgccagugcagccucaucgaggccgggacccgguucaaccugggccccgugacgaucacccugagcgagccccgcaacauccagcagaagcugcccccggagaucaucacccugcacccccggaucgaggagggguucuucgaccugaugcacguccagaaggugcucuccgccagcaccgucugcaagcugcaguccugcacgcacggcgugcccggcgaccuccagguguaccacaucgggaaccuccugaagggcgacaaggucaacgggcaccugauccacaagaucgagccccacuucaacaccagcuggauguccugggacggcugcgaccucgacuacuacugcaacaugggggacuggccgagcugcaccuacaccggcgugacccagcacaaccacgcguccuucgugaaccugcugaacaucgagacggacuacaccaagaacuuccacuuccacagcaagcgcgucaccgcccacggcgacacgccccagcucgaccugaaggcccggcccaccuacggggccggcgagaucaccgugcugguggaggucgccgacauggagcuccacaccaagaagaucgagaucuccgggcugaaguucgcgagccugaccugcacgggcugcuacgccugcuccagcgggaucuccugcaaggugcgcauccacguggacgagcccgacgagcucaccguccacgucaagagcgacgacccggacgugguggccgccuccagcucccugauggcccggaagcuggaguucggcaccgacagcaccuucaaggcguucuccgccaugcccaagacgagccucugcuucuacaucguggagcgcgagcacugcaagagcugcuccgaggaggacaccaagaagugcgugaacaccaagcuggagcagccccagagcauccugaucgagcacaagggcaccaucaucgggaagcagaacuccacgugcaccgccaaggccagcugcuggcucgaguccgucaagagcuucuucuacggccugaagaacaugcuguccgggaucuucggcaacguguucaucggcaucuuccuguuccucgggcccuucauccugcugauccucuucuucauguucggcuggcggauccuguucugcuucaagugcugccgccggacccgcgggcugcucaaguaccgccaccugaaggaggacgaggagaccggcuaccggcgcaucaucgagcggcugaacaacaagaaggggaagaacaagcuccuggacggcgagcgccuggccgaccggcgcaucgcggagcuguucagcacgaagacccacaucggcuga

SEQ ID NO: 11994 - RNA, 5055 nt, Artificial Sequence
  derived and/or modified CDS sequence (opt1) from CCHFV(NIV 11703)__JN572086.1__GP
augcacaccagccugaucuacgugguccucugccugcagcugugcucccucggcaagacccacgggagccacaacggcacggagcacaacaagaccgacgugaugaccacccccggggacaaccaguccccggagccccuggugagcacggcccugcccgucacccccgacccguccaccgugacccccacggcccccgcgagcggccucgagggguccggcgagguguacaccagcuccagcaucaccaccaagggccugucccugcccaaggccacgagcgagcuccuggccaccaccgggauggucaccuccagcgccuccgacaucgacccgagcacgcaggccgcgggcgacacccccacccccaccgugcgcacgucccugcccaacagcccguccacccccagcaccagccaggacacccaccaccccgugcggaaccuccuguccgucacgagccccaagccggaggagacccccacccccuccaagagcgacaaggacuccagcgccaccaacagcccccacccggccgccagccgccuguccacgccgcccaccaccgaccaggggcccaccgagaacaacaaccacaacagcacggagcagcucgagucccugacccggagcgcgaccuccagcuccauggugagccugacccagacggugcucccccaguccgccaccagcaucgccacccaggacacccaccccucccccaccaaccgcagcaagcggaaccuggagauggagaucauccugacgcucccccagggccugaagaaguacuacgggaagauccugaagcuccugcaccugacccucgaggaggacaccgagggccugcuggaguggugcaagcgcaaccucggccuggacugcgacgacaccuucuuccagaagcggaucgaggaguucuucaucacgggggagggccacuucaacgagguccugcaguuccgcgccccggggacccucagcaccaccgagcccacgcacgccggcucccccaccgcggagccguucaagagcuacuucgccaagggcuuccuguccaucgacagcggguacuucuccgccaagugcuacagccggaccuccaacagcggccugcagcucaucaacgugacccgccacuccacgcggaucgccgacacccccgggcccaagaucaccaaccugaagaccaucaacugcaucaaccugaaggccagcguguucaaggagcaccgcgaggucgagaucaacgugcuccugccccagguggcggucaaccuguccaacugccacguggccaucaagagccacgugugcgacuacucccucgacacggacggcgccauccggcugccgcacauccacuacgaggggaccuucauccccggcaccuacaagaucgucaucgacaagaagaacaagcugaacgaccgcugcacccucuucacgaacugcgugaucaagggccgggaggugcgcaaggggcagagcguccugcggcaguacaagaccgagauccgcaucggccgggccuccaccgggagccgccggcugcucuccgaggagagcggcgacgacugcaucagccgcacccagcugcugcgcacggagaccgccgaggugcacggggacaacuacggcggccccggggacaagaucaccaucugcaacggcuccaccgucguggaccagcggcuggggagcgagcucggcugcuacacgaucaaccgcgugaaguccuucaagcugugcgagaacagcgcgaccgggaaguccugcgagaucgacagcauccccgucaagugccggcagggcuacugccugaagaucacccaggagggccgcgggcacgugaagcucucccggggcagcgaggugguccuggacgccugcgacuccagcugcgaggugaugaucccgaaggggaccggcgacauccugguggacugcuccggcgggcagcagcacuuccucaaggacaaccugaucgaccugggcugccccaagaucccccuccuggggaagauggccaucuacaucugccgcaugagcaaccaccccaagacgaccauggccuuccuguucugguucuccuucggcuacgucaucacgugcauccucugcaaggugaucuucuaccugcugaucaucuucgggacccucggcaagcgguucaagcaguaccgcgagcugaagccgcagaccugcaccaucugcgagaccacccccgugaacgccaucgacgcggagaugcacgaccugaacugcagcuacaacaucugccccuacugcgccucccggcucaccagcgacggccuggcccgccacgucacgcagugccccaagcggaaggagaagguggaggagaccgagcuguaccucaaccuggagcgcaucccgugggugguccggaagcugcuccagguguccgagagcaccgggaucgcccugaagcgcuccagcuggcugaucgugcuccugguccuguucaccgugagcaucacgcccgugcaguccgcgcccaucggccacgggaagaccaucgaggccuaccgggcccgcgaggaguacaccagcaucugccucuucguccugggcuccgugcuguucguggucagcugccucaugaaggggcugguggacuccgugggcaacaucuucuuccccggccuguucaucugcaagaccugcagcaucggguccaucaacggcuucgagaucgagagccacaagugcuacugcucccucuucugcugcccguacugccggcacugcagcgccgaccgcgagauccaccagcugcaccuguccaucugcaagaagcggaagacggggagcaacgucaugcucgccgugugcaagcgcaugugcuuccgcaccaccauggagguguccaacaaggcgcuguucguccggagcaucaucaacaccacguucguggugugcauccugauccucgccgucugcgugguguccaccagcgccgucgagauggagucccugcccgccggcaccugggagcgcgaggaggaccugaccaacuucugccaccaggagugccaggugacggagaccgagugccucugccccuacgaggcccuggugcugcggcgcccccucuuccuggacagcaucgucaaggggaugaagaaccugcucaacuccaccagccuggagaccagccuguccaucgaggcgccguggggcgccaucaacgugcagagcacguacaagcccaccguguccgccgccaacaucgcccucagcugguccagcgucgagcaccggggcaacaagauccugguguccgggcgcagcgaguccaucaugaagcuggaggagcggaccggcaucagcugggaccucgggguggaggacgcguccgagagcaagcugcugaccgucuccgugauggaccucagccagauguacucccccguguucgaguaccugagcggcgaccgccaggucgaggaguggccgaaggccacgugcaccggggacugccccgagcggugcggcugcaccuccagcacgugccugcacaaggaguggccccacucccgcaacuggcggugcaaccccaccuggugcuggggcguggggaccggcugcacgugcugcgggcucgacgugaaggaccuguucaccgacuacauguucgucaaguggaagguggaguacaucaagaccgaggccaucgucugcguggagcugaccagccaggagcgccagugcagccucaucgaggccggcacccgguucaaccugggcuccgugaccaucacgcugagcgagccgcgcaacauccagcagaagcucccgcccgagaucaucacccugcacccccggaucgaggagggguucuucgaccugaugcacguccagaaggugcucuccgcgagcaccgugugcaagcugcaguccugcacccacggcguccccggggaccuccagguguaccacaucggcaaccuccugaagggggaccgcgugaacggccaccugauccacaagaucgagcagcaccucaacaccagcuggauguccugggacggcugcgaccuggacuacuacugcaacaugggggacuggcccagcugcacguacaccggcgucacccagcacaaccacgccuccuucgugaaccugcucaacaucgagaccgacuacacgaagaccuuccacuuccacagcaagcgggugaccgcccacggggacacgccccagcuggaccugaaggcccgccccaccuacggcgccggggagaucaccguccucguggagguggcggacauggagcugcacaccaagaagaucgagaucuccggccugaaguucgccagccucuccugcaccggcugcuacgccugcagcuccgggaucagcugcaagguccggauccacguggacgagccggacgagcugacggugcacgucaaguccgacgaccccgacgugguggccgccagcuccagccugauggcgcgcaagcucgagagcggcaccgacuccaccuucaaggccuucagcgccaugcccaagaccucccugugcuucuacaucgucgagcgggaguacugcaaggggugcagcaaggaggacacgcagaagugcgugaacaccaagcuggagcagccccaguccauccucaucgagcacaagggcaccaucaucgggaagcagaacaacacgugcaccgccaaggccagcugcuggcuggaguccgugaaguccuucuucuacggccugaagaacaugcuguccggcaucuucgggaacgucuuccucggcaucuucagcuuccuggcgccguucgugcugcucauccuguucuucauguucggguggcgcauccuguucugcuucaagugcugccgccggacccgcggccucuucaaguaccggcaccugaaggacgacgaggagaccggcuaccgcaagaucaucgagcggcugaacaacaagaaggggaagaacaagcuccuggacggcgagcgccuggccgaccggaagaucgccgagcuguucuccaccaagacgcacaucggguga

SEQ ID NO: 11995 - RNA, 5055 nt, Artificial Sequence
  derived and/or modified CDS sequence (opt1) from CCHFV(NIV 112143)__JN572085.1__GP
augcacaccagccugaucuacgugguccucugccugcagcugugcucccucggcaagacccacgggagccacaacggcacggagcacaacaagaccgacgugaugaccacccccggggacaaccaguccccggagccccuggugagcacggcccugcccgucacccccgacccguccaccaucacccccacggcccccgcgagcggccucgagggguccggcgagguguacaccagcuccagcaucaccaccaagggccugucccugcccaaggccacgagcgagcuccuggccaccaccgggauggugaccuccagcgccuccgacaucgacccgagcacgcaggccgcgggcgacacccccacccccaccguccgcacgucccugcccaacagcccguccacccccagcaccagccaggacacccaccaccccgugcggaaccuccuguccgugacgagccccaagccggaggagacccccacccccuccaagagcgacaaggacuccagcgccaccaacagcccccacccggccgccucccgccuguccacgccgcccaccaccgaccaggggcccaccgagaacaacaaccacaacagcacggagcagcucgagucccugacccggagcgcgaccuccagcuccauggucagccugacccagacggugcucccccaguccgccaccagcaucgccacccaggacacccaccccucccccaccaaccgcagcaagcggaaccuggagauggagaucauccugacgcucccccagggccugaagaaguacuacgggaagauccugaagcuccugcaccugacccucgaggaggacaccgagggccugcuggaguggugcaagcgcaaccucggccuggacugcgacgacaccuucuuccagaagcggaucgaggaguucuucaucacgggggagggccacuucaacgaggugcugcaguuccgcgccccggggacccucagcaccaccgagcccacgcacgccggcucccccaccgcggagccguucaagagcuacuucgccaagggcuuccuguccaucgacagcggguacuucuccgccaagugcuacagccggaccuccaacagcggccugcagcucaucaacgucacccgccacuccacgcggaucgccgacacccccgggcccaagaucaccaaccugaagaccaucaacugcaucaaccugaaggccagcguguucaaggagcaccgcgagguggagaucaacguccuccugccccagguggcggugaaccuguccaacugccacgucgccaucaagagccacgugugcgacuacucccucgacacggacggcgccauccggcugccgcacauccacuacgaggggaccuucauccccggcaccuacaagaucgugaucgacaagaagaacaagcugaacgaccgcugcacccucuucacgaacugcgucaucaagggccgggaggugcgcaaggggcagagcgugcugcggcaguacaagaccgagauccgcaucggccgggccuccaccgggagccgccggcugcucuccgaggagagcggcgacgacugcaucagccgcacccagcugcugcgcacggagaccgccgagguccacggggacaacuacggcggccccggggacaagaucaccaucugcaacggcuccaccguggucgaccagcggcuggggagcgagcucggcugcuacacgaucaaccgcgugaaguccuucaagcugugcgagaacagcgcgaccgggaaguccugcgagaucgacagcauccccgugaagugccggcagggcuacugccugaagaucacccaggagggccgcgggcacgucaagcucucccggggcagcgagguggugcuggacgccugcgacuccagcugcgaggucaugaucccgaaggggaccggcgacauccugguggacugcuccggcgggcagcagcacuuccucaaggacaaccugaucgaccugggcugccccaagaucccccuccuggggaagauggccaucuacaucugccgcaugagcaaccaccccaagacgaccauggccuuccuguucugguucuccuucggcuacgugaucacgugcauccucugcaaggucaucuucuaccugcugaucaucuucgggacccucggcaagcgguucaagcaguaccgcgagcugaagccgcagaccugcaccaucugcgagaccacccccgugaacgccaucgacgcggagaugcacgaccugaacugcagcuacaacaucugccccuacugcgccucccggcucaccagcgacggccuggcccgccacgugacgcagugccccaagcggaaggagaaggucgaggagaccgagcuguaccucaaccuggagcgcaucccguggguggugcggaagcugcuccaggucuccgagagcaccgggaucgcccugaagcgcuccagcuggcugaucgugcuccuggugcuguucaccgucagcaucacgcccgugcaguccgcgcccaucggccacgggaagaccaucgaggccuaccgggcccgcgaggaguacaccagcaucugccucuucgugcugggcuccguccuguucguggugagcugccucaugaaggggcuggucgacuccgugggcaacaucuucuuccccggccuguucaucugcaagaccugcagcaucggguccaucaacggcuucgagaucgagagccacaagugcuacugcucccucuucugcugcccguacugccggcacugcagcgccgaccgcgagauccaccagcugcaccuguccaucugcaagaagcggaagacggggagcaacgugaugcucgccgucugcaagcgcaugugcuuccgcgcgaccauggagguguccaacaaggcccuguucgugcggagcaucaucaacaccaccuucgucgugugcauccugauccucgccaucugcguggucuccacgagcgccguggagauggagucccugcccgccggcaccugggagcgcgaggaggaccugaccaacuucugccaccaggagugccaggugaccgagacggagugccucugccccuacgaggcgcugguccugcggcgcccccucuuccuggacagcaucgugaaggggaugaagaaccugcucaacuccaccagccuggagaccagccuguccaucgaggccccguggggcgccaucaacgugcagagcaccuacaagcccacggucuccgccgccaacaucgcgcucagcugguccagcguggagcaccggggcaacaagauccugguguccgggcgcagcgaguccaucaugaagcuggaggagcggaccggcaucagcugggaccucggggucgaggacgccuccgagagcaagcugcugaccguguccgugauggaccucagccagauguacucccccgucuucgaguaccugagcggcgaccgccagguggaggaguggccgaaggcgaccugcacgggggacugccccgagcggugcggcugcaccuccagcacgugccugcacaaggaguggccccacucccgcaacuggcggugcaaccccaccuggugcuggggcguggggaccggcugcacgugcugcgggcucgacgucaaggaccuguucaccgacuacauguucgugaaguggaagguggaguacaucaagaccgaggccaucgucugcguggagcugaccagccaggagcgccagugcagccucaucgaggccggcacccgguucaaccugggcuccgucaccaucacccugagcgagccgcgcaacauccagcagaagcucccgcccgagaucaucacgcugcacccccggaucgaggagggguucuucgaccugaugcacgugcagaaggugcucuccgccagcaccgucugcaagcugcaguccugcacccacggcgugcccggggaccuccagguguaccacaucggcaaccuccugaagggggaccgcgucaacggccaccugauccacaagaucgagcagcaccucaacaccagcuggauguccugggacggcugcgaccuggacuacuacugcaacaugggggacuggcccagcugcaccuacacgggcgugacccagcacaaccacgccuccuucgugaaccugcucaacaucgagaccgacuacaccaagacguuccacuuccacagcaagcgggucaccgcccacggggacacgccccagcuggaccugaaggcccgccccaccuacggcgcgggggagaucaccgugcucguggaggucgccgacauggagcugcacaccaagaagaucgagaucuccggccugaaguucgccagccucuccugcaccggcugcuacgccugcagcuccgggaucagcugcaaggugcggauccacguggacgagccggacgagcugaccguccacgugaaguccgacgaccccgacguggucgccgcgagcuccagccugauggcccgcaagcucgaguucggcacggacagcaccuucaaggccuucuccgccaugcccaagaccagccugugcuucuacaucguggagcgggaguacugcaaggggugcuccaaggaggacacccagaagugcgugaacacgaagcuggagcagccccagagcauccucaucgagcacaagggcaccaucaucgggaagcagaacaacacgugcaccgccaaggcguccugcuggcuggagagcgucaaguccuucuucuacggccugaagaacaugcugagcggcaucuucgggaacguguuccucggcaucuucuccuuccuggccccguucgugcugcucauccuguucuucauguucggguggcgcauccuguucugcuucaagugcugccgccggacccgcggccucuucaaguaccggcaccugaaggacgacgaggagaccggcuaccgcaagaucaucgagcggcugaacaacaagaaggggaagaacaagcuccuggacggcgagcgccuggccgaccggaagaucgccgagcuguucagcaccaagacccacaucggguga

SEQ ID NO: 11996 - RNA, 5055 nt, Artificial Sequence
  derived and/or modified CDS sequence (opt1) from CCHFV(NIVA 118594)__JN572084.1__GP
augcacaccagccucaucuacgugguccucugccugcagcugugcucccucggcaagacccacgggagccacaacggcacggagcacaacaagaccgacgugaugaccacccccggggacaaccaguccccggagccccuggugagcacggcccugcccgucacccccgacccguccaccgugacccccacggcccccgcgagcggccucgagggguccggcgagguguacaccagcuccagcaucaccaccaagggccugucccugcccaaggccacgagcgagcuccuggccaccaccgggauggucaccuccagcgccuccgacaucgacccgagcacgcaggccgcgggcgacacccccacccccaccgugcgcacgucccugcccaacagcccguccacccccagcaccagccaggacacccaccaccccgugcggaaccuccuguccgucacgagccccaagccggaggagacccccacccccuccaagagcgacaaggacuccagcgccaccaacagcccccacccggccgccagccgccuguccacgccgcccaccaccgaccaggggcccaccgagaacaacaaccacaacagcacggagcagcucgagucccugacccggagcgcgaccuccagcuccauggugagccugacccagacggugcucccccaguccgccaccagcaucgccacccaggacacccaccccucccccaccaaccgcagcaagcggaaccuggagauggagaucauccugacgcucccccagggccugaagaaguacuacgggaagauccugaagcuccugcaccugacccucgaggaggacaccgagggccugcuggaguggugcaagcgcaaccucggccuggacugcgacgacaccuucuuccagaagcggaucgaggaguucuucaucacgggggagggccacuucaacgagguccugcaguuccgcgccccggggacccucagcaccaccgagcccacgcacgccggcucccccaccgcggagccguucaagagcuacuucgccaagggcuuccuguccaucgacagcggguacuucuccgccaagugcuacagccggaccuccaacagcggccugcagcucaucaacgugacccgccacuccacgcggaucgccgacacccccgggcccaagaucaccaaccugaagaccaucaacugcaucaaccugaaggccagcguguucaaggagcaccgcgaguucgagaucaacguccuccugccccagguggcggugaaccuguccaacugccacgucgccaucaagagccacgugugcgacuacucccucgacacggacggcgccauccggcugccgcacauccacuacgaggggaccuucauccccggcaccuacaagaucgugaucgacaagaagaacaagcugaacgaccgcugcacccucuucacgaacugcgucaucaagggccgggaggugcgcaaggggcagagcgugcugcggcaguacaagaccgagauccgcaucggccgggccuccaccgggagccgccggcugcucuccgaggagagcggcgacgacugcaucagccgcacccagcugcugcgcacggagaccgccgagguccacggggacaacuacggcggccccggggacaagaucaccaucugcaacggcuccaccguggucgaccagcggcuggggagcgagcucggcugcuacacgaucaaccgcgugaaguccuucaagcugugcgagaacagcgcgaccgggaaguccugcgagaucgacagcauccccgugaagugccggcagggcuacugccugaagaucacccaggagggccgcgggcacgucaagcucucccggggcagcgagguggugcuggacgccugcgacuccagcugcgaggucaugaucccgaaggggaccggcgacauccugguggacugcuccggcgggcagcagcacuuccucaaggacaaccugaucgaccugggcugccccaagaucccccuccuggggaagauggccaucuacaucugccgcaugagcaaccaccccaagacgaccauggccuuccuguucugguucuccuucggcuacgugaucacgugcauccucugcaaggucaucuucuaccugcugaucaucuucgggacccucggcaagcgguucaagcaguaccgcgagcugaagccgcagaccugcaccaucugcgagaccacccccgugaacgccaucgacgcggagaugcacgaccugaacugcagcuacaacaucugccccuacugcgccucccggcucaccagcgacggccuggcccgccacgugacgcagugccccaagcggaaggagaaggucgaggagaccgagcuguaccucaaccuggagcgcaucccguggguggugcggaagcugcuccaggucuccgagagcaccgggaucgcccugaagcgcuccagcuggcugaucgugcuccuggugcuguucaccgucagcaucacgcccgugcaguccgcgcccaucggccacgggaagaccaucgaggccuaccgggcccgcgaggaguacaccagcaucugccucuucgugcugggcuccguccuguucguggugagcugccucaugaaggggcuggucgacuccgugggcaacaucuucuuccccggccuguucaucugcaagaccugcagcaucggguccaucaacggcuucgagaucgagagccacaagugcuacugcucccucuucugcugcccguacugccggcacugcagcgccgaccgcgagauccaccagcugcaccuguccaucugcaagaagcggaagacggggagcaacgugaugcucgccgucugcaagcgcaugugcuuccgcaccaccauggagguguccaacaaggcgcuguucgugcggagcaucaucaacaccacguucgucgugugcauccugauccucgccgugugcgucguguccaccagcgccguggagauggagucccugcccgccggcaccugggagcgcgaggaggaccugaccaacuucugccaccaggagugccaggucacggagaccgagugccucugccccuacgaggcccuggugcugcggcgcccccucuuccuggacagcaucgugaaggggaugaagaaccugcucaacuccaccagccuggagaccagccuguccaucgaggcgccguggggcgccaucaacguccagagcacguacaagcccaccguguccgccgccaacaucgcccucagcugguccagcguggagcaccggggcaacaagauccuggucuccgggcgcagcgaguccaucaugaagcuggaggagcggaccggcaucagcugggaccucgggguggaggacgcguccgagagcaagcugcugaccguguccgucauggaccucagccagauguacucccccguguucgaguaccugagcggcgaccgccagguggaggaguggccgaaggccacgugcaccggggacugccccgagcggugcggcugcaccuccagcacgugccugcacaaggaguggccccacucccgcaacuggcggugcaaccccaccuggugcuggggcgucgggaccggcugcacgugcugcgggcucgacgugaaggaccuguucaccgacuacauguucgugaaguggaaggucgaguacaucaagaccgaggccaucgugugcgucgagcugaccagccaggagcgccagugcagccucaucgaggccggcacccgguucaaccugggcuccgugaccaucacgcugagcgagccgcgcaacauccagcagaagcucccgcccgagaucaucacccugcacccccggaucgaggagggguucuucgaccugaugcacgugcagaagguccucuccgcgagcaccgugugcaagcugcaguccugcacccacggcgugcccggggaccugcaggucuaccacaucggcaaccuccugaagggggaccgcgugaacggccaccugauccacaagaucgagcagcaccucaacaccagcuggauguccugggacggcugcgaccuggacuacuacugcaacaugggggacuggcccagcugcacguacaccggcgugacccagcacaaccacgccuccuucgucaaccugcucaacaucgagaccgacuacacgaagaccuuccacuuccacagcaagcgggugaccgcccacggggacacgccccagcuggaccugaaggcccgccccaccuacggcgccggggagaucaccgugcucgucgagguggcggacauggagcugcacaccaagaagaucgagaucuccggccugaaguucgccagccucuccugcaccggcugcuacgccugcagcuccgggaucagcugcaaggugcggauccacgucgacgagccggacgagcugacggugcacgugaaguccgacgaccccgacgucguggccgccagcuccagccugauggcgcgcaagcucgagagcggcaccgacuccaccuucaaggccuucagcgccaugcccaagaccucccugugcuucuacaucguggagcgggaguacugcaaggggugcagcaaggaggacacgcagaagugcgucaacaccaagcuggagcagccccaguccauccucaucgagcacaagggcaccaucaucgggaagcagaacaacacgugcaccgccaaggccagcugcuggcuggaguccgugaaguccuucuucuacggccugaagaacaugcuguccggcaucuucgggaacguguuccucggcaucuucagcuuccuggcgccguucguccugcucauccuguucuucauguucggguggcgcauccuguucugcuucaagugcugccgccggacccgcggccucuucaaguaccggcaccugaaggacgacgaggagaccggcuaccgcaagaucaucgagcggcugaacaacaagaaggggaagaacaagcuccuggacggcgagcgccuggccgaccggaagaucgccgagcuguucuccaccaagacgcacaucggguga

SEQ ID NO: 11997 - RNA, 5055 nt, Artificial Sequence
  derived and/or modified CDS sequence (opt1) from CCHFV(UCCR4448)__KY484042.1__GP
augcacaucagccugauguacgccgugcucugccugcagcugugcggccucggggagacccacggcucccacaacgagaccgggcacaacaagacggacgucaugaccacccccggcgacaaccugagcuccgagcagccggugagcaccgcccuguccaucacgcccgaccccagcaccgugacccccaccacgccggcguccgggcucgagggcagcggcgaggucuacaccuccccccccaucaucaccgagagccugucccugcccgagaccacgccggagcucagcgccaccgccgggaucgacaccuccagcgccuccgacguggacagcuccacccaggccgcgcgcggcacgagcgcccugaccgugcggaccucccugcccaacagccccagcacccccuccacgccgcaggagacccaccaccccguccgcaaccuccugagcgugaccuccccccggcccgaggagaccagcacgccguccgggagcggcaaggaguccagcgccaccuccgggccccaccccgugagcaacaagcccccgaccccccccgccaagacccagggccccacggagaacaacucccacaacgcgaccgagcacccggagccccugacccagagcgccacccucggccugaugacgucccccacccagaucguccacccccagagcgccaccuccaucaccgugcaggacacguacccgagccccaccaaccgcuccaagcggaaccuggagauggagaucauccucacccugagccaggggcugaagaaguacuacggcaagauccuccgccugcugcggcucacccuggaggaggacaccgaggggcugcucgaguggugcaagcgcaaccugggccuggacugcgacgacacguucuuccagaagcggaucgaggaguucuucaucaccggcgaggggcacuucaacgaggugcuccaguucaagacccccggcacccuguccacgaccgagagcaccccggccgagcugcccaccgccgagcccuucaagagcuacuucgcgaagggguuccucuccaucgacagcggcuacuacuccgccaagugcuacagcgggacguccaacagcggccugcagcugaucaacaucacccgccacuccgcccggaucgucgacacccccggcccgaaggugaccaaccucaagacgaucaacugcaucaaccugaaggccagcaucuucaaggagcaccgcgagguggagaucaacguccugcucccccagguggccgugaaccuguccaacugccacgucaucaucaagagccacgugugcgacuacucccuggacaucgacgggaccgugcggcucccccacaucuaccacgagggcgucuucauccccgggaccuacaagaucgugaucgacaagaaggacaagcugaacgaccgcugcacccuguucacggacugcgugaucaagggccgggagguccgcaaggggcagagcgugcuccggcaguacaagaccgagauccgcaucggcaaggcguccaccggcagccggcgccugcuguccgaggagaccagcgacgacugcaucucccggacgcagcuccugcgcaccgagaccgccgagauccacggggacaacuacggcgggccgggcgacaagaucaccaucugcaacgggagcacgaucgucgaccagcgccugggcagcgagcugggcugcuacaccaucaaccgggugaaguccuucaagcucugcgagaacagcgccaccgggaaguccugcgagaucgacagcgugcccgucaagugccgccagggcuacugccugcggaucacccaggaggggcgcggccacgugaagcugucccggggcagcgaggugguccucgacgccugcgacacguccugcgagaucaugauccccaaggggaccggcgacauccugguggacugcagcgggggccagcagcacuuccugaaggacaaccucaucgaccuggggugccccaagaucccgcugcucggcaagauggccaucuacaucugccgcauguccaaccaccccaagaccaccauggcguuccuguucugguucagcuucggcuacgugaucacgugcauccugugcaaggccaucuucuaccuccugaucaucaucgggacccugggcaagcgguucaagcaguaccgcgagcucaagccccagaccugcaccaucugcgagacgacccccgucaacgccaucgacgccgagaugcacgaccugaacugcuccuacaacaucugcccguacugcgccagccggcugaccuccgacgggcucgcgcgccacgugacccagugccccaagcggaaggagaagguggaggagaccgagcuguaccugaaccucgagcgcauccccugggucgugcggaagcugcugcaggugagcgaguccacgggcgucgcccucaagcgcagcuccuggcugaucgugcugcucgugcuguucaccaucagccugucccccguccagagcgccccgaucagccacgggaagaccaucgaggccuaccgggcgcgcgagggcuacaccuccaucugccucuucgugcugggcagcauccuguucaucguguccuaccucaugaaggggcuggucgacagcgugggcaacuccuucuuccccgggcugagcaucugcaagacgugcuccaccagcuccaucaacggcuucgagaucgagagccacaagugcuacugcucccucuucugcugccccuacugccggcacugcagcgccgacaaggagauccacaagcugcaccuguccaucugcaagaagcgcaagaccgggagcaacgugaugcucgccgucugcaagcggaugugcuuccgcgccaccauggagguguccaaccgcgcccuguucauccggagcaucaucaacacgaccuucgugcugugcauccucauccuggcggucugcgugguguccaccagcgccgucgagauggagaaccugcccgccggcaccugggagcgcgaggaggaccucacgaacuucugccaccaggagugccaggugaccgagaccgagugccugugcccguacgaggcccuggugcuccggaagccccuguuccuggacuccaucgucaagggcaugaagaaccuccugaacagcaccagccuggagacgucccucagcaucgaggcccccuggggggcgaucaacgugcaguccaccuacaagccgaccgugagcaccgccaacaucgcccuguccuggagcuccgucgagcaccgcggcaacaagauccuggugagcgggcgguccgagagcaucaugaagcucgaggagaagacgggcaucuccugggaccuggggguggaggacgccagcgaguccaagcugcucaccgucagcgugauggaccugucccagauguacagccccguguucgaguaccuguccggcgaccgccaggucgaggaguggcccaaggccaccugcaccggcgacugccccgagcggugcgggugcacgagcuccaccugccuccacaaggaguggccgcacagccgcaacuggcggugcaaccccaccuggugcuggggcguggggaccggcugcacgugcugcggccuggacgugaaggaccuguucaccgacuacauguucgucaaguggaagguggaguacaucaagaccgaggcgaucgugugcgucgagcucaccagccaggagcgccagugcucccugaucgaggccgggacgcgguucaaccugggccccgugaccaucacccucagcgagccccgcaacauccagcagaagcugccgcccgagaucaucacccugcacccccggaucgaggagggguucuucgaccucaugcacgugcagaagguccuguccgccagcacggugugcaagcugcaguccugcacccacggcguccccggggaccuccagguguaccacaucggcaaccugcugaagggcgacaaggugaacgggcaccucauccacaagaucgagccgcacuucaacaccagcuggauguccugggacggcugcgaccuggacuacuacugcaacaugggggacuggcccagcugcaccuacaccggcgucacgcagcacaaccacgccuccuucgugaaccugcucaacaucgagaccgacuacaccaagaacuuccacuuccacagcaagcgcgugaccgcgcacggggacacgccccagcuggaccugaaggcccggcccaccuacggcgccggcgagaucaccguccucguggagguggccgacauggagcugcacaccaagaagaucgagaucuccgggcugaaguucgccagccucacgugcaccggcugcuacgcgugcuccagcgggaucuccugcaagguccgcauccacguggacgagccggacgagcugaccgugcacgucaagagcgacgaccccgacgugguggccgccuccagcucccugauggcccggaagcucgaguucggcaccgacagcacguucaaggccuucagcgcgaugcccaagaccucccugugcuucuacaucgucgagcgcgagcacugcaagagcugcuccgaggaggacaccaagaagugcgugaacaccaagcuggagcagccccagagcauccucaucgagcacaaggggacgaucaucggcaagcagaacuccaccugcaccgccaaggccagcugcuggcuggaguccgugaagagcuucuucuacggccugaagaacaugcuguccgggaucuucggcaacgucuucaucgggaucuuccucuuccuggccccguucauccugcucauccuguucuucauguucggcuggaagauccuguucugcuucaagugcugccggcgcacccggggccucuucaaguaccgccaccugaaggacgacgaggagacgggguaccgccggaucaucgagcgccugaacaacaagaagggcaagaacaagcuccuggacggggagauccuggccgaccggcgcaucgcggagcucuucagcaccaagacccacaucggcuga

SEQ ID NO: 11998 - RNA, 5055 nt, Artificial Sequence
  derived and/or modified CDS sequence (opt1) from CCHFV(UCCR4401)__KY484035.1__GP
augcacaucagccugauguacgccauccucugccugcagcugugcggccucggggagacccacggcucccacaacgagacccgccacaacaagacggacaccaugaccacccccggggacaacccgagcuccgagccgcccgugagcacggcccuguccaucacccuggaccccagcaccgucacccccacgacccccgcguccggccucgaggggagcggcgagguguacaccuccccgcccaucaccacgggcagccugccccuguccgagaccacccccgagcuccccgugaccacggggaccgacacccugagcgccggcgacgucgaccccuccacccagacggccgggggcaccagcgccccgaccgugcggaccucccugcccaacagccccuccacgcccagcaccccgcaggacacccaccaccccgugcgcaaccuccuguccgucaccagccccgggcccgacgagacgagcaccccguccggcaccggcaaggagagcuccgccaccagcagcccccaccccguguccaaccggcccccgacgccgcccgcgaccgcccaggggcccaccgagaacgacucccacaacagcaccgagcaccccgagucccugacgcagagcgccacccccggccucaugaccucccccacccagaucgugcacccgcagagcgccacccccaucacgguccaggacacccaccccucccccaccaaccgcagcaagcggaaccugaagauggagaucauccugacccucucccaggggcugaagaaguacuacggcaagauccugcgccuccugcagcugacgcucgaggaggacaccgagggccugcuggaguggugcaagcggaaccucgggcuggacugcgacgacaccuucuuccagaagcgcaucgaggaguucuucaucaccggcgaggggcacuucaacgaggugcugcaguuccggacgccgggcacccucagcaccaccgaguccacgcccgcggggcugcccaccgccgagcccuucaagagcuacuucgccaagggcuuccuguccaucgacagcggcuacuacagcgccaagugcuacuccgggaccagcaacuccggccuccagcugaucaacaucacccgccacagcacgcggaucguggacaccccggggcccaagaucaccaaccugaagaccaucaacugcaucaaccucaaggccuccaucuucaaggagcaccgcgaggucgagaucaacgugcugcugccccagguggcggucaaccucagcaacugccacguggugaucaagucccacgucugcgacuacagccuggacaucgacggcgccgugcggcugccccacaucuaccacgaggggguguucaucccgggcacguacaagaucgucaucgacaagaagaacaagcucaacgaccgcugcacccuguucaccgacugcgugaucaagggccgggaggugcgcaaggggcaguccguccugcggcaguacaagaccgagauccgcaucggcaaggccagcacggggucccggcgccuccugagcgaggagcccuccgacgacugcaucagccggacccagcugcuccgcaccgagaccgccgagauccacggcgacaacuacgggggccccggcgacaagaucacgaucugcaacggguccaccaucguggaccagcgccugggcagcgagcuggggugcuacaccaucaaccggguccgcuccuucaagcugugcgagaacagcgccaccggcaagaacugcgagaucgacagcgugcccgugaagugccggcagggcuacugccuccgcaucacgcaggaggggcggggccacgucaagcugucccgcgggagcgagguggugcuggacgcgugcgacaccuccugcgagaucaugaucccgaagggcaccggggacauccucgucgacugcagcggcggccagcagcacuuccugaaggacaaccugaucgaccucgggugccccaagaucccccugcugggcaagauggccaucuacaucugccggauguccaaccaccccaagaccacgauggccuuccucuucugguucagcuucggguacgugaucacgugcauccugugcaaggccaucuucuaccugcucaucaucgugggcacccuggggaagcgccugaagcaguaccgggagcucaagccgcagaccugcaccaucugcgagaccacccccgucaacgccaucgacgcggagaugcacgaccugaacugcuccuacaacaucugccccuacugcgccagccgccugaccuccgacggccucgcccggcacgugauccagugccccaagcgcaaggagaagguggaggagaccgagcuguaccugaaccucgagcggaucccgugggucgugcgcaagcugcuccaggugagcgaguccacgggcgucgcccugaagcggagcuccuggcugaucgugcugcucgugcuguucaccgucagccugucccccgugcagagcgcccccaucgggcagggcaagaccaucgaggcguaccgcgcccgggagggguacaccuccaucugccucuucgugcugggcagcauccuguucaucgucuccugccucaugaaggggcugguggacagcgugggcaacagcuucuucccgggccuguccaucugcaagacgugcagcaucuccagcaucaacggguucgagaucgagucccacaagugcuacugcagccucuucugcugccccuacugccgccacugcuccaccgacaaggagauccacaagcugcaccugagcaucugcaagaagcggaagaccggcuccaacgucaugcucgccgugugcaagcugaugugcuuccgcgccaccauggaggugagcaaccgcgcgcuguucauccgguccaucaucaacacgaccuucguccucugcauccugauccuggccgugugcguggucagcaccuccgccguggagauggagaaccuccccgccgggaccugggagcgcgaggaggaccugacgaacuucugccaccaggagugccaggugaccgagaccgagugccugugccccuacgaggcccucguccugcggaagccgcuguuccucgacagcaccgcgaagggcaugaagaaccugcugaacuccacgagccucgagaccucccugagcaucgaggcccccuggggcgccaucaacgugcaguccaccuacaagcccaccgugagcacggccaacaucgcccugagcugguccagcgucgagcaccgcgggaacaagauccucguguccggccggagcgaguccaucaugaagcuggaggagcgcaccgggaucagcugggaccugggcguggaggacgcguccgagagcaagcuccugaccgucuccgugauggaccugagccagauguacucccccguguucgaguaccucagcggggaccggcaggucgaggaguggccgaaggcgaccugcacgggcgacugccccgagcgcugcggcugcaccuccagcacgugccugcacaaggaguggccccacucccggaacuggcgcugcaaccccaccuggugcuggggcguggggaccgggugcacgugcugcggccuggacgugaaggaccucuucaccgacuacauguucgucaaguggaagguggaguacaucaagaccgaggccaucgugugcgucgagcugaccagccaggagcggcagugcucccugaucgaggccgggacccgcuucaaccucggcccggugaccaucacccugagcgagccccggaacauccagcagaagcugccgcccgagaucaucacccuccacccccgcaucgaggagggcuucuucgaccugaugcacgugcagaagguccuguccgccagcacggugugcaagcuccagagcugcacccacgggguccccggcgaccuccagguguaccacaucgggaaccugcugaagggcgacaaggugaacgggcaccugauccacaagaucgagccccacuucaacaccuccuggaugagcugggacggcugcgaccuggacuacuacugcaacaugggcgacuggcccuccugcaccuacacgggggucacccagcacaaccacgccagcuucgugaaccuccugaacaucgagaccgacuacaccaagaacuuccacuuccacuccaagcgggugacggcccacggcgacaccccgcagcuggaccucaaggcccgccccaccuacggggccggcgagaucaccguccugguggagguggcggacauggagcugcacacgaagaagaucgagaucagcgggcucaaguucgccucccuggccugcaccggcugcuacgccugcagcuccggcaucagcugcaagguccggauccacguggacgagcccgacgagcugaccgugcacgucaaguccgacgaccccgacgugguggccgcgagcuccagccucauggcccgcaagcuggaguucgggaccgacuccacguucaaggccuucagcgccaugccgaagaccucccugugcuucuacaucgucgagcgggagcacugcaagagcugcuccgaggaggacaccaagaagugcgugaacaccaagcucgagcagccccagagcauccugaucgagcacaagggcacgaucaucgggaagcagaacagcacgugcaccgccaaggcguccugcuggcuggagagcgugaaguccuucuucuacggccugaagaacaugcucagcggcaucuucgggaacgucuucaugggcaucuuccuguuccuggcccccuucauccuccugauccuguucuucauguucggguggcgcauccucuucugcuucaagugcugccggcgcacccgcggccuguucaaguaccggcaccugaaggacgacgaggagaccggguaccgccggaucaucgagaagcucaacaacaagaagggcaagaacaagcugcuggacggcgagcgccucgccgaccggcgcaucgccgagcuguucuccaccaagacccacaucggguga

SEQ ID NO: 11999 - RNA, 5055 nt, Artificial Sequence
  derived and/or modified CDS sequence (opt1) from CCHFV(IbAn7620)__KX013451.1__GP
augcacaucagccugaucuacgccauccucugccugcagcugugcggccucggggagaccuacggcucccacaacgagacccgccacaacaagacggacaccaugaccacccccggggacaaccugagcuccgagccgcccgugagcacggcccuguucaucacccccgaccccuccaccgucaccccgacgacccccgcgagcggccucgagggguccggcgagguguacaccagcccccccaucaccacgggcucccugccgcugcccgagaccacccccgagcuccccgccaccacggggaccgacaccagcuccgccagcgacguggacuucuccacccagacggccggcgggaccagcgcccugaccguccggaccggccugccggacucccccagcacgcccuccaccccccaggacacccaccacccgaugcgcaaccuccugagcgugaccucccccgggcccgacgagacgagcacccccagcggcaccggccgggaguccagcgcgaccuccagcccgcaccccguguccaaccgcccccccacgccgcccgccaccgcccaggggcccaccgagaacgacagccacaacgccaccgagcaccccgagucccugacgcagagcgcgaccccgggccucaugaccucccccacccagaccauccacccccagagcgccacgccgaucaccguccaggacaagcagcccucccccaccaaccggagcaagcgcaaccuggagauggagaucauccugacccucucccaggggcugaagaaguacuacggcaagauccugcggcuccugcaccugacgcucgaggaggacaccgagggccugcuggaguggugcaagcgcaaccucgggcuggacugcgacgacaacuucuuccagaagcggaucgaggaguucuucaucaccggcgaggggcacuucaacgaggugcugcaguuccgcacccccggcacgcucagcaccaccgaguccaccccggccgggcugcccacggccgagcccuucaagagcuacuucgccaagggcuuccuguccaucgacagcggcuacuacuccgcgaagugcuacagcgggaccagcaacuccggccuccagcugaucaacaucacccggcacagcacccgcaucguggacacgcccgggccgaagaucaccaaccugaagaccaucaacugcaucaaccucaaggccuccaucuucaaggagcaccgggaggucgagaucaacgugcugcugccccagguggccgucaaccucagcaacugccacguggugaucaagucccacgucugcgacuacagccuggacaucgacggcgccgugcgccugccccacaucuaccacgaggggguguucauccccggcaccuacaagaucgucaucgacaagaagaacaagcucaacgaccggugcacgcuguucaccgacugcgugaucaagggccgcgaggugcggaaggggcaguccguccugcgccaguacaagaccgagauccggaucggcaaggccagcaccgggucccgccggcuccugagcgaggagccguccgacgacugcaucagccgcacgcagcugcuccgcaccgagaccgcggagauccacggcgacaacuacgggggccccggcgacaagaucaccaucugcaacggguccacgaucguggaccagcggcugggcagcgagcuggggugcuacaccaucaaccgcgugaaguccuucaagcugugcgagaacagcgccaccggcaagaacugcgagaucgacuccguccccgugaagugccggcagggcuacugccuccgcaucacccaggaggggcggggccacgucaagcugagccgcgggagcgagaucgugcuggacgccugcgacacguccugcgagaucaugauccccaagggcaccggggacauccucguggacugcagcggcggccagcagcacuuccugaaggacaaccugaucgaccucgggugcccgaagaucccccugcugggcaagauggccaucuacaucugccggauguccaaccaccccaagaccaccauggccuuccucuucugguucagcuucggguacgucaucacgugcauccugugcaaggcgaucuucuaccugcucaucaucaucggcacccuggggaagcgccugaagcaguaccgggagcucaagccccagaccugcaccaucugcgagaccacgccggugaacgccaucgacgccgagaugcacgaccugaacugcuccuacaacaucugccccuacugcgccagccgccugaccuccgacggccucgcccggcacgugauccagugccccaagcgcaaggagaaggucgaggagaccgagcuguaccugaaccucgagcggauccccuggguggugcgcaagcugcugcaggucagcgaguccaccggcguggcgcucaagcggagcuccuggcugaucgugcugcucguccuguucacggugagccuguccccggugcagagcgcccccaucgggcagggcaagaccaccgaggccuaccgcgcccgggagggguacaccuccaucugccucuucguccugggcagcauccuguucaucguguccugccucaugaaggggcugguggacagcgucggcaacuccuucuuccccggccugagcaucugcaagacgugcagcaucuccagcaucaacggguucgagaucgagucccacaagugcuacugcagccucuucugcugcccguacugccgccacugcuccaccgacaaggagauccacaagcugcaccugagcaucugcaagaagcggaagaccggcuccaacgugaugcucgcggugugcaagcgcaugugcuuccgcgccaccauggaggucagcaaccgggcccuguucauccgcuccaucaucaacacgaccuucgugcugugcauccucauccuggccgugugcgucgugagcaccuccgccguggagauggagaaccugcccgcggggaccugggagcgggaggaggaccucacgaacuucugccaccaggagugccaggucaccgagaccgagugccugugccccuacgaggcccuggugcuccgcaagccccuguuccuggacagcaucgccaagggcaugaagaacccgcucaacuccaccagccuggagacgucccugagcaucgaggcccccuggggggccaucgacgugcaguccaccuacaagcccaccgucagcaccgcgaacaucgcccucuccuggagcagcguggagcaccggggcaacaagauccugguguccggccgcagcgaguccaucaugaagcuggaggagcggacggggaucagcugggaccucggcgucgaggacgccuccgagagcaagcugcugaccguguccgugauggaccucagccagauguacucccccgucuucgaguaccugagcggggaccgccagguggaggaguggccgaaggccaccugcaccggcgacugccccgagcggugcggcugcacguccagcaccugccugcacaaggaguggccccacucccgcaacuggcggugcaaccccaccuggugcuggggggugggcaccgggugcacgugcugcggccucgacgucaaggaccuguucaccgacuacauguucgugaaguggaagguggaguacaucaagaccgaggccaucgucugcguggagcugaccagccaggagcgccagugcucccucaucgaggcggggacgcgguucaaccugggcccggugaccaucacccugagcgagccccgcaacauccagcagaagcucccccccgagaucaucacccugcacccgcggaucgaggagggcuucuucgaccugaugcacguccagaaggugcucuccgccagcaccgugugcaagcugcaguccugcacgcacgggguccccggcgaccugcagguguaccacaucgggaaccuccugaagggcgacaaggugaacgggcaccugauccacaagaucgagccccacuucaacaccagcuggaugagcugggacggcugcgaccucgacuacuacugcaacaugggcgacuggcccuccugcaccuacaccggggucacgcagcacaaccacgccagcuucgugaaccugcugaacaucgagaccgacuacaccaagaacuuccacuuccacuccaagcgcgucaccgcccacggcgacacgccgcagcucgaccugaaggcgcggcccaccuacggggccggcgagaucaccgugcugguggaggucgccaacauggagcuccacaccaagaagaucgagaucagcgggcugaaguucgccucccugacgugcaccggcugcuacgccugcagcuccggcaucagcugcaaggugcgcauccacguggacgagcccgacgagcucaccguccacgugaaguccgacgaccccgacguggucgcggccagcuccagccugauggcccggaagcuggaguucgggaccgacuccacguucaaggccuucagcgccaugccgaagaccucccucugcuucuacaucguggagcgcgagcacugcaagagcugcuccgaggaggacaccaagaagugcgugaacaccaagcuggagcagccccagagcauccugaucgagcacaagggcacgaucaucgggaagcagaacuccaccugcaccgcgaaggccagcugcuggcucgagagcgucaaguccuucuucuacggccugaagaacaugcugagcggcaucuucgggaacguguucaugggcaucuuccuguuccucgcccccuucauccugcugauccucuucuucauguucggguggcggauccuguucugcuucaagugcugccgccgcacccggggccuguucaaguaccgccaccucaaggacgacgaggagacgggguaccggcgcaucaucgagcggcugaacaacaagaagggcaagaacaagcugcucgacggcgagcgccuggccgaccggcgcaucgccgagcuguucuccaccaagacccacaucggguga

SEQ ID NO: 12000 - RNA, 5055 nt, Artificial Sequence
  derived and/or modified CDS sequence (opt1) from CCHFV(Zahedan 2007)__KC867273.1__GP
augcacaucagccugauguacgccguguucugccuccagcugugcggccuggggaagaccaacggcccccacaacgggaccgagcacaacaacacgcacgucaugaccaccccggacgacucccagagccccgagccgcccguguccaccgcccuccccgugacgcccgaccccagcaccgucacccccuccaccccggcgagcggccuggagggguccggcgaggugcacacgagcucccccaucaccaccaagggccugagccuccccgaggccaccuccgagcccccgagcacgaccuccguggucaccagcuccgccagcgacaccgacuccagcacgcaggccgccggggacacccccacccccaccgugcgcacgucccugcccagcagcccguccacccccagcaccucccagggcacccacuaccccgugcggagccugcucuccgucacggggcccaagccggaggagacccccacccccagcaaguccggcaaggacaaccuggcgaccaacagcccccacccggccacgucccgccccaccacccccagcaccaucgcccagaagcccacggagaacaacucccacaacaccaccgagcagcuggagagccucacccaccuggccacgcugggguccaagaucagcccgacccagaccgugcucccccaguccgugaccagcaucgcgauccaggacauccacaccucccccacgaaccggagcaagcgcaaccuggacauggagaucauccugacccucucccagggccugaagaaguacuacggcaagauccugaagcuccugcggcugacccucgaggaggacaccgaggggcugcuggaguggugcaagcgcaaccucggccuggacugcgacgacacguucuuccagaagcggaucgaggaguucuucaucaccggggagggccacuucaacgagguccugcaguuccgcacccucggcacccugagcacgaccgagagcacccacgccggguccccgaccguggagcccuucaagagcuacuucgccaagggcuuccuguccaucgacagcggguacuucuccgccaagugcuacagccggacguccaacagcggccuccagcugaucaacgugacccgccacuccacccggaucgccgacacccccgggcccaagaucacgaaccugaagaccaucaacugcaucaaccucaaggcgagcgucuucaaggagcaccgcgagguggagaucaacgugcugcugccgcaggucgccgugaaccucuccaacugccacguggccaucaagagccacaucugcgacuacucccuggacaccgacggcgccauccggcugccccagauccaccacgagggcaccuucauccccgggacguacaagaucgucaucgacaagaaguccaagcucaacgaccgcugcacccuguucaccaacugcgugaucaagggccgggaggugcgcaaggggcagagcguccugcggcaguacaagaccgagauccgcaucggccgggccagcacggggucccgccggcuccugagcgaggagagcggcgacgacugcaucucccgcacccagcugcuccgcaccgagaccgcggaggugcacggcgacaacuacgggggccccggggacaagaucacgaucugcaacggcagcaccgucguggaccagcggcugggguccgagcugggcugcuacaccaucaaccgcgugcggagcuucaagcugugcgagaacuccgccaccggcaagagcugcgagaucgacuccaucccggucaagugcaagcagggguucugccucaagaucacgcaggagggccgcgggcacgugaagcugagccggggcuccgaggugguccuggacgugugcgacagcuccugcgaggugaugauccccaagggcaccggggacauccucgucgacugcagcggcgggcagcagcacuuccugaaggacaaccugguggaccucggcugccccaagaucccccugcuggggaagauggccaucuacaucugccgcauguccaaccacccgaagaccaccauggccuuccucuucugguucagcuucggcuacgugaucacgugcauccugugcaaggccaucuucuuccugcucaucaucuucggcacccuggggaagcgguucaagcaguaccgcgagcugaagccccagaccugcaccaucugcgagaccacgcccgucaacgcgaucgacgccgagaugcacgaccucaacugcuccuacaacaucugccccuacugcgccagccggcugaccuccgacggccuggcccgccacgugacccagugcccgcggcgcaaggagaagguggaggagaccgagcucuaccugaaccuggagcggauccccugggucgugcgcaagcuccuccaggugagcgaguccacggggaccguccugaagcggagcagcuggcucaucgugcugcuggugcuguucaccgucucccugagccccgugcaguccgcccccaucggccacgggaagaccaucgagacguaccgcgugcgggaggaguacaccagcaucugccuguucguccucggcuccauccuguucaucgugagcuuccugaugaagggccucguggacggggucggcaacaucuucuucccggggcuguccgugugcaagaccugcagcaucggcuccaucaacggguucgagaucgagagccaccgcugcuacugcucccuguucugcugccccuacugccggcacugcagcgcggacggcgagauccaccagcuccaccuguccaucugcaagaagcgcaagaccggcagcaacgugaugcuggccgucugcaagcgcaugugcuuccgggccacgauggagguguccaacaaggugcuguucauccgcagcaucaucaacaccaccuucgucgugugcauccugauccuggccgugugcgucguguccaccagcgcgguggagauggagucccuccccgccgggacgugggagcgggaggaggaccugaccaacuucugccaccaggagugccaggucaccgagaccgagugccugugccccuacgaggcccucgugcugcgccggccgcuguuccucgacagcaucgugaaggacaugaagaaccugcugaacagcacgucccucgagaccagccuguccaucgaggcccccuggggcgccaucaacguccagagcaccuacaagcccaccguguccacggcgaacaucgcccugagcugguccagcguggagcaccgcgggaacaagguccucguguccggccggagcgaguccaucaugaagcuggaggagcgcaccgggaucagcugggaccugggcguggaggacgccuccgagagcaagcuccugaccgucuccgugauggaccugagccagauguacuccccgguguucgaguaccucagcggcgaccggcaggucgaggaguggcccaaggcgaccugcacgggggacugccccgagcgcugcggcugcaccuccagcacgugccugcacaaggaguggccccacagccggaacuggcgcugcaacccgaccuggugcuggggcguggggaccggcugcacgugcugcgggcuggacgucaaggaccucuucaccgacuacauguucgugaaguggaagguggaguacaucaagaccgaggccaucgucugcguggagcugaccucccaggagcggcagugcagccugaucgaggccggcacccgcuucaaccucggguccgugaccaucacccugagcgagccccggaacauccagcagaagcugccgcccgagaucaucacccuccaccccaagaucgaggagggcuucuucgaccugaugcacguccagaaggugcuguccgccagcacggugugcaagcuccaguccugcacccacgggguccccggcgaccuccagguguaccacaucggcaaccugcucaagggggaccgcgugaacggccaccugauccacaagaucgagcagcacuucaacaccagcuggauguccugggacgggugcgaccuggacuacuacugcaacaugggcgacuggcccagcugcaccuacacgggggucacccagcacaaccacgccuccuucgugaaccuccugaacaucgagaccgacuacaccaagacguuccacuuccacagcaagcgggugaccgcccacggcgacacgccccagcuggaccucaaggcccgcccgaccuacggcgcgggggagaucaccguccugguggagguggccgacauggagcugcacaccaagaagaucgagaucuccggccucaaguucgccgggcugaccugcaccggcugcuacgccugcagcuccgggaucagcugcaagguccggauccacguggacgagcccgacgagcugacggugcacgucaaguccgacgaccccgacgugguggcggccagcuccagccucauggcccgcaagcuggaguucggcaccgacagcaccuucaaggccuucuccgccaugcccaagaccagccugugcuucuacaucgucgagcgggaguacugcaaguccugcagcaaggaggacacgcagaagugcgugaacaccaagcucgagcagccgcaguccauccugaucgagcacaagggcaccaucaucgggaagcagaacaacacgugcaccgcgaaggccagcugcuggcuggaguccgucaagagcuucuucuacggccucaagaacaugcucgggggcaucuucggcaacguguucaucgggaucuucaccuuccugacccccuucauccugcugaucuucuucuucauguucggcuggcgcauccuguucugcuucaagugcugccgccggacccgcgggcuguucaaguaccggcaccucaaggacgacgaggagacgggcuaccgcaagaucaucgagcggcugaacaacaagaaggggaagaaccgccugcucgacggcgagcggcuggccgaccgcaagaucgccgagcuguucuccaccaagacccacaucggcuga

SEQ ID NO: 12001 - RNA, 5055 nt, Artificial Sequence
  derived and/or modified CDS sequence (opt1) from CCHFV(Afg09-2990)__HM452306.1__GP
augcacaucagccugauguacgccguguucugccuccagcugugcggccuggggaagaccaacggcccccacaacgggaccgagcacaacaacacgcacgucaugaccaccccggacgacucccagagccccgagccccccguguccaccgcccucccggugacgcccgaccccagcaccgucacccccuccaccccggcgagcggccuggagggguccggcgagguguacacgagcucccccaucaccaccaagggccugagccuccccgaggccaccuccgagcccccggccacgaccagcguggucaccuccagcgccuccgacaccgacagcuccacgcaggccgcgggggacacccccacccccaccgugcgcacgagccugcccuccagcccgagcacccccuccaccagccagggcacccacuaccccgugcggucccugcucagcgucacgucccccaagccggaggagacccccacccccagcaaguccgggaaggacaaccuggccaccaacagcccccacccggccacgucccgccccaccaccccccccaccacggcccagaagccgaccgagaacaacagccacaacaccaccgagcagcuggagucccucacgcaccuggcgacccugggcagcaugaucucccccacccagaccgugcucccccagagcgugaccuccaucgccauccaggacauccacaacagcccgacgaaccgguccaagcgcaaccuggacauggagaucauccugacccucagccaggggcugaagaaguacuacggcaagauccugaagcuccugcaccugacccucgaggaggacaccgagggccugcuggaguggugcaagcggaaccucgggcuggacugcgacgacacguucuuccagaagcgcaucgaggaguucuucaucaccggcgaggggcacuucaacgagguccugcaguuccggacccucggcacccuguccacgaccgagagcacccacgccggcagccccaccguggagcccuucaaguccuacuucgccaagggguuccugagcaucgacuccggcuacuucagcgccaagugcuacucccgcacgagcaacuccgggcuccagcugaucaacgugacccggcacagcacccgcaucgcggacacccccggcccgaagaucacgaaccugaagaccaucaacugcaugaaccucaaggccuccgucuucaaggagcaccgggagguggagaucaacgugcugcugccccaggucgccgugaaccucagcaacugccacguggccaucaagucccacaucugcgacuacagccuggacaccgacggggccauccgccugccccagauccaccacgagggcaccuucauccccggcacguacaagaucgucaucgacaagaaguccaagcucaacgaccggugcacccuguucaccaacugcgugaucaaggggcgcgaggugcggaagggccagagcguccugcgccaguacaagaccgagauccggaucgggcgcgcguccgccggcagccggcgccuccuguccgaggagagcggggacgacugcaucagccggacgcagcugcuccgcaccgagaccgccgaggugcacggcgacaacuacggcgggccgggcgacaagaucaccaucugcaacggguccacggucguggaccagcgccugggcagcgagcuggggugcuacaccaucaaccgggugcgcuccuucaagcugugcgagaacagcgccaccggcaaguccugcgagaucgacagcauccccgucaagugcaagcagggcuacugccucaagaucacccaggaggggcggggccacgugaagcugucccgcgggagcgaggugguccuggacgugugcgacuccagcugcgaggugaugauccccaagggcacgggcgacauccucgucgacugcuccgggggccagcagcacuaccugaaggacaaccugguggaccucgggugccccaagaucccgcugcugggcaagauggccaucuacaucugccggaugagcaaccaccccaagaccaccauggcguuccucuucugguucuccuucggguacgugaucaccugcauccugugcaaggccaucuucuuccugcucaucaucuucggcacgcugggcaagcgcuucaagcaguaccgggagcugaagccccagaccugcaccaucugcgagaccacccccgucaacgccaucgacgccgagaugcacgaccucaacugcagcuacaacaucugcccguacugcgccucccgccugacgagcgacgggcuggcgcggcacgugacccagugcccccgccggaaggagaagguggaggagaccgagcucuaccugaaccuggagcgcauccccugggucgugcggaagcuccugcagguguccgagagcaccggcacgguccugaagcgcuccagcuggcucaucgugcugcuggugcucuucaccgucagccugucccccgugcagagcgccccgaucgggcacggcaagaccaucgagaccuaccgggugcgcgaggaguacacguccaucugccuguucguccucgggagcauccuguucaucguguccuuccugaugaagggccucguggacggcgucgggaacaucuucuuccccggccugagcgugugcaagaccugcuccaucgggagcaucaacggcuucgagaucgagucccacaagugcuacugcagccuguucugcugccccuacugccggcacugcuccgccgacggggagauccaccagcuccaccugagcaucugcaagaagcgcaagaccggcuccaacgugaugcuggccgucugcaagcggaugugcuuccgcgcgaccauggaggugagcaacaaggcccucuucauccgcuccaucaucaacacgaccuucguggucugcauccugauccuggccgugugcguggucagcaccuccgccguggagauggagagccuccccgccggcaccugggagcgggaggaggaccugacgaacuucugccaccaggagugccaggugaccgagaccgagugccugugcccguacgaggcgcucguccugcgccggccccuguuccucgacuccaucgugaaggggaugaagaaccugcugaacagcaccagccucgagacgucccugagcaucgaggcccccuggggcgccaucaacgugcaguccaccuacaagccgaccgucagcaccgccaacaucgcccuguccuggagcuccguggagcaccgcgggaacaaggugcucgucagcggccgguccgagagcaucaugaagcuggaggagcgcacggggaucuccugggaccugggcguggaggacgcgagcgaguccaagcuccugaccgugagcgucauggaccugucccagauguacagccccguguucgaguaccucuccggcgaccggcagguggaggaguggcccaaggccaccugcaccggggacugccccgagcgcugcggcugcacgagcuccaccugccugcacaaggaguggccgcacagccggaacuggcgcugcaaccccaccuggugcuggggggucggcaccggcugcacgugcugcgggcuggacgugaaggaccucuucaccgacuacauguucgucaaguggaagguggaguacaucaagaccgaggccaucgugugcgucgagcugaccagccaggagcggcagugcucccugaucgaggccggcacgcgcuucaaccucgggagcgugaccaucacccuguccgagccccggaacauccagcagaagcugcccccggagaucaucacccuccaccccaagaucgaggagggcuucuucgaccugaugcacgugcagaagguccugagcgccuccaccgugugcaagcuccagagcugcacgcacggggugcccggcgaccugcaggucuaccacaucggcaaccugcucaagggggaccgcgugaacggccaccugauccacaagaucgagcagcacuucaacaccuccuggaugagcugggacgggugcgaccuggacuacuacugcaacaugggcgacuggcccuccugcaccuacaccggggugacgcagcacaaccacgcgagcuucgucaaccuccugaacaucgagaccgacuacaccaagaccuuccacuuccacuccaagcgggugacggcccacggcgacaccccgcagcuggaccucaaggcccgccccaccuacggcgccggggagaucaccgugcuggucgagguggcggacauggagcugcacacgaagaagaucgagaucagcggccucaaguucgccgggcugaccugcaccggcugcuacgccugcuccagcgggaucuccugcaaggugcggauccacgucgacgagcccgacgagcugaccgugcacgugaagagcgacgaccccgacgucguggccgccuccagcucccucauggcgcgcaagcuggaguucggcacggacagcaccuucaaggccuucagcgccaugccgaagaccucccugugcuucuacaucguggagcgggaguacugcaagagcugcuccaaggaggacacccagaagugcgucaacacgaagcucgagcagccccagagcauccugaucgagcacaagggcaccaucaucgggaagcagaacaacaccugcaccgccaaggccuccugcuggcuggagagcgugaaguccuucuucuacggccucaagaacaugcuggggggcaucuucggcaacguguucaucgggaucuucacguuccugacccccuucauccugcucauccuguucuucauguucggcuggcgcauccuguucugcuucaagugcugccggcgcacccgcgggcucuucaaguaccggcaccugaaggacgacgaggagaccggcuaccgcaagaucaucgagcggcugaacaacaagaaggggaagaaccgccuccuggacggcgagcggcuggcggaccgcaagaucgccgagcucuucagcacgaagacccacaucggcuga

SEQ ID NO: 12002 - RNA, 5055 nt, Artificial Sequence
  derived and/or modified CDS sequence (opt1) from CCHFV(SPU41/84)__AY900142.1__GP
augcacaucagccugauguacgcggugcucugccugcagcugugcggccucggggagacccacggcagccacaacgggacccgcuacaacaacaccgacgccaccaccacccccggcgacagccagagccccgagccgcccgugagcaccgcguccagcaucacccacaaccccuccaccgugaccagcaccacccccaccuccgggagcgagggcuccggcgagguguacaccagcucccccaucacgaccgaggggcuguccccgcccggcaccacccccgagcugcccgccacgaccgggaucgacaccuccggcgccagcgacgccaaccccuccacccaggccgcgcgggggacgagcgcccucaccgugcacaccucccugcccagcagcccguccaccccgcccaucagccaggacacgcaccaccccgugcgcaaccugcucuccgugaccagccccaugcccgaggagaccaccgcccccuccggcagcggcaaggaguccagcgccacguccagcccccaccccgcguccgaccggccgcccacgccgcccgccaccgcccaggggcugaccgagagcaacucccacaacgccacggagcaccuggagagccucacccaguccgccacccccggccuggucaccagccccgcgcagacggugcacccccacuccgccaccagcaucgccgcccccgacacccaccccaaccccaccaaccgcuccaagcggaaccuggagauggagaucauccucacccugagccaggggcugaagaaguacuacggcaagauccuccgccugcugcaccucacgcuggaggaggacaccgagggccugcucgaguggugcaagcggaaccuggggcuggacugcgacgacaccuucuuccagaagcgcaucgaggaguucuucaucaccggcgaggggcacuucaacgaggugcuccaguuccggacgccgggcaccgucagcaccaccgaguccacgcacgccgggccgcccaccgcggagcccuucaagagcuacuucgccaagggcucccugagcaucgacuccggcuacuacagcgccaagugcuacuccgggaccagcaacuccggccugcagcucaucaacaucacccgccacagcacgaagaucgccgacaccccggggcccaagaucaccaaccugaagaccaucaacugcaucaaccugaaggcccucacguucaaggagcaccgggagguggagaucaacgugcugcugccccaggucgcggugaaccucuccaacugccacguggucaucaagagccacgugugcgacuacucccuggacaucgacggcaccgugcgccugccccacauccaccacgaggggaucuucaucccgggcaccuacaagaucgucaucgacaagaagaacaagaugaacgaccggugcacccucuucacgaacugcgugaucaagggccgcgaggugcggaaggggcagagcguccugaagcaguacaagaccgagauccgcaucggcaaggccuccaccgggagccggcgccugcucuccgaggagagcagcgacgacugcaucucccggacccagcugcugcgcacggagaccgccgagauccacggcgacaacuacgggggccccggcgacaagaucaccaucugcaacgggagcaccgugguggaccagcggcucggcuccgagcuggggugcuacacgaucaaccgcgucaagaccuucaagcugugcgagaacagcgccaccggcaaguccugcgagaucgacagcgugcccgucaagugccgccagggcuacugccucaagaucacccaggaggggcggggccacgugaagcugucccgcgggagcgaggugguccuggacgccugcgacacguccugcgaggugaugauccccaagggcaccggggacauccugguggacugcagcggcggccagcagcacuuccucaaggacaaccugaucgaccuggggugcccgaagaucccccuccugggcaagauggcgaucuacaucugccggauguccaaccaccccaagaccaccauggccuuccuguucugguucagcuucggguacgucaucacgugcaucaucugcaaggugaucuucuaccuccugaucaucgugggcacccuggggaagcgcuucaagcaguaccgggagcucaagccccagaccugcaccaucugcgagaccacgccggucaacgccaucgacgccgagaugcacgaccugaacugcuccuacaacaucugccccuacugcgcgagccgccugaccuccgacggccucgcccggcacgugacccagugccccaagcgcaaggagaagguggaggagaccgagcuguaccugaaccucgagcggauccccugggucgugcgcaagcugcuccaggugagcgaguccacgggcgucgcccucaagcggagcuccuggcugguggugcugcucguccugcugaccgugagccucagcccggugcaguccgcccccaucagccacgggaagaccgucgaggccuaccgcgcgcgggagggcuacaccuccaugugccuguucgugcuggggagcguccuguuccuggucuccugccugaugaagggccucguggacagcguggggaacacguucuuccccggccuguccaucugcaagaccugcagcaucuccagcaucaacggcuucgagaucgagucccaccgcugcuacugcagccuguucugcugccccuacugccggcacugcuccgccaacaaggagauccaccagcuccaccugagcaucugcaagaagcgcaaggccggguccaacgucaugcuggccgugugcaagcggaugugcuuccgcgccaccauggaggugagcaaccgggcccucuucauccgcuccaucaucaacaccacguucguccugugcauccugauccucgccgccugcguggugagcaccuccgccgucgagauggagagccugccggccggcaccugggagcgcgaggaggaccugaccaacuucugccaccaggagugccagguggcggacacggagugccucugccccuacgaggcccuggugcugcggcgcccccucuuccuggacagcaucgucaaggggaugaagaaccugcucaacuccaccagccuggagaccucccugagcaucgaggccccguggggcgccaucaacgugcaguccaccuacaagcccacggugagcaccgcgaacaucgcccucuccuggagcuccgucgagcaccgggggaacaagauccuggugagcggccgcuccgagagcaucaugaagcuggaggagcggaccggcaucuccugggaccucgggguggaggacgccagcgaguccaagcugcugaccgucagcgugauggaccucucccagauguacagccccguguucgaguaccuguccggcgaccgccaggucgaggaguggcccaaggccacgugcaccggggacugcccggagcggugcggcugcaccagcuccacgugccugcacaaggaguggccccacucccgcaacuggcggugcaaccccaccuggugcuggggcguggggaccggcugcacgugcugcgggcucgacgugaaggaccuguucaccgacuacauguucgucaaguggaagguggaguacaucaagacggaggccaucgugugcgucgagcugaccagccaggagcgccagugcucccucaucgaggcgggcacccgguucaaccuggggcccgugaccaucacgcugagcgagccgcgcaacauccagcagaagcugccgcccgagaucaucacccugcacccccggaucgaggagggcuucuucgaccugaugcacguccagaaggugcucuccgccagcaccgugugcaagcugcaguccugcacccacggcgucccgggggaccuccagguguaccacaucggcaaccuccugaagggggacaaggugaacggccaccugguccacaagaucgagccccacuucaacaccagcuggauguccugggacgggugcgaccucgacuacuacugcaacaugggcgacuggcccagcugcacguacaccggcgugacccagcacaaccacgccuccuucgugaacaugcugaacaucgagaccgacuacacgaagaacuuccacuuccacagcaagcgcgucaccgcccacggggacacgccccagcuggaccucaaggcccggccgaccuacggcgcgggggagaucacggugcugguggaggucgccgacauggagcugcacaccaagaagaucgagaucuccggccucaaguucaccagccugaccugcacggggugcuacgccugcuccagcggcaucuccugcaaggugcgcauccacguggacgagcccgacgagcugaccguccacgucaagagcgaggaccccgacguggucgccgccuccagcagccucauggcgcggaagcuggaguucggcaccgacuccaccuucaaggccuucagcgccaugcccaagacgucccugugcuucuacaucguggagcgcgaguacugcaagagcugcuccgaggaggacacccagaagugcgugaacaccaagcucgagcagccgcagagcauccugaucgagcggaaggggaccaucaucggcaagcagaacaacacgugcaaggccaaggcggggugcuggcuggaguccgucaagagcuucuucuacggccucaagaacaugcuguccggcaucuucgggaacguguucaucggcaucuuccuguuccucgcccccuucauccugcugauccuguucuucauguucggguggcgcauccucuucugcuucaagugcugccggcgcacccgcggccuguucaaguaccggcaccugaaggacgacgaggagaccggguaccgcaagaucaucgagcggcucaacaacaagaagggcaagaacaagcugcuggacggcgagcgccucgccgaccggcgcaucgccgagcuguucagcaccaagacgcacaucggguga

SEQ ID NO: 12003 - RNA, 5055 nt, Artificial Sequence
  derived and/or modified CDS sequence (opt1) from CCHFV(SPU103/87)__DQ211634.1__GP
augcacaucagccucauguacgccgugcucugccugcagcugugcggccucgggggcgcccacgggucccacaacggcacccgcuacaacaacaccggggcgcugacgacccugggcgacggccagagcuccgagcccccggucagcaccgcccccuccaccacgcacaaccccagcaccgugaccuccaccacgcccgccagcggguccgagggcagcggggagguguacaccgccuccccggucaccaccgagggccucagcccgcccgggacgacccccgagcugcccgccaccaccggcaucgacacguccggcgcgagcgacgccgaccccuccacccaggccgccggggacaccagcgcgcugaccgugcggacgucccuccccagcucccccagcacccugccgaccagccaggacacccaccaccccgugcgcaaccugcucuccgucacgagcccccggcccgaggagaccaccgccccguccggcagcgggaucgaguccagcgccaccuccagcccccaccccgccuccgaccggcccccgacgccgcccgccgcggcccagggccccaccgagagcaacucccacaacgccaccgagcaccuggagagccugacccaguccgccacgcccgaccucgugaccagccccgcccagaccgugcacccccaguccgcgaccagcaucgccgcccccgacacgcacccgucccccaccaaccgcagcaagcgcaaccuggaggucgagaucauccugacccucucccagggccugaagaaguacuacgggaagauccugcggcuccugcaccugacccucgaggaggacaccgagggccugcuggaguggugcaagcgcaaccucgggcuggacugcgacgacacguucuuccagaagcggaucgaggaguucuucaucaccggcgaggggcacuucaacgaggugcugcaguuccgcacccccggcaccgugagcacgaccgagagcacccacgccggcccgcccaccgccgagcccuucaaguccuacuucgcgaagggguuccucagcaucgacuccggcuacuacagcgccaagugcuacuccgggacgagcaacuccggccugcagcugaucaacaucacccggcacagcacccgcaucgccgacacccccgggccgaagaucacgaaccucaagaccaucaacugcaucaaccugaaggcccugaccuucaaggagcaccgggaggucgagaucaacgugcuccugccccagguggccgucaaccuguccaacugccacguggugaucaagagccacgucugcgacuacucccucgacaucgacggcaccgugcgccugccccacauccaccacgagggcaucuucauccccgggacguacaagaucgugaucgacaagaagaacaagcugaacgaccggugcacccucuucaccgacugcgucaucaagggccgcgaggugcggaaggggcagagcgugcugaagcaguacaagaccgagauccgcaucggcaaggcguccacggggagccggcgccugcucuccgaggagagcuccgacgacugcaucagccggacccagcugcugcgcaccgagaccgccgagauccacggcgacaacuacggcgggccgggcgacaagaucacgaucugcaacgggagcaccaucgucgaccagcgccucggcuccgagcugggcugcuacaccaucaaccgggugaagaccuucaagcugugcgagaacagcgccacggggaaguccugcgagaucgacagcguccccgugaagugccgccagggcuacugccugaagaucacccaggaggggcggggccacgugaagcucucccgcgggagcgaggucgugcuggacgccugcgacaccuccugcgaggugaugauccccaagggcaccggcgacauccuggucgacugcagcgggggccagcagcacuuccucaaggacaaccugaucgaccuggggugccccaagaucccgcuccugggcaagauggcgaucuacaucugccggauguccaaccaccccaagacgaccauggccuuccuguucugguucagcuucggguacgugaucacgugcgugcucugcaaggccaucuucuaccugcugaucaucgucggcacccucggcaagcgccugaagcaguaccgggagcugaagccccagaccugcaccaucugcgagaccacccccgugaacgccaucgacgccgagaugcacgaccucaacugcuccuacaacaucugcccguacugcgcgagccgccugaccuccgacgggcuggcccggcacgugacgcagugccccaagcgcaaggagaaggucgaggagaccgagcucuaccugaaccuggagcggauccccuggguggugcgccggcuccugcaggucagcgaguccaccggcguggcccugaagcgcagcuccuggcucaucgugcugcugguccucuucaccgugagccugucccccgugcagagcgccccgaucagccacgggaagacggucgaggccuaccaggcgcgggagggcuacaccgggaugugccuguucgugcucggcuccauccuguuccuggugagcugccucaugaagggccuggucgacuccguggggaacaccuucuuccccggccugagcaucugcaagaccugcuccaucagcuccaucaacggguucgagaucgagagccaccgcugcuacugcucccucuucugcugccccuacugccggcacugcagcgccaacaaggagauccaccagcugcaccuguccaucugcaagaagcgcaagacgggcagcaacgugaugcucgccgucugcaagcggaugugcuuccgcgccaccauggagguguccaaccgcgcccuguucauccggagcaucaucaacaccaccuucgugcugugcauccucauccuggcggucugcgugguguccacgagcgccgucgagauggagucccugcccgccgggaccugggagcgcgaggaggaccucaccaacuucugccaccaggagugccaggugaccgacacggagugccugugcccguacgaggcccuggugcuccggcgcccccuguuccuggacaacaucgucaagggcaugaagaaccuccugaacagcaccucccuggagaccagccucagcaucgaggcgcccuggggcgccaucaacgugcaguccaccuacaagccgacggugagcaccgccaacaucgcccuguccuggagcuccgucgagcaccgggggaacaagauccuggugagcggccgcuccgagagcaucaugaagcucgaggagcggaccgggaucuccugggaccugggcguggaggacgccagcgaguccaagcugcucaccgucagcgugauggaccugucccagauguacagccccguguucgaguaccuguccggcgaccgccaggucgaggaguggcccaaggcgacgugcaccggggacugccccgagcggugcggcugcaccagcuccacgugccuccacaaggaguggccgcacagccgcaacuggcggugcaaccccaccuggugcuggggcguggggaccgggugcacgugcugcggccuggacgugaaggaccuguucaccgacuacauguucgucaaguggaagaucgaguacaucaagaccgaggccaucgugugcguggagcucaccucccaggagcgccagugcagccugaucgaggccggcacccgguucaaccuggggcccgucaccaucacgcucagcgagccccgcaacauccagcagaagcugccguccgagaucaucacccugcacccccggaucgaggagggcuucuucgaccucaugcacgugcagaagguccugagcgccuccaccgugugcaagcugcagagcugcacccacggggugcccggcgaccuccaggucuaccacaucgggaaccugcugaagggcgacaaggugaacggccaccucgugcacaagaucgagccccacuucaacaccuccuggaugagcugggacgggugcgaccuggacuacuacugcaacaugggcgacuggccguccugcacguacaccggggucacccagcacaaccacgccagcuucgugaaccugcucaacaucgagaccgacuacacgaagaacuuccacuuccacuccaagcgcgugaccgcgcacggcgacacgccccagcuggaccugaaggcccggcccaccuacggggccggcgagaucaccguccucguggagguggccgacauggagcugcacaccaagaagaucgagaucagcggccugaaguucaccucccugaccugcacggggugcuacgccugcagcuccggcaucagcugcaagguccgcauccacguggacgagcccgacgagcucaccgugcacgucaaguccgacgacccggacgugguggcggccagcuccagccugauggcccggaagcucgaguucgggaccgacuccaccuucaaggccuucagcgcgaugcccaagacgagccugugcuucuacaucgucgagcgcgaguacugcaaguccugcagcgaggaggacacccagaagugcgugaacaccaagcuggagcagccccaguccauccucaucgagcacaagggcaccaucaucggcaagcagaacaacacgugcaaggcccgggccgggugcuggcuggagagcgugaaguccuucuucuacggccugaagaacaugcugagcgggaucuucggcaacgucuucaucgggaucuuccucuuccuggcccccuucauccugcucauccuguucuucauguucggcuggcgcauccuguucugcuucaagugcugccgccggacccgcggccucuucaaguaccggcaccugaaggacgacgaggagaccggguaccgcaagaucaucgagcggcugaacaacaagaagggcaagaacaagcuccuggacggggagcgccuggccgaccggcgcaucgcggagcuguucuccaccaagacgcacaucggcuga

SEQ ID NO: 12004 - RNA, 5055 nt, Artificial Sequence
  derived and/or modified CDS sequence (opt1) from CCHFV(Iran-53)__DQ446216.1__GP
augcacaucagccugauguacgccguguucugccuccagcugugcggccuggggaagaccaacggcccccacaacgggaccgagcacaacaacacgcacgucaugaccaccccggacgacucccagagccccgagccgcccguguccaccgcccuccccgugacgcccgaccccagcaccgucacccccuccaccccggcgagcggccuggagggguccggcgagguguacacgagcucccccaucaccaccaagggccugagccuccccgaggccaccuccgagcccccggccacgaccagcguggucaccuccagcgccuccgacaccgacagcuccacgcaggccgccgggggcacccccacccccaccgugcgcacgagccugcccuccagcccgagcacccccuccaccagccaggggacccacuaccccgugcggucccugcucagcgucacgucccccaagccggaggagacccccacccccagcaaguccggcaaggacaaccuggccaccaacagcccccacccggccacgucccgccccaccgccccgcccaccaccgcgcagaagcccacggagaacaacagccacaacaccaccgagcagcuggagucccucacccaccuggccacgcuggggagcaugaucucccccacccagaccgugcucccccagagcgugaccuccaucgccauccaggacauccacaccagcccgacgaaccgguccaagcgcaaccuggacgucgagaucauccugacccucagccagggccugaagaaguacuacggcaagauccugaagcuccugcaccugacccucgaggaggacaccgaggggcugcuggaguggugcaagcggaaccucggccuggacugcgacgacacguucuuccagaagcgcaucgaggaguucuucaucaccggggagggccacuucaacgaggugcugcaguuccggacccucggcacccuguccacgaccgagagcacccacgccgggagccccaccguggagcccuucaaguccuacuucgccaagggcuuccugagcaucgacuccggguacuucagcgcgaagugcuacucccgcacgagcaacuccggccuccagcugaucaacgucacccggcacagcacccgcaucgccgacacccccgggccgaagaucacgaaccugaagaccaucaacugcaucaaccucaaggccuccguguucaaggagcaccgggagguggagaucaacguccugcugccccagguggccgugaaccucagcaacugccacgucgccaucaagucccacaucugcgacuacagccuggacaccgacggcgcgauccgccugccccagauccaccacgagggcaccuucauccccgggacguacaagaucgugaucgacaagaaguccaagcucaacgaccggugcacccuguucaccaacugcgugaucaagggccgcgagguccggaaggggcagagcgugcugcgccaguacaagaccgagauccggaucggccgcgccuccacggggagccggcgccuccuguccgaggagagcggcgacgacugcaucagccggacccagcugcuccgcaccgagaccgccgagguccacggcgacaacuacgggggcccgggggacaagaucacgaucugcaacggcuccaccgugguggaccagcgccuggggagcgagcugggcugcuacaccaucaaccggguccgcuccuucaagcugugcgagaacagcgccaccggcaaguccugcgagaucgacagcauccccgugaagugcaagcagggguacugccucaagaucacgcaggagggccgggggcacgugaagcugucccgcggcagcgaggucgugcuggacgugugcgacuccagcugcgaggucaugauccccaagggcaccggggacauccucguggacugcuccggcgggcagcagcacuuccugaaggacaaccugguggaccucggcugccccaagaucccgcugcuggggaagauggccaucuacaucugccggaugagcaaccaccccaagaccaccauggcguuccucuucugguucuccuucggcuacgucaucacgugcauccugugcaaggccaucuucuuccugcucaucaucuucggcacccuggggaagcgcuucaagcaguaccgggagcugaagccccagaccugcaccaucugcgagaccacgcccgugaacgccaucgacgccgagaugcacgaccucaacugcagcuacaacaucugcccguacugcgccucccgccugaccagcgacggccuggcgcggcacgugacccagugcccccgccggaaggagaaggucgaggagaccgagcucuaccugaaccuggagcgcauccccuggguggugcggaagcuccugcaggucuccgagagcacggggaccgugcugaagcgcuccagcuggcucaucgugcugcugguccucuucaccgugagccugucccccgugcagagcgccccgaucggccacgggaagaccaucgagacguaccggguccgcgaggaguacaccuccaucugccuguucgugcucggcagcauccuguucaucguguccuuccugaugaagggccucgucgacggggugggcaacaucuucuuccccgggcugagcgugugcaagaccugcuccaucggcagcaucaacggguucgagaucgagucccacaagugcuacugcagccuguucugcugccccuacugccggcacugcuccgccgacggcgagauccaccagcuccaccugagcaucugcaagaagcgcaagaccggcuccaacgucaugcuggccgugugcaagcggaugugcuuccgcgcgacgauggaggugagcaacaaggcccucuucauccgcuccaucaucaacaccaccuucgucgugugcauccugauccuggccgugugcgucgugagcaccuccgccguggagauggagagccuccccgccgggacgugggagcgggaggaggaccugaccaacuucugccaccaggagugccaggucaccgagaccgagugccugugcccguacgaggcgcucgugcugcgccggccccuguuccucgacuccaucgugaagggcaugaagaaccugcugaacagcacgagccucgagaccucccugagcaucgaggcccccuggggcgccaucaacguccaguccaccuacaagccgaccgugagcacggccaacaucgcccuguccuggagcuccguggagcaccgcgggaacaagguccucgugagcgggcgguccgagagcaucaugaagcuggaggagcgcaccggcaucuccugggaccugggcguggaggacgcgagcgaguccaagcuccugaccgucagcgugauggaccugucccagauguacagccccguguucgaguaccucuccggggaccggcaggucgaggaguggcccaaggcgaccugcacgggcgacugccccgagcgcugcgggugcaccagcuccacgugccugcacaaggaguggccgcacagccggaacuggcgcugcaaccccaccuggugcuggggcgugggcaccgggugcacgugcugcggccuggacgucaaggaccucuucaccgacuacauguucgugaaguggaagguggaguacaucaagaccgaggccaucgucugcguggagcugaccagccaggagcggcagugcucccugaucgaggccgggacccgcuucaaccucggcagcgugaccaucacccuguccgagccccggaacauccagcagaagcugcccccggagaucaucacccuccaccccaagaucgaggagggguucuucgaccugaugcacguccagaaggugcugagcgccuccacggugugcaagcuccagagcugcacccacggcguccccggcgaccuccagguguaccacaucgggaaccugcucaagggcgaccgcgugaacgggcaccugauccacaagaucgagcagcacuucaacaccuccuggaugagcugggacggcugcgaccuggacuacuacugcaacaugggggacuggcccuccugcaccuacacgggcgucacccagcacaaccacgcgagcuucgugaaccuccugaacaucgagaccgacuacaccaagacguuccacuuccacuccaagcgggugaccgcccacggcgacaccccgcagcuggaccucaaggcccgccccaccuacggggccggcgaggucacggugcugguggaggucgcggacauggagcugcacaccaagaagaucgagaucagcgggcucaaguucgccggccugaccugcaccgggugcuacgccugcuccagcggcaucuccugcaaggugcggauccacguggacgagcccgacgagcugacgguccacgucaagagcgacgaccccgacgugguggccgccuccagcucccucauggcgcgcaagcuggaguucggcaccgacagcaccuucaaggccuucagcgccaugccgaagaccucccugugcuucuacaucguggagcgggaguacugcaagagcugcuccaaggaggacacgcagaagugcgugaacaccaagcucgagcagccccagagcauccugaucgagcacaaggggaccaucaucggcaagcagaacaacacgugcaccgccaaggccuccugcuggcuggagagcgucaaguccuucuucuacgggcucaagaacaugcugggcggcaucuucgggaacguguucaucggcaucuucaccuuccugacccccuucauccugcucauccuguucuucauguucggguggcgcauccuguucugcuucaagugcugccggcgcacccgcggccucuucaaguaccggcaccugaaggacgacgaggagacgggguaccgcaagaucaucgagcggcugaacaacaagaagggcaagaaccgccuccuggacggcgagcggcuggcggaccgcaagaucgccgagcuguucagcaccaagacccacaucggguga

SEQ ID NO: 12005 - RNA, 5055 nt, Artificial Sequence
  derived and/or modified CDS sequence (opt1) from CCHFV(Iran-52)__DQ446215.1__GP
augcacaucagccugauguacgccguguucugccuccagcugugcggccuggggaagaccaacggcccccacaacgggaccgagcacaacaacacgcacgugaugaccaccccggacgacucccagagccccgagccgcccguguccaccgcccuccccgugacgcccgaccccagcaccgucacccccuccaccccggcgagcggccuggagggguccggcgagguguacacgagcucccccaucaccaccaagggccugagccuccccgaggccaccuccgagcccccggccacgaccagcguggucaccuccagcgccuccgacaccgacagcuccacgcaggccgcgggggacacccccacccccaccgugcgcacgagccugcccuccagcccgagcacccccuccaccagccagggcacccacuaccccgugcggucccugcucagcgucacgucccccaagccggaggagacccccacccccagcaaguccgggaaggacgaccuggccaccaacagcccccacccggccacgucccgccccaccaccccgcccaccacggcccagaagcccaccgagaacaacagccacaacaccaccgagcagcuggagucccucacgcaccuggcgacccugggccucaugaucagccccacccagaccgugcugccccaguccgugaccagcaucgccauccaggacauccacaacuccccgacgaaccggagcaagcgcaaccuggacauggagaucauccucacccugucccaggggcugaagaaguacuacggcaagauccucaagcugcugcaccucacccuggaggaggacaccgagggccugcucgaguggugcaagcggaaccuggggcuggacugcgacgacacguucuuccagaagcgcaucgaggaguucuucaucaccggcgaggggcacuucaacgagguccuccaguuccggacccugggcacccugagcacgaccgaguccacccacgccggcagccccaccguggagcccuucaagagcuacuucgccaagggguuccucuccaucgacagcggcuacuucuccgccaagugcuacagccgcacguccaacagcgggcugcagcugaucaacgugacccggcacuccacccgcaucgcggacacccccggcccgaagaucacgaaccucaagaccaucaacugcaugaaccugaaggccagcgucuucaaggagcaccgggagguggagaucaacgugcugcucccccaggucgccgugaaccuguccaacugccacguggccaucaagagccacaucugcgacuacucccuggacaccgacggggccauccgccucccccagauccaccacgagggcaccuucauccccggcacguacaagaucgucaucgacaagaaguccaagcugaacgaccggugcacccuguucaccaacugcgugaucaaggggcgcgaggugcggaagggccagagcguccuccgccaguacaagaccgagauccggaucgggcgcgcgagcacgggcucccggcgccugcugagcgaggaguccggggacgacugcaucagccggacccagcuccugcgcaccgagaccgccgaggugcacggcgacaacuacggcgggccgggcgacaagaucacgaucugcaacgggagcaccgucguggaccagcgccugggcuccgagcuggggugcuacaccaucaaccgggugcgcagcuucaagcucugcgagaacuccgccaccggcaagagcugcgagaucgacuccauccccgucaagugcaagcagggcuacugccugaagaucacgcaggaggggcggggccacgugaagcugagccgcggguccgaggugguccucgacgugugcgacagcuccugcgaggugaugauccccaagggcaccggcgacauccuggucgacugcagcgggggccagcagcacuuccugaaggacaaccucguggaccuggggugccccaagaucccgcugcucggcaagauggccaucuacaucugccggauguccaaccaccccaagaccaccauggccuuccuguucugguucagcuucggguacgugaucacgugcauccugugcaaggcgaucuucuuccuccugaucaucuucggcacccugggcaagcgcuucaagcaguaccgggagcucaagccccagaccugcaccaucugcgagaccacgcccgucaacgccaucgacgccgagaugcacgaccugaacugcuccuacaacaucugcccguacugcgccagccgccugaccuccgacgggcucgcccggcacgugacccagugcccccgccggaaggagaagguggaggagaccgagcuguaccugaaccucgagcgcauccccugggucgugcggaagcugcuccaggugagcgaguccacgggcaccguccucaagcgcagcuccuggcugaucgugcugcucgugcuguucaccgucagccugagccccgugcaguccgcgccgaucgggcacggcaagaccaucgagacguaccgggugcgcgaggaguacaccagcaucugccucuucguccugggguccauccuguucaucgugagcuuccucaugaagggccugguggacggcgucgggaacaucuucuuccccggccuguccgugugcaagaccugcagcaucggguccaucaacggcuucgagaucgagagccacaagugcuacugcucccucuucugcugccccuacugccggcacugcagcgccgacggggagauccaccagcugcaccuguccaucugcaagaagcgcaagaccggcagcaacgugaugcucgccgucugcaagcggaugugcuuccgcgccacgauggagguguccaacaaggcgcuguucauccgcagcaucaucaacaccaccuucguggucugcauccugauccucgccgugugcguggucuccaccagcgccguggagauggagucccugcccgccggcacgugggagcgggaggaggaccugaccaacuucugccaccaggagugccaggugaccgagaccgagugccucugcccguacgaggcccugguccugcgccggccccucuuccuggacagcaucgugaaggggaugaagaaccugcucaacuccacgagccuggagaccagccuguccaucgaggcgcccuggggcgccaucaacgugcagagcaccuacaagccgaccgucuccacggccaacaucgcccucagcugguccagcguggagcaccgcgggaacaaggugcuggucuccggccggagcgaguccaucaugaagcuggaggagcgcaccgggaucagcugggaccucggcguggaggacgccuccgagagcaagcugcugaccguguccgucauggaccucagccagauguacucccccguguucgaguaccugagcggcgaccgccagguggaggaguggcccaaggcgaccugcacgggggacugccccgagcggugcggcugcaccuccagcacgugccugcacaaggaguggccgcacucccggaacuggcgcugcaaccccaccuggugcuggggcgucgggaccggcugcacgugcugcgggcucgacgugaaggaccuguucaccgacuacauguucgucaaguggaagguggaguacaucaagaccgaggccaucgugugcgucgagcugaccagccaggagcggcagugcagccucaucgaggccggcacccgcuucaaccugggguccgugaccaucacccugagcgagccccggaacauccagcagaagcugcccccggagaucaucacccugcaccccaagaucgaggagggcuucuucgaccugaugcacgugcagaagguccucuccgccagcacggugugcaagcugcaguccugcacccacggggugcccggcgaccugcaggucuaccacaucggcaaccuccugaagggggaccgcgugaacggccaccugauccacaagaucgagcagcacuucaacaccagcuggauguccugggacgggugcgaccucgacuacuacugcaacaugggcgacuggcccagcugcaccuacacgggggugacccagcacaaccacgccuccuucgucaaccugcugaacaucgagaccgacuacaccaagacguuccacuuccacagcaagcgggugaccgcgcacggcgacaccccgcagcucgaccugaaggcccgccccaccuacggcgccggggagaucacggugcuggucgagguggccgacauggagcuccacaccaagaagaucgagaucuccggccugaaguucgcggggcugaccugcaccggcugcuacgccugcagcuccgggaucagcugcaaggugcggauccacgucgaggagcccgacgagcucacggugcacgugaaguccgacgaccccgacgucguggccgccagcuccagccugauggcccgcaagcuggaguucggcaccgacuccaccuucaaggcguucagcgccaugccgaagaccagccucugcuucuacaucguggagcgggaguacugcaaguccugcagcaaggaggacacgcagaagugcgucaacaccaagcuggagcagccccaguccauccugaucgagcacaagggcaccaucaucgggaagcagaacaacacgugcaccgccaaggccagcugcuggcucgaguccgucaagagcuucuucuacggccugaagaacaugcucgggggcaucuucggcaacguguucaucgggaucuucaccuuccugacccccuucauccugcugauccuguucuucauguucggcuggcgcauccucuucugcuucaagugcugccggcgcacccgcgggcuguucaaguaccggcaccugaaggacgacgaggagacgggcuaccgcaagaucaucgagcggcucaacaacaagaaggggaagaaccgccugcuggacggcgagcggcucgccgaccgcaagaucgcggagcuguucuccaccaagacccacaucggcuga

SEQ ID NO: 12006 - RNA, 5055 nt, Artificial Sequence
  derived and/or modified CDS sequence (opt1) from CCHFV(75024)__AB069671.1__GP
augcacaucagccugaugugcgccgugcucugccugcagcuguacgggcucggggagacccacggguccagcaacgagaccgagcacaacaagaccaacguggugaccacccccggggacucccagagcccggagccccugguguccaccacccugcccgucacccucgacagcuccaccgugacccccaccaccccggccagcggccccgagggguccggcgagguguacaccuccccgcccaucaccaccgagggccuguccccgagcgaggccaccuccgagcugcccgccaccaccgggaucggcaucagcuccgccagcgacgucgacuccagcacccaggccgccggggacaccuccacccccaccgugcgcaccuccccgcccaacagcuccagcacgccgcccaccucccaggacacccaccaccccaugcggaaccuccugagcgugacgucccugaagcccgaggagaccagcgcgcccuccaagagcggcaaggagucccccgccgccagcagcccccacccggucgccagccggccgcccacgccgcccaccacggcgcaggggcccaucgagaacaacucccacaacaccaccggccagcucgagagcgugacccaguccgccacgcugggccccauggccagccccacccagaccgugcugucccagaacgucaccagcaucgccauccaggacacgcaccccucccccaccaaccggagcaagcgcaaccucgagauggagaucauccugacccugccccaggggcucaagaaguacuacggcaaggugcugcggcugcuccagcugacccuggaggaggacaccgaggggcuccuggaguggugcaagcgcaaccugggccucgacugcgacgacacguucuuccagaagcggaucgaggaguucuucaucaccggcgaggggcacuucaacgaggugcugcaguuccgcaccccgggcacccugagcacgaccgaguccacccacgccgagagccccaccgcggagcccuucaaguccuacuucgccaagggguuccucagcaucgacuccggcuacuucagcgccaagugcuacucccggacgagcaacuccgggcugcagcugaucaacgucacccgccacagcacccggaucgccgacacccccggcccgaagaucacgaaccucaagaccaucuccugcaucaaccugaaggccagcguguucaaggagcaccgcgagguggagaucaacguccugcucccccagguggcggugaaccuguccaacugccacgucaccaucaagagccacgugugcgacuacucccuggacaucgacggcaccgugcggcucccccacauccaccacgaggggacguucauccccggcaccuacaagaucgucaucgacaagaagaacaagcugaacgaccgcugcacccuguucaccaacugcgugaucaaggggcgggagguccgcaagggccagagcgugcuccggcaguacaagacggagauccgcaucgggaaggccuccaccggcagccggcgccugcugagcgaggaguccggcgacgacugcaucagccggacccagcuccugcgcaccgagacggccgagauccacggggacaacuacggcgggccgggcgacaagaucaccaucugcaacggguccaccaucguggaccagcgccugggcagcgagaugggcugcuacaccaucaaccgggucaaguccuucaagcucugcgagaacagcgccacggggaaguccugcgagaucgacagcauccccgugaagugccgccagggcuacugccugaagaucacccaggaggggcggggccacgugaagcugucccgcggcagcgaggucgugcuggacgccugcgacuccagcugcgaggugaugauccccaaggggaccggcgacauccucgucgacugcuccgggggccagcagcacuuccugaaggacaaccugaucgaccucgggugccccagcaucccgcugcugggcaagauggcgaucuacaucugccggauguccaaccaccccaagaccacgauggccuuccucuucugguucagcuucggcuacgugaucacgugcauccugugcaaggccaucuucuaccugcucaucaucguggggacccugggcaagcgcuucaagcaguaccgggagcugaagccccagaccugcacgaucugcgagaccacccccgccaacgccaucgacgcggagaugcacgaccucaacugcuccuacaacaucugcccguacugcgccagccgccugaccuccgacgggcuggcccggcacgucacccagugccccaagcgcaaggagaagguggaggagacggagcucuaccugaaccuggagcggauccccugggugguccgcaagcuccuccaggugagcgagagcaccggcguggcccugaagcgguccagcuggcucaucguccugcugguccucuucgcgaucucccugagccccgugcaguccgccccgaucgggcacggcaagaccaucgagaccuaccaggcccgcgaggaguacacgagcaucugccuguucguccucggcuccauccuguucaucgugagcugccugaugaaggggcucguggacuccaucggcaacaucuucuuccccgggcugagcaucugcaagaccugcuccaucggcagcaucaacggguucgagaucgagucccacaagugcuacugcagccugcucugcugccccuacugccggcacugcuccgccgaccgcgagauccaccagcugcaccugagcaucugcaagaagcggaagaccggcuccaacgucaugcucgccgugugcaagcgcaugugcuuccgggcgaccauggaggugagcaacaaggcccugcugauccgcuccaucaucaacacgaccuucgucgugugcauccucauccuggccgugugcgucgugagcaccagcgccguggagauggagucccugcccgccggcaccugggagcgcgaggaggaccucacgaacuucugccaccaggagugccaggucaccgagaccgagugccugugcccguacgaggcgcuggugcuccggcgcccccuguuccuggacagcaucgugcgggggaugaagaaccagcucaacuccaccagccuggagacgucccugagcaucgaggcccccuggggcgccaucaacguccaguccaccuacaagccgaccgugagcaccgccaacaucgcccucuccuggagcuccguggagcaccgcgggaacaagauccuggucagcggccgguccgagagcaucaugaagcuggaggagcgcacggggaucuccugggaccucggcguggaggacgcgagcgaguccaagcugcugaccgugagcgucauggaccucucccagauguacagccccguguucgaguaccugagcggcgaccgccagguggaggaguggcccaaggcgaccugcaccggggacugccccgagcgcugcggcugcacgaccagcacgugccugcacaaggaguggccgcacagccggaacuggcgcugcaaccccaccuggugcuggggcgugggcaccggcugcacgugcugcgggcucgacgugaaggaccuguucaccgacuacaugaucgugaaguggaaggucgaguacaucaagaccgaggccaucgugugcguggagcugacgucccaggagcggcagugcagccucaucgaggccggcacccgcuucaaccugggguccgucaccaucacccugagcgagccccggaacauccagcagaagcucccgcccgagaucaucacgcugcacccccgcaucgaggagggcuucuucgaccugaugcacgugcagaagguccucuccgcgagcaccgugugcaagcugcaguccugcacccacggggugcccggcgaccugcaggucuaccacgugggcaaccuccugaagggggacaaggugaacggccaccugauccacaagaucgagccccaccucaacaccagcuggauguccugggacgggugcgaccuggacuacuacugcaacaugggcgacuggcccagcugcaccuacacgggggucacccagcacaaccacgccuccuucgugaaccugcucaacaucgagaccgacuacaccaagagcuuccacuuccacuccaagcgggugacggcccacggcgacacgccccagcuggaccugaaggcccgccccaccuacggcgccggggagaucaccguccucguggagguggcggacauggaguucacgcccaagaagaucgagaucagcggccugaaguucgccucccugaccugcaccgggugcuacgccugcagcuccggcaucagcugcaagguccggauccacguggacgagccggacgagcucaccgugcacgucaagagcgacgaccccgacgugguggccgccuccagcucccugauggcgcgcaagcuggaguucgggacggacagcaccuucaaggccuucuccgccaugcccaagaccagccucugcuucuacaucgucgagcgggaguacugcaaguccugcagcaaggaggacacccagaagugcgugaacacgaagcuggagcagccccaguccauccugaucgagcacaagggcaccaucaucggcaagcagaacaacacgugcaccgccaaggccagcugcuggcucgaguccgucaagagcuucuucuacgggcugaagaacaugcuguccggcaucuucgggaaccucuucaugggcaucuuccuguuccuggcgccguucauccugcucauccuguucuucauguucggcuggcgcauccuguucugcuucaagugcugccggcgcacgcgcggccucuucaaguaccggcaccugaaggacgacgaggagaccggcuaccgccggaucaucgagcgccugaacaacaagaaggggaagaacaagcuccuggacggcgagcggcuggccgaccgccggaucgccgagcuguucagcaccaagacccacaucggguga

SEQ ID NO: 12007 - RNA, 5055 nt, Artificial Sequence
  derived and/or modified CDS sequence (opt1) from CCHFV(7803)__AB069672.1__GP
augcacaucagccugaugugcgccgugcucugccugcagcuguacgggcucggggagacccacggcagcagcaacgagaccgagcacaacaagaccaacguggugaccacccccggggacucccagagcccggagccccugguguccaccacccugcccgucacccucgacagcuccaccgugacccccaccaccccggccagcgagcccgagggcuccggggagguguacaccuccccgcccaucaccaccgagggccuguccccgagcgaggccaccuccgagcugcccgucaccaccggcaucgggaucagcuccgccagcgacguggacuccagcacccaggccgccggcgacaccuccacccccaccgugcgcacgagcccgcccaacagccccuccacgccgcccaccagccaggacacccaccaccccaugcggaaccuccuguccgucacgagccugaaguccgaggagaccagcgcccccuccaagagcgggaaggagucccccgcggccagcagcccccacccgguggccagccggccgcccacccaccccaucaccgcccagggcccgacggagaacaacucccacaacaccaccgggcagcucgagagcgugacccaguccgcgacgcugggccccauggccagccccacccagaccguccugucccagaacgugaccagcaucgccauccaggacacgcaccccuccccgaccaaccggagcaagcgcaaccucgagauggagaucauccugacccugccccagggccucaagaaguacuacgggaaggugcugcggcugcuccagcugacccuggaggaggacaccgagggccuccuggaguggugcaagcgcaaccuggggcucgacugcgacgacacguucuuccagaagcggaucgaggaguucuucaucaccggcgagggccacuucaacgagguccugcaguuccgcacccccgggacccugagcacgaccgaguccacccacgccgagagcccgaccgccgagcccuucaaguccuacuucgcgaagggcuuccucagcaucgacuccggguacuucagcgccaagugcuacucccggacgagcgacuccggccugcagcugaucaacgugacccgccacagcacccggaucgccgacacccccgggcccaagaucacgaaccucaagaccaucuccugcaucaaccugaaggccagcguguucaaggagcaccgcgaggucgagaucaacgugcugcucccccagguggccgucaaccuguccaacugccacgugaccaucaagagccacgugugcgacuacucccuggacaucgacggcaccguccggcucccccacauccaccacgagggcacguucauccccgggaccuacaagaucgugaucgacaagaagaacaagcugaacgaccgcugcacccuguucaccaacugcgucaucaagggccgggaggugcgcaaggggcagagcgugcuccggcaguacaagacggagauccgcaucggcaaggcguccaccgggagccggcgccugcugagcgaggaguccggcgacgacugcaucagccggacccagcuccugcgcaccgagacggccgagauccacggcgacaacuacgggggccccggggacaagaucaccaucugcaacggcuccaccaucgucgaccagcgccuggggagcgagaugggcugcuacaccaucaaccgggugaaguccuucaagcucugcgagaacagcgccacgggcaaguccugcgagaucgacagcaucccggugaagugccgccagggguacugccugaagaucacccaggagggccgggggcacgucaagcugucccgcggcagcgaggugauccuggacgccugcgacuccagcugcgaggugaugauccccaagggcaccggggacauccucgucgacugcuccggcgggcagcagcacuuccugaaggacaaccugaucgaccucggcugccccagcaucccccugcuggggaagauggccaucuacaucugccggauguccaaccacccgaagaccacgauggcguuccucuucugguucagcuucggcuacgugaucacgugcauccugugcaaggccaucuucuaccugcucaucaucgugggcacccuggggaagcgcuucaagcaguaccgggagcugaagccccagaccugcacgaucugcgagaccacccccgccaacgccaucgacgccgagaugcacgaccucaacugcuccuacaacaucugccccuacugcgcgagccgccugaccuccgacggccuggcccggcacgucacccagugcccgaagcgcaaggagaagguggaggagacggagcucuaccugaaccuggagcggauccccugggugguccgcaagcuccuccaggugagcgagagcaccgggguggcccugaagcgguccagcuggcucaucguccugcugguccuguucgccaucucccugagccccgugcaguccgcgcccaucagccacggcaagaccaucgagaccuaccaggcccgcgaggaguacacguccaucugccuguucguccucgggagcauccuguucaucguguccugccugaugaagggccucguggacagcaucggcaacaucuucuucccggggcuguccaucugcaagaccugcagcaucggcuccaucaacggguucgagaucgagagccacaagugcuacugcucccugcucugcugccccuacugccggcacugcagcgccgaccgcgagauccaccagcugcaccuguccaucugcaagaagcggaagaccggcagcaacgucaugcucgccgccugcaagcgcaugugcuuccgggcgaccauggagguguccaacaaggcccugcugauccgcagcaucaucaacacgaccuucguggucuacauccucauccuggccgugugcguggucagcaccuccgccguggagauggagagccugcccgccgggaccugggagcgcgaggaggaccucacgaacuucugccaccaggagugccaggugaccgagaccgagugccugugccccuacgaggcgcugguccuccggcgcccgcuguuccuggacuccaucgugcggggcaugaagaacccccucaacagcaccucccuggagacgagccuguccaucgaggcccccuggggcgccaucaacgugcagagcaccuacaagccgaccgucuccaccgccaacaucgcccucagcugguccagcguggagcaccgcgggaacaagauccugguguccggccggagcgaguccaucaugaagcuggaggagcgcacggggaucagcugggaccucggcgucgaggacgcguccgagagcaagcugcugaccguguccgugauggaccucagccagauguacagccccgucuucgaguaccuguccggggaccgccagguggaggaguggcccaaggcgaccugcaccggcgacugccccgagcgcugcggcugcacgaccuccacgugccugcacaaggaguggccgcacucccggaacuggcgcugcaaccccaccuggugcuggggcgugggcaccgggugcacgugcugcggccucgacgucaaggaccuguucaccgacuacaugaucgugaaguggaagguggaguacaucaagacccggggcaucgucugcguggagcugacgagccaggagcgccagugcucccucaucgaggccgggacccgguucaaccugggcagcgugaccaucacccuguccgagccccgcaacauccagcagaagcugccgcccgagaucaucacgcugcacccccggaucgaggagggguucuucgaccugaugcacguccagaaggugcucagcgccuccaccgucugcaagcugcagagcugcacccacggcgugcccggggaccuccagguguaccacgucggcaaccuccugaagggcgacaaggugaacgggcaccugauccacaagaucgagccccaccucaacaccuccuggaugagcugggacggcugcgaccuggacuacuacugcaacaugggggacuggcccuccugcaccuacacgggcgugacccagcacaaccacgcgagcuucgucaaccugcucaacaucgagaccgacuacaccaaguccuuccacuuccacagcaagcgcgugacggcccacggggacacgccccagcuggaccugaaggcccggcccaccuacggcgccggcgagaucaccgugcucgucgagguggccgacauggaguucacgcccaagaagaucgagaucuccgggcugaaguucgcgagccugaccugcaccggcugcuacgccugcuccagcgggaucagcugcaaggugcgcauccacgucgacgagccggacgagcucaccgugcacgugaaguccgacgaccccgacgucguggccgccagcuccagccugauggcccggaagcuggaguucggcacggacuccaccuucaaggcguucagcgccaugcccaagaccucccucugcuucuacaucguggagcgcgaguacugcaagagcugcuccaaggaggacacccagaagugcgucaacacgaagcuggagcagccccagagcauccugaucgagcacaaggggaccaucaucggcaagcagaacaacacgugcaccgccaaggccuccugcuggcucgagagcgugaaguccuucuucuacggccugaagaacaugcugagcgggaucuucggcaacuucuucauggggaucuuccucuuccuggccccguucauccugcugauccucuucuucauguucggcuggcggauccuguucugcuucaagugcugccgccgcacgcggggccuguucaaguaccgccaccucaaggacgacgaggagaccggguaccggcgcaucaucgagcggcugaacaacaagaagggcaagaacaagcugcucgacggggagcgccuggcggaccggcgcaucgccgagcuguucuccaccaagacccacaucggcuga

SEQ ID NO: 12008 - RNA, 5055 nt, Artificial Sequence
  derived and/or modified CDS sequence (opt1) from CCHFV(Hodzha)__AY223476.1__GP
augcacauccugcucaugugcgccgugcugugccugcagcaguacggccucggggagacccaccgccccaacaacggcaccgagcacaacaagaccaacguccugaccacccccggggacaagcugucccccgagcuccccguguccaccgcccuguccgugacccccgacuccagcaccgucacccccaccacccccguguccggccuggaggggagcggcgacguguacaccagcccgcccgucaccaccaagggccucagcccguccaaggccaccagcgagcugcccgccuccagcgggaucgacaccuccagcgccuccgacguggacagcuccacccaggccgcccgggacaccagcacgcugaccgugcgcaccagcccgcccagcagcccguccacgccgcccacgagccaggacaccuaccaccucguccggaaccugcuguccgugaccagccccuggccggaggagaccacggcgcccuccaagagcggcaaggagucccccguggccaacagcccccacccggucaccucccgccccagcagcccgcccaucaccgugcaggggccgaccgagaacagcucccacaacacgaccggccagcucgagagcauggcccaguccaccacccuggugcccauggccagccccacgcagaccguccugucccagagcgugaccucccucgcggugcaggacgcccaccccagcccgaccaaccggagcaagcgcaaccuggagauggucaucauccugacgcucccccaggggcugaagaaguacuacggcaaggugcugcggcuccugcagcugacccucgaggaggacaccgagggccugcuggaguggugcaagcgcaaccucgggcuggacugcgacgacaccuucuuccagaagcggaucgaggaguucuucaucaccggcgaggggcacuucaacgaggugcugcaguucaagacgcccuccacccucagcaccaccgaguccacgcacgccgucagcccgaccgccgagcccuucaaguccuacuucgccaagggcuuccugagcaucgacuccggcuacuucagcgcgaagugcuacuccaagaccagcaacuccgggcugcagcucaucaacgugacccgccacagcacgcggaucgccgacacccccggccccaagaucaccaaccugaagaccaucuccugcaucaaccugaaggccagcguguucaaggagcaccgcgaggucgagaucaacgugcuccugccgcaggucgccgugaaccuguccaacugccacgugacgaucaagagccacgucugcgacuacucccucgacguggacgggaccgugcggcugccccacauccaccacggcgggaccuucauccccggcaccuacaagaucgucaucgacaagaagaacaagcugaacgaccgcugcacgcucuacaccaacugcgugaucaagggccgggaggugcgcaaggggcagagcauccugcggcaguacaagaccgagauccgcaucggcaaggccagcaccgggucccggcgccugcucagcgaggaguccggcgacgacugcaucagccggacgcagcugcugcgcaccgagaccgcggagauccacggggacgacuacggcggccccggggacaagaucaccaucugcaacggcuccacgaucgucgaccagcgccuggggagcgagcucggcugcuacaccaucaaccgggugaaguccuucaagcugugcaagaacagcgccaccgggaaguccugcgagaucgacagcaccccggugaagugccgccagggcuacugccugaagaucacgcaggagggccgggggcacgucaagcucucccgcggcagcgagguggugcuggacgccugcgacuccagcugcgaggucaugauccccaaggggaccggcgacauccugguggacugcuccggcgggcagcagcacuuccucaaggacaaccugaucgaccugggcugcccccggaucccccuccuggggaagauggccaucuacaucugccgcaugagcaaccacccgaagaccaccauggccuuccuguucugguucuccuucggcuacgugaucacgugcauccucugcaaggcgaucuucuaccugcugaucaucgucgggacccucggcaagcgguucaagcaguaccgcgagcugaagccccagaccugcaccaucugcgagacgacccccgccaacgccaucgacgccgagaugcacgaccugaacugcagcuacaacaucugccccuacugcgccucccggcucaccagcgacggccuggcgcgccacgugacccagugcccgaagcggaaggagaagguggaggagaccgagcuguaccucaaccuggagcgcauccccuggaucguccggaagcugcuccaggugagcgaguccacggggguggcccugaagcgcagcuccuggcugaucguccuccuggugcuguucgccgugagccucucccccguccagagcgcccccaucggccacgggaagaccaucgagaccuaccaggcgcgggaggacuacaccuccaucugccuguucgugcugggcagcauccucuucaucguguccugccugaugaaggggcuggucgacagcaucggcaacaucuucuucccgggccucacgaucugcaagaccugcuccaucgggagcaucaacggcuucgagaucgagucccacaagugcuacugcagccugcugugcugccccuacugccgccacugcuccgccgaccgggagauccaccagcuccaccugagcaucugcaagaagcgcaagaccggguccaacgugaugcuggccgugugcaagcggaugugcuuccgcgccaccauggaggucagcaacaaggcccuccugauccgcuccaucaucaacacgaccuucguggugugcauccugauccucgcggucugcguggugagcaccagcgccgucgagauggagucccugcccgccggcaccugggagcgggaggaggaccugacgaacuucugccaccaggagugccaggugaccgagaccgagugccucugccccuacgaggcccuggugcugcgccggccccuguuccuggacagcaucgucaaggggaccaagaaccugcucaacuccacgagccuggagaccucccugagcaucgaggcccccuggggcgcgaucaacgugcaguccaccuacaagcccaccgugagcacggccaacaucgcccucuccuggagcuccgucgagcaccgcggcaacaagauccuggugagcgggcgguccgagagcaucaugaagcuggaggagcgcaccggcaucuccugggaccucgggguggaggacgccagcgaguccaagcugcugaccgucagcgugauggaccucucccagauguacagcccgguguucgaguaccugagcggcgaccggcaggucgaggaguggcccaaggcgaccugcacgggggacugccccgagcgcugcggcugcaccuccagcacgugccugcacaaggaguggccccacucccggaacuggcgcugcaacccgaccuggugcuggggcguggggaccggcugcacgugcugcgggcucgacgucaaggaccuguucaccgacuacauguucgugaaguggaagguggacuacaucaagaccgaggcgaucgucugcguggagcugacgagccaggagcggcagugcucccucguggaggccggcacccgcuucaaccugggccccgucaccaucacccugagcgagccccggaacauccagcagaagcucccgcccgagaucaucacgcugcacccccgcaucgaggagggguucuucgaccugaugcacgugcagaaggugcucuccgccagcaccgucugcaagcugcaguccugcacccacggcgugcccggggaccuccagguguaccacaucggcaaccuccugaagggggacaaggucaacggccaccugauccacaagaucgagccccacuucaacaccagcuggauguccugggacggcugcgaccucgacuacuacugcaacaugggggacuggcccagcugcaccuacacgggcgugacccagcacaaccacgccuccuucgugaaccugcugaacaucgagaccgacuacaccaagagcuuccacuuccacuccaagcgggucacggcgcacggggacacgccccagcucgaccugaaggcccgccccaccuacggcgccggggagaucaccgugcugguggaggucgccgacauggagcuccacacgaagaagaucgagaucaccggccugaaguucgccagccugaccugcaccggcugcuacgcgugcuccagcgggaucuccugcaaggugcggauccacguggacgagcccgacgagcucacgguccacgugaaguccgacgacccggacguggucgccgccagcuccagccugauggcccgcaagcuggaguucggcaccgacuccaccuucaaggccuucagcgcgaugcccaagaccucccucugcuucuacaucguggagcgggaguacugcaagagcugcuccaaggaggacacgcagaagugcgugaacaccaagcuggagcagccccagagcauccugaucgagcgcaaggggaccaucaucggcaagcagaacaacacgugcacggccaaggccuccugcuggcuggagagcgucaaguccuucuucuacgggcucaagaacaugcugagcggcaucuucggcaacguguucguggggaucuuccuguuccucgcccccuucauccugcugauccucuucuucauguucggcuggcggauccuguucugcuucaagugcugccgccgcacccgggggcuguucaaguacaagcaccucaaggacgacgaggagaccggcuaccgccggaucaucgagcgccugaacaacaagaagggcaagaacaagcugcucgacggggagcggcuggccgaccgccggaucgcggagcuguucuccaccaagacgcacaucggcuga

SEQ ID NO: 12009 - RNA, 5055 nt, Artificial Sequence
  derived and/or modified CDS sequence (opt1) from CCHFV(Hodzha)__KX013448.1__GP
augcacauccugcucaugugcgccgugcugugccugcagcaguacggccucggggagacccaccgccccaacaacggcaccgagcacaacaagacgaacguccugaccaccccgagcgacaagcugucccccgagccgcccgugagcaccgcccucuccgugacgcccgacagcuccaccgucacccccaccacgcccgugagcgggcuggagggcuccggggagguguacaccagcccgcccgucaccaccaagggccugucccccagcaaggcgacguccgagcuccccgccaccaccggcaucgacaccagcuccgccagcgacguggacuccagcacgcaggccgcccgggacaccuccacccugaccgugcgcacgagcccgcccuccagccccagcaccccgcccaccucccaggacaccuaccaccugguccggaaccuccugagcgugacgagcccccgccccgaggagaccaccgcgcccuccaaguccgggaaggagagccccguggccaacuccccgcaccccgucaccagccggcccuccagcccgcccaucacggugcagggccccaccgagaacuccagccacaacaccaccgggcagcuggaguccauggcccagagcacgacccucgugcccauggccucccccacccagaccguccugagccaguccgugacgagccuggcggugcaggacgcccacccgucccccaccaaccgcagcaagcggaaccucgagauggagaucauccugacccugccccagggccucaagaaguacuacgggaagguccugcgccugcuccagcugacccuggaggaggacaccgagggccuccuggaguggugcaagcggaaccugggccucgacugcgacgacacguucuuccagaagcgcaucgaggaguucuucaucaccggggagggccacuucaacgaggugcugcaguucaagaccccgagcacccuguccacgaccgagagcacccacgccgugucccccaccgccgagcccuucaagagcuacuucgccaagggguuccucuccaucgacagcggcuacuucuccgcgaagugcuacagcaagacguccaacagcggccugcagcugaucaacgucacccggcacuccacccgcaucgccgacacccccgggccgaagaucacgaaccucaagaccaucagcugcaucaaccugaaggccuccguguucaaggagcaccgggagguggagaucaacguccugcucccccagguggccgucaaccugagcaacugccacgugaccaucaagucccacgugugcgacuacagccuggacgucgacggcaccgugcgccucccccacauccaccacgggggcacguucauccccgggaccuacaagaucgugaucgacaagaagaacaagcugaacgaccggugcacccuguacaccaacugcgucaucaagggccgcgaggugcggaagggccaguccauccuccgccaguacaagacggagauccggaucgggaaggccagcaccggcagccgccggcugcuguccgaggagagcggggacgacugcaucucccgcacccagcuccugcgcaccgagacggcggagauccacggcgacgacuacgggggcccgggcgacaagaucaccaucugcaacgggagcaccaucguggaccagcggcugggcuccgagcuggggugcuacaccaucaaccgcgucaagagcuucaagcucugcgagaacuccgccacgggcaagagcugcgagaucgacuccacccccgugaagugccggcagggguacugccugaagaucacccaggagggccgcggccacgugaagcugagccggggguccgaggucgugcucgacgccugcgacagcuccugcgaggugaugauccccaagggcaccggggacauccuggucgacugcagcggcggccagcagcacuuccugaaggacaaccucaucgaccuggggugcccccgcaucccgcugcucggcaagauggccaucuacaucugccggauguccaaccaccccgagacgaccauggccuuccuguucugguucagcuucggguacgugaucacgugcauccugugcaaggcgaucuucuaccuccugaucaucgugggcacccuggggaagcgcuucaagcaguaccgggagcucaagccccagaccugcaccaucugcgagaccacccccgccaacgccaucgacgccgagaugcacgaccugaacugcuccuacaacaucugcccguacugcgccagccgccugaccuccgacggccucgcgcggcacgucacgcagugccccaagcgcaaggagaagguggaggagaccgagcuguaccugaaccucgagcggauccccuggaucgugcgcaagcugcugcaggucagcgagagcaccggcguggcccucaagcgguccagcuggcugaucgugcugcucguccuguucgccgugucccugagccccgugcaguccgccccgaucgggcacggcaagaccaucgagacguaccaggcgcgcgaggaguacaccagcaucugccucuucguccugggguccauccuguucaucgugagcugccucaugaagggccugguggacuccaucgggaacaucuucuuccccggccugaccaucugcaagaccugcagcaucggcuccaucaacggguucgagaucgagagccacaagugcuacugcucccuccugugcugccccuacugccggcacugccccgccgaccgcgagauccaccagcugcaccucagcaucugcaagaagcggaagacgggcuccaacgucaugcuggccgugugcaagcgcaugugcuuccgcgccaccauggaggugagcaacaaggcccugcucauccgguccaucaucaacaccaccuucgucgugugcauccugauccuggcggugugcgucgugagcacguccgccguggagauggagagccucccggccgggaccugggagcgcgaggaggaccugaccaacuucugccaccaggagugccaggucaccgagacggagugccugugccccuacgaggcccucgugcugcggcgcccccuguuccucgacagcaucgugaagggcaagaagaaccugcugaacuccaccagccucgagaccucccugagcaucgaggccccguggggcgcgaucaacguccaguccaccuacaagcccacggugagcaccgccaacaucgcccuguccuggagcuccguggagcaccgggggaacaagauccucgucagcggccgcuccgagagcaucaugaagcuggaggagcggaccgggaucuccugggaccugggcguggaggacgccagcgaguccaagcuccugaccgugagcgucauggaccugucccagauguacagccccguguucgaguaccucuccggggaccgccagguggaggaguggcccaaggccacgugcaccggcgacugcagcgagcggugcgggugcaccagcuccacgugccugcacaaggaguggccgcacagccgcaacuggcggugcaaccccaccuggugcuggggcgucggcaccgggugcacgugcugcggccuggacgugaaggaccucuucaccgacuacauguucgucaaguggaagguggacuacaucaagaccgaggcgaucgugugcgucgagcugaccucccaggagcgccagugcagccugguggaggccgggacccgguucaaccucggccccgugaccaucacgcuguccgagccccgcaacauccagcagaagcugccgcccgagaucaucacccuccacccccggaucgaggagggcuucuucgaccugaugcacguccagaaggugcugagcgccuccaccgugugcaagcuccagagcugcacccacgggguccccggcgaccuccagguguaccacaucgggaaccugcugaagggcgacaaggugaacgggcaccugauccacaagaucgagccgcacuucaacaccuccuggaugagcugggacggcugcgaccuggacuacuacugcaacaugggcgacuggcccuccugcacguacaccggggucacccagcacaaccacgccagcuucgugaaccuccugaacaucgagaccgacuacacgaaguccuuccacuuccacagcaagcgcgugaccgcgcacggcgacacgccccagcuggaccucaaggcccggcccaccuacggggccggcgagaucaccguccugguggagguggccgacauggagcugcacaccaagaagaucgagaucaccgggcucaaguucgccucccugaccugcacgggcugcuacgcgugcagcuccggcaucagcugcaagguccgcauccacguggacgagccggacgagcugaccgugcacgucaaguccgacgaccccgacgugguggccgccagcagcucccucauggcccggaagcuggaguucgggaccgacagcaccuucaaggccuucuccgcgaugcccaagacgagccugugcuucuacaucgucgagcgcgaguacugcaaguccugcagcaaggaggacacccagaagugcgugaacaccaagcucgagcagccccaguccauccugaucgagcagaagggcaccaucaucgggaagcagaacaacacgugcaccgccaaggccagcugcuggcuggaguccgucaagagcuucuucuacggccugaagaacaugcucuccgggaucuucggcaacguguucgugggcaucuuccuguuccuggccccguucauccuccugauccuguucuucauguucggguggcggauccucuucugcuucaagugcugccgccgcacccggggccuguucaaguacaagcaccugaaggacgacgaggagaccggguaccgccggaucaucgagcgccucaacaacaagaagggcaagaacaagcugcuggacggcgagcggcucgccgaccgccggaucgcggagcuguucagcacgaagacccacaucggguga

SEQ ID NO: 12010 - RNA, 5055 nt, Artificial Sequence
  derived and/or modified CDS sequence (opt1) from CCHFV(Baghdad 12)__AJ538197.2__GP
augcacaucagccugaucuacgccgugcucugccugcagcuguacggccucggggagacccacggcuccagcuccgggaccgagcacaaccgcacgaacgucguggccacccccggcgggagccaguccccggagccccuggugagcaccacccugcccgucacgcucgacuccagcaccgugacccccgcgacccaggccuccggcccggagggcagcggggagguguacacguccccccccaccaccaccgagggccugagccccuccgacgccacgagcgagcugccgaccaccaccgggaucggcaucuccagcuccagcgacgucaacuccagcacgcaggccgccggggacaccagcacccccaccgcgcggacgucccuccccgacagccccuccaccccgcccaccagccaggacacccaccaccccaugcgcaaccugcuguccgugacgagccucaagcccgaggagaccccggcccccuccaagagcggcaaggagucccccgccgccagcuccccccacccgguggcgagccggccccccacccccuccaccacggcccagggcccgaccgagaacaacagccgcaacaccaccguccagcugaaguccgugacgcagagcgccacccuggggcccauggccucccccacccagaccgugcuccugcagagcgucacguccaucgccauccaggacacccaccccagcccgaccaaccggagccgccggaaccuggagauggagaucauccucacccugccccagggccugaagaaguacuacgggaaggugcuccgccugcugcagcucacccuggaggaggacacggagggccugcucgaguggugcaagcggaaccugggccuggacugcgacgacaccuucuuccagaagcgcaucgaggaguucuucaucaccggggagggccacuucaacgaggugcuccaguuccggacccccgggacgcuguccaccaccgagagcacccacgcgggcuccccgacggucgagcccuucaagagcuacuucgccaagggguuccugcucaucgacuccggcuacuucagcgccaagugcuacucccgcaccagcaacuccggccugcagcugaucaacgugacccggcacagcaccaagaucgccgacacgcccgggcccaagaucaccaaccucaagaccaucuccugcaucaaccugaaggccagcaucuucaaggagcaccgcgagaucgagaucaacgugcugcucccgcaggucgcggugaaccuguccaacugccacgugaccaucaagagccacgucugcgacuacucccugaacaucgacggcacggugaagcucccccacauccaccacgaggggaucuucauccccggcaccuacaagaucgugaucgacaagaagaacaagcugaacgaccggugcacccuguucaccaacugcgucaucaaggggcgcgaggugcggaagggccagagcguccuccgccaguacaagacggagauccggaucggcaaggccuccaccgggagccgccggcugcugagcgaggaguccggcgacgacugcaucagccgcacccgccuccugcggaccgagacggccgagauccacggggacuccuacggcgggcccggcgacaagaucaccaucugcaacggcagcaccaucguggaccagcgccugggguccgagaugggcugcuacaccaucaaccgggugaagagcuucaagcugugcgagaacuccgccacggggaagagcugcaagaucgacuccaucccggucaagugccgccagggcuacugccucaagaucacccaggagggccgggggcacgugaagcugagccgcggcuccgaggugguccuggacgccugcgacagcuccugcgaggugaugauccccaaggggaccggcgacauccucguggacugcagcgggggccagcagcacuuccugaaggacaaccugaucgaccucggcugccccaacaucccccugcuggggaagauggcgaucuacaucugccggauguccaaccacccgaagaccacgauggccuuccucuucugguucagcuucggcuacgucaucaccugcauccugugcaaggccaucuucuaccugcucaucaucguggggacccugggcaagcgcuucaagcaguaccgggagcugaagccccagaccugcacgaucugcgagaccacccccgugaacgccaucgacgccgagaugcacgaccucaacugcuccuacaacaucugccccuacugcgcgagccgccugaccuccgacgggcuggcccggcacgucacccagugcccgaagcgcaaggagaagguggaggagacggagcucuaccugaaccuggagcggauccccugggugguccgcaagcuccugcaggugagcgagagcaccggcguggcccugaagcgguccagcuggcucaucguccugcuggugcuccuggccguguccagcucccccguccagagcgcgcccaucggcuacgggaagaccaucgagaccuaccaggcccgcgagggcuacacguccaucugccuguucgugcucgggagcauccuguucaucguguccugccugaccaagggccucgucgacagcaucgggaacaucuucuucccgggccuguccaucugcaagaccugcagcaucggcuccaucaacggguucgagguggagagccacaagugcuacugcucccugcucugcugccccuacugccggcacugcagcgccgaccgcgagauccaccagcugcaccuguccaucugcaagaagcggaagaccggcagcuccgugaugcucgccgucugcaagcgcaugugcuuccgcgccacgauggaggugagcaacaaggcgcugcugauccggagcaucaucaacaccaccuucguggucugcauccucacccuggccgugugcguggucuccacgagcgccguggagauggagucccugcccgccgggaccugggagcgcgaggaggaccucaccaacuucugccaccaggagugccaggugaccgagacggagugccugugccccuacgaggcccugguccuccggaagccgcuguuccuggacagcaucgugaagggcaccaagaaccuccugaacuccaccagccuggagaccucccucagcaucgaggcgcccuggggggccaucaacgugcaguccacguacaagcccaccgucagcaccgccaacaucgcccuguccuggagcuccguggagcaccgcggcaacaagauccuggugagcggccgguccgagagcaucaugaagcucgaggagcgcaccgggaucuccugggaccugggcgucgaggacgccagcgaguccaagcugcucacggugagcgugauggaccugagccagauguacuccccggucuucgaguaccugagcggggaccggcagguggaggaguggcccaaggcgaccugcaccggcgacugccccgagcgcugcggcugcaccacguccaccugccuccacaaggaguggccccacagccggaacuggcgcugcaacccgaccuggugcuggggggugggcaccgggugcacgugcugcggccuggacgucaaggaccuguucaccgacuacauguucgugaaguggaagguggaguacaucaagaccgacgccaucgucugcguggagcucaccucccaggagcggcagugcagccugaucgaggccgggacgcgcuucaaccugggcuccgucaccaucacccucagcgagccccggaacauccagcagaagcugccccccgagaucaucacccugcacccgcgcaucgaggagggcuucuucgaccucaugcacgugcagaaggugcuguccgccagcaccgucugcaagcugcaguccugcacgcacggggugcccggcgaccuccagguguaccacaucgggaaccugcugaagggcgacaaggucaacgggcaccucauccacaagaucgagccccacuucaacaccagcuggauguccugggacggcugcgaccuggacuacuacugcaacaugggcgacuggcccagcugcaccuacaccggggugacgcagcacaaccacgcguccuucgugaaccugcucaacaucgagaccgacuacaccaagagcuuccacuuccacuccaagcgggucaccgcccacggcgacacgccgcagcuggaccugaaggugcgccccaccuacggggccggcgagaucaccgugcucgucgagguggccgacauggagcugcacaccaagaagaucgagaucagcgggcugaaguucgccucccucacgugcaccggcugcuacgcgugcagcagcggcaucuccugcaaggugcggauccacgucgacgagcccgacgagcugaccgugcacgugaagagcgacgaccccgacgucguggccgccuccagcucccugauggcccgcaagcucgaguucgggaccgacagcacguucaaggccuucuccgcgaugccgaagaccagccugugcuucuacaucguggagcgggaguacugcaaguccugcagcaaggaggacacccagaagugcgucaacaccaagcuggagcagccccaguccauccucaucgagcacaagggcacgaucaucgggaagcagaacaacaccugcaccgccaagaccagcugcuggcuggaguccgugaagagcuucuucuacggccugaagaacaugcuguccggcaucuucgggaacuucuucaugggcaucuuccucuuccuggcccccuucauccugcucauccuguucuucauguucggguggcgcauccuguucugcuucaagugcugccggcgcacgcgcggccucuucaaguaccggcaccugaaggacgacgaggagaccggguaccgccggaucaucgagcgccugaacaacaagaagggcaagaacaagcuccuggacggcgagcggcuggccgaccgccggaucgccgagcucuucagcaccaagacccacaucggguga

SEQ ID NO: 12011 - RNA, 5055 nt, Artificial Sequence
  derived and/or modified CDS sequence (opt1) from CCHFV(TADJ/HU8966 )__AY179962.1__GP
augcacaugcugcucaugugcgccgugcugugccugcagcucuacggccucgggggcacccugcgcagcaacaacgggaccgagcacaacaagacgaacguccucaccacccccggcgacaagcuguccccggagccgcccgugagcaccgcccugcccgugacgccggacuccagcaccgucacccccaccacgcccgcguccgggcucgagggcagcggcgagguguacaccagcccgcccaucaccaccaaggggcugucccccuccgaggccacgagcgagccgcccgccaccaccggcauggggaucuccagcgccuccggcguggacuucagcacccaggccgcgcgggacacguccacccugaccguccucaccagcccgcccaacucccccaacacgcccccgaccagccaggacacccaccaccccgugcgcucccugcugagcgugaccagcccccggcccgaggagacgaccgccccguccaagagcgggaaggagucccccgccgccaacagcucccaccccgucaccagccgccccuccagcccgcucaucaccgugcggggccccacggagaacuccagccacaacaccaccggccagcuggaguccaugacccagagcacgacccuggugcccauggcgucccccacccagaccguccucagccaguccgugacgagcaucgccgugcaggacgcccacccguccagcaccaaccgcuccaagcggaaccuggagauggagaucauccugacccucccccaggggcugaagaaguacuacggcaagguccugcgccuccugcagcugacccucgaggaggacaccgaggggcugcuggaguggugcaagcggaaccucggccuggacugcgacgacacguucuuccagaagcgcaucgaggaguucuucaucaccggcgaggggcacuucaacgaggugcugcaguuccggacccccggcacccucagcacgaccgagagcacccacgccggguccccgaccgccgagcccuucaagagcuacuucgcgaagggcuuccuguccaucgacagcggguacuucuccgccaagugcuacagccgcacguccaacagcggccugcggcucaucaacgugacccgccacuccacccggaucgccgacacccccggccccaagaucacgaaccugaagaccaucagcugcaucaaccugcgcgccuccaucuucaaggagcaccgggaggucgagaucaacgugcuccugccccagguggccgucaaccugagcaacugccacguggcgaucaagucccacgugugcgacuacagccucgacgucgacgggaccgugcgccugccccacauccaccacggcgggaccuucauccccggcacguacaagaucgucaucgacaagaagaacaagcugaacgaccggugcacccucuucaccaacugcgugaucaaggggcgcgaggugcggaagggccaguccauccugcgccaguacaagaccgagauccgcaucggcaaggccagcacggggucccggcgccugcucagcgaggagagcggcgacgacugcaucucccggacccagcugcugcgcaccgagaccgccgagauccacggggacgacuacggcgggcccggcgacaagaucacgaucugcaacggcagcaccaucgucgaccagcggcugggguccgagcucggcugcuacaccaucaaccgcgucaagagcuucaagcugugcgagaacuccgccaccgggaagaacugcgagaucgacagcgugcccgugaagugccggcagggcuacugccugaagaucacgcaggagggccgcgggcacgugaagcucucccggggcagcgaggugguccuggacgccugcgacuccagcugcgaggugaugauccccaaggggaccggcgacaucuccguggacugcagcgggggccagcagcacuuccugaaggacaaccucaucgaccugggcugccccaagaucccccugcucgggaagauggcgaucuacaucugccgcauguccaaccacccgaagaccaccauggccuuccuguucugguucagcuucggcuacgucaucacgcggauccugugcaaggccaucuucuaccuccugaucaucguggggacccugggcaagcgcuucaagcaguaccgggagcucaagccccagaccugcaccaucugcgagacgacccccgccaacgccaucgacgcggagaugcacgaccugaacugcuccuacaacaucugccccuacugcgccagccgccugaccuccgacgggcucgcccggcacgugacccagugcccgaagcgcaaggagcgggucgaggagaccgagcuguaccugaaccucgagcgcauccccuggaucgugcggaagcugcuccaggugagcgaguccacgggcgucgcccugaagcgcagcagcuggcugaucgugcugcucgugcuguucaccgucucccugagccccgugcaguccgcgcccaucggcuacgggaacaccaucgagaccuaccaggcccgcgaggaguacacgagcaucugccucuucgugcugggcuccauccuguucaucgucagcugccucaugaaggggcugguggacuccaucggcaacaucuucuucccggggcugaccaucugcaagaccugcagcaucggcuccaucaacggcuucgagaucgagagccacaagugcuacugcucccuccugugcugccccuacugccggcacugcagcgccgaccgcgagauccaccagcugcaccucuccaucugcaagaagcggaagaccgggagcaacgugaugcuggccgucugcaagcgcaugugcuuccgggccacgauggagguguccaacaaggcgcugcucauccgcagcaucaucaacaccaccuucguggucugcauccugauccuggccgugugcaucguguccaccagcgccgucgagauggagucccuccccgccggcacgugggagcgggaggaggaccugaccaacuucugccaccaggagugccaggugaccgagaccgagugccugugccccuacgaggcccucgugcugcgccggccgcuguuccucgacagcaucgucaaggggaugaagaacccccugaacagcacgucccuggagaccagccucuccaucgaggcgcccuggggcgccaucaacgugcagagcaccuacaagccgaccguguccacggccaacaucgcccugagcugguccagcaucgagcaccgcgggaacaacauccuggucuccggccggagcgaguccaucaugaagcucgaggagcgcaccggcaucagcggggaccugggcguggaggacgccuccgagagcaagcugcucaccguguccgucauggaccugagccagauguacucccccguguucgaguaccugagcggggaccgccagguggaggaguggcccaaggcgaccugcacgggcgacugccccgagcggugcggcugcaccuccagcacgugccuccacaaggaguggccgcacagccggaacuggcgcugcaaccccaccuggugcuggggcgucgggaccgggugcacgugcugcggccuggacgugaaggaccuguucaucgacuacauguucgugaaguggaaggucgacuacaucaagaccgaggccaucgugugcguggagcucaccucccaggagcggcagugcagccuggucgaggccgggacccgcuucaaccugggccccgugaccaucacccucuccgagccccggaacauccagcagaagcugccgcccgagaucaucacccugcacccccgcaucgaggagggcuucuucgaccucaugcacguccagaaggugcugagcgccuccacggugugcaagcugcagagcugcacccacgggguccccggcgaccuccagguguaccacaucgggaaccugcugaagggcgacaaggagaacgggcaccucauccacaagaucgagccgcacuucaacaccuccuggaugagcugggacggcugcgaccuggacuacuacugcaacaugggcgacuggcccuccugcaccuacaccggggugacgcagcacaaccacgcgagcuucgucaaccugcucaacaucgagaccgacuacaccaaguccuuccacuuccacagcaagcgggugaccgcccacggcgacacgccccagcuggaccugaaggcccgccccaccuacggggccggcgagaucaccgugcucgucgagguggccgacauggagcugcacaccaagaagaucgagaucacggggcugaaguucgcgucccugaccugcaccggcugcuacgccugcagcuccggcaucagcugcaaggugcgcauccacgucgacgagccggacgagcugaccgugcacgugaaguccgacgaccccgacgucguggccgccagcuccagccugauggcccggaagcucgaguucgggacggacagcaccuucaaggcguucuccgccaugcccaagaccagccugugcuucuacaucguggagcgcgaguaccggaaguccugcagcaaggaggacacccagaagugcgucaacacgaagcuggagcagccccaguccauccucaucgagcacaagggcaccaucaucgggaagcagaacaacacgugcaccgccaaggccagcugcuggcuggaguccgucaagagcuucuucuacggccugaagaacaugcuguccggcaucuucgggaacguguucgugggcaucuuccucuuccuggccccguucauccugcucauccuguucuucauguucggguggcgcauccugagcugcuucaagugcugccggcgcacccggggccuccugaagcaccgccaccugaaggacgacgaggagaccggguaccggcgcaucaucgagcggcucaacaacaagaagggcaagaacaagcugcuggacggcgagcgccucgcggaccggcgcaucgccgagcuguucuccaccaagacccacaucggguga

SEQ ID NO: 12012 - RNA, 5055 nt, Artificial Sequence
  derived and/or modified CDS sequence (opt1) from CCHFV(K168_40)__KX013457.1__GP
augcacaucagccugaugugcgccgugcucugccugcagcuguacggccucgggggcacccacgggcugcacaacggcaccgagcacaacaagacgaacgccgucaccaccuccagcaacucccagagcuccgagagccccgcgcgcaccgccccgcccgugacgcccgacucccccaccgugaccccgaccacgcccgccagcgcccccgagggguccggcgaggcccacagcucccccccgaacaacaccgagggccccagccugcccgaguccaccagcgagcccccggcggccaccuccacggggauccccagcgccuccgacgucaacagcuccacccaggccgcgcgggacaccagcacccccacggugcgcaccagccccccgaacucccccagcaccccccccaccccgcaggagacgcaccaccccgugcggaaccuccuguccgucaccagccacaagcccgaggagaccuccgcccccagcgaguccggcaaggagagcccggccgccaacuccccccaccccguggccagccgccccccgacccccuccacgaccgcgcaggggcccaccgagaacaacaacuacaacaccacgggccagcuggagagccucacccaguccaccacccuggggccgaugacgagccugacccagaccgaccucccccaguccgugaccagcaucgccguccaggacacgcaccccucccccaccaaccggagcaagcgcaaccuggagauggagaucauccugacccucccgcagggccugaagaaguacuacggcaaggugcugcggcuccugcagcugacccucgaggaggacaccgaggggcugcuggaguggugcaagcgcaaccucggccuggacugcgacgacacguucuuccagaagcggaucgaggaguucuucaucaccggggagggccacuucaacgaggugcugcaguuccgcacccccggcacccucuccacgaccgagagcacccacgccgggcugcccaccgccgagcccuucaagagcuacuucgccaagggcuuccuguccaucgacagcggguacuucuccgcgaagugcuacagccggacguccaacagcggccuccagcugaucaacgucacccgccacuccacccggaucgccgacaccccggggcccaagaucacgaaccugaagaccaucagcugcaucaaccucaaggccuccguguucaaggagcaccgcgagguggagaucaacguccugcugccccagguggccgugaaccucagcaacugccacgucaccaucaagucccacgugugcgacuacagccuggacaucgacggcaccgugcggcugccccacauccaccacgacggcacguucaucccggggaccuacaagaucgucaucgaccgcaagaacaagcucaacgaccggugcacccuguucaccaacugcgugaucaagggccgcgaggugcggaaggggcaguccguccugcgccaguacaagacggagauccggaucggcaaggccagcaccgggucccgccgccuccugagcgacgaguccggcgacgacugcaucagccggacccagcugcuccgcaccgagacggcggagauccacggcgacaacuacgggggccccggggacaagaucaccaucugcaacggcagcaccaucguggaccagcggcugggguccgagcugggcugcuacaccaucaaccgcgucaagagcuucaagcucugcgagaacuccgccacgggcaagagcugcgagguggacuccauccccgugaagugccggcagggguacugccugaagaucacccaggagggccgcgggcacgucaagcugagccggggcuccgagguggugcuggacgccugcgacagcuccugcgaggucaugauccccaagggcaccggggacauccucguggacugcagcggcgggcagcagcacuuccugaaggacaaccugaucgaccucggcugcccgaagaucccccugcuggggaagauggccaucuacaucugccgcauguccaaccaccccaagaccacgauggccuuccucuucugguucagcuucggcuacgugaucaccugcaucgucugcaaggcgaucuucuaccugcugaucaucgugggcacccucgggaagcgguucaagcaguaccgcgagcugaagccccagaccugcacgaucugcgagaccaccccgaccaacgccaucgacgccgagaugcacgaccugaacugcuccuacaacaucugccccuacugcgccagccggcucaccuccgacggccuggcgcgccacgugacgcacugccccaagcggaaggagaaggucgaggagaccgagcuguaccucaaccuggagcgcauccccuggguggugcggaagcugcuccaggucagcgaguccaccgggguggcccugaagcgcagcuccuggcugaucgugcuccugguccuguucgccgugagccucagcccggugcaguccgcccccaucggccacgggaagaccaucgagacguaccagguccgggaggaguacaccagcaucugccuguucgugcugggcuccauccucuucaucgugagcugccugaugaagggccuggucaacuccguggggaacaucuucuuccccggccucagcaucugcaagaccugcuccaucgggagcaucaacggcuucgagaucgagucccacaagugcuacugcagccugcugugcugcccguacugccgccacugcuccgccgaccgggagauccaccagcuccaccugagcaucugcaagaagcgcaagaccggguccaacgugaugcuggcggucugcaagcgcaugugcuuccgggccacgguggaggugagcaacaaggcccucuccauccgcagcaucaucaacaccaccuucgucgugugcauccugauccuggccgugugcgucguguccaccagcgccguggagauggagucccuccccgcgggcacgugggagcgggaggaggaccugaccaacuucugccaccaggagugccaggucaccgagaccgagugccugugccccuacgaggcccucgugcugcgccggccccuguuccucgacggcaucgugaaggggaugaagaaccugcugaacagcacgagccucgagaccucccugagcaucgaggccccguggggcgccaucaacguccaguccaccuacaagcccaccgugagcgccgcgaacaucgcccuguccuggagcuccguggagcaccgcgggaacaagauccucgucagcggccgguccgagagcaucaugaagcuggaggagcgcacggggaucuccugggaccugggcguggaggacgccagcgaguccaagcuccugaccgugagcgucauggaccugucccagauguacagccccguguucgaguaccucuccggcgaccggcagguggaggaguggcccaaggccaccugcaccggggacugcccggagcgcugcggcugcacgagcuccaccugccugcacaaggaguggccccacagccggaacuggcgcugcaaccccaccuggugcuggggggucggcaccggcugcacgugcugcgggcuggacgugaaggaccucuucaccgacuacauguucgugaaguggaaggucgaguacaucaagaccgaggcgaucgugugcgucgagcugaccagccaggagcggcagugcucccugaucgaggccggcacgcgcuucaaccucgggcccgugaccaucacccugagcgagccgcggaacauccagcagaagcugccccccgagaucaucacccuccacccccgcaucgaggagggcuucuucgaccugaugcacgugcagaagguccuguccgccagcacggugugcaagcuccaguccugcacccacggggugccgggcgaccugcaggucuaccacaucggcaaccugcucaagggggacaaggugaacggccaccugauccacaagaucgagccccacuucaacaccagcuggauguccugggacgggugcgaccuggacuacuacugcaacaugggcgacuggcccagcugcaccuacaccggggugacgcagcacaaccacgccuccuucaucaaccuccugaacaucgagaccgacuacaccaagagcuuccacuuccacuccaagcgggucaccgcccacggcgacacgccccagcuggaccucaaggcgcgcccgaacuacggcgccggggagaucaccgugcugguggaggucgccgacauggagcugcacaccaagaagaucgagaucagcggccucaaguucgccucccugaccugcacggggugcuacgccugcagcuccggcaucagcugcaaggugcggauccacguggacgagcccgacgagcugaccguccacgugaaguccgacgaccccgacguggucgcggccagcuccagccucauggcccgcaagcuggaguucgggaccgacagcaccuucaaggccuucuccgccaugcccaagacgagccugugcuucuacaucguggagcgggaguacugcaaguccugcagcaaggaggacacccagaagugcgugaacaccaagcucgagcacccgcaguccauccugaucgagcacaagggcaccaucaucggcaagcagaacaacacgugcaccgcgaagaccagcugcuggcuggaguccgucaagagcuucuucuacgggcucaagaacaugcuguccggcaucuucgggaacguguucgugggcaucuuccuguuccucgcccccuucauccugcugauccuguucuucauguucggcuggcgcauccucuucugcuucaagugcugccgccggacccgcgggcuguuccgguacaagcaccuggaggacgacgaggagacgggcuaccgccggaucaucgagcgccucaacaacaagaaggggaagaacaagcugcuggacggcgagcggcucgccgaccgccggaucgccgagcuguucagcaccaagacccacaucggguga

SEQ ID NO: 12013 - RNA, 5055 nt, Artificial Sequence
  derived and/or modified CDS sequence (opt1) from CCHFV(K128_76)__KX013454.1__GP
augcacaucagccugaugugcgccgugcucugccugcagcuguacggccucgggggcacccacgggucccacaacgagaccgagcacaacaagacgaacgccgucaccaccagcuccgacagccagucccccgagccgcccacccgcacgacccugcccgugacccccgacagcccgaccgugacgcccaccacccccgcguccgcccccgagggcagcggggagguccacaccuccccgcccaacacgaccgagggccccagccugcccgaguccaccccggagccccccaccgccacgagcaccggcauccccuccgccagcgacgugaacuccagcacccaggccgcgcgggacaccuccacgccgaccgugcacaccagcccccccaacucccccagcaccccgcccacgcuccaggagacccaccaccccaugcgcaaccugcugagcgucaccucccacaagcccgaggagaccagcgccccguccgagagcgggaaggagucccccgccgccaacagcccccaccccguggcggaccggccguccacgagcuccaccaccgcccagggccccaccgagaacaacagcuacaacacgaccgagcagcucgagucccugacccagagcaccacgcuggggcccaugaccucccucacccagaccgugcugagccaguccgucaccagcaucgccgugcaggacacgcaccuguccccgaccaaccgcagcaagcggaaccucgagauggagaucauccugacccugccccagggccucaagaaguacuacgggaaggugcugcgccugcuccagcugacccuggaggaggacacggagggccuccuggaguggugcaagcggaaccuggaccucgacugcgacgacaccuucuuccagaagcgcaucgaggaguucuucaucaccggcgagggguacuucaacgagguccugcaguuccggacccccggcacgcuguccaccaccgagagcacccacgccgggcuccccacggccgagccguucaagagcuacuucgcgaagggcuuccuguccaucgacagcggcuacuucuccgccaagugcuacagccgcaccuccaacagcgggcugcagcucaucaacgugacccggcacuccacccgcaucgccgacacgcccggccccaagaucaccaaccugaagaccaucagcugcaucaaccugaaggccuccguguucaaggagcaccgggaggucgagaucaacgugcuccugccccagguggccgucaaccugagcaacugccacgugaccaucaagucccacgugugcgacuacagccucgacaucgacgggacggucaagcugccgcacauccaccacgacggcaccuucauccccgggaccuacaagaucgugaucgaccgcaagaacaagcugaacgaccggugcacccucuucacgaacugcgugaucaagggccgcgagguccggaagggccaguccgugcugcgccaguacaagaccgagauccggaucgggaaggcgagcaccggcucccgccggcugcucagcgacgaguccggggacgacugcaucagccgcacccagcugcugcgcacggagaccgccgagauccacggcgacaacuacgggggccccggcgacaagaucaccaucugcaacgggagcaccaucgucgaccagcggcucggcuccgagcuggggugcuacacgaucaaccgcgugaagagcuucaagcugugcgagaacuccgccaccggcaagagcugcgagaucgacuccauccccgugaagugccggcagggguacugccugaagaucacccaggagggccgcggccacgucaagcucagccggggguccgagguggugcuggacgccugcgacagcuccugcgaggucaugaucccgaagggcaccggggacauccugguggacugcagcggcggccagcagcacuuccucaaggacaaccugaucgaccuggggugccccaagaucccccuccugggcaagauggccaucuacaucugccgcauguccaaccaccccaagacgaccauggcguuccuguucugguucagcuucggguacgugaucaccugcaucgucugcaaggccaucuucuaccuccugaucaucgugggcacccuggggaagcgguucaagcaguaccgcgagcucaagccgcagaccugcacgaucugcgagaccacccccaccaacgccaucgacgccgagaugcacgaccugaacugcuccuacaacaucugccccuacugcgccagccggcugacguccgacggccucgcgcgccacgugacccacugccccaagcggaaggagaaggucgaggagaccgagcuguaccugaaccucgagcgcaucccguggguggugcggaagcugcugcaggucagcgaguccaccggcguggcccucaagcgcagcuccuggcugaucgugcugcucguccuguucgccgugagccugagccccgugcaguccgcccccaucagccacgggaagacgaucgagaccuaccagguccgggaggaguacaccuccaucugccucuucgugcugggcagcauccuguucaucguguccugccucaugaaggggcuggucaacagcgugggcaacaucuucuuccccgggcuguccaucugcaagaccugcagcaucggcuccaucaacggcuucgagaucgagagccacaagugcuacugcucccuccugugcugcccguacugccgccacugcagcgcggaccgggagauccaccagcugcaccucuccaucugcaagaagcgcaagacggggagcaacgugaugcuggccgucugcaagcggaugugcuuccgcgccaccauggagguguccaacaaggcccuguucauccgcagcaucaucaacaccaccuucguggucugcauccucauccuggccgugugcguggucuccacgagcgcgguggagauggagucccugcccgccggcaccugggagcgggaggaggaccucaccaacuucugccaccaggagugccaggugaccgagacggagugccugugccccuacgaggcccugguccuccgccggccgcuguuccaggacagcaucgugaaggggaugaagaaccugcucaacagcaccucccuggagaccagccuguccaucgaggcccccuggggcgccaucaacgugcagagcaccuacaagcccgcggucuccgccgccaacaucgcccucagcugguccagcguggagcaccgcggguccaagauccuggugagcggccgguccgagagcaucaugaagcuggaggagcgcacgggcaucuccugggaccucggggucgaggacgccagcgaguccaagcugcugaccgugagcgugauggaccucucccagauguacagccccgucuucgaguaccuguccggcgaccggcagguggaggaguggccgaaggcgaccugcaccggggacugccccgagcgcugcggcugcacgagcagcaccugccugcacaaggaguggccccacucccggaacuggcgcugcaaccccaccuggugcuggggggugggcaccggcugcacgugcugcgggcucgacgucaaggaccuguucaccgacuacauguucgugaaguggaagguggaguacaucaagaccgaggccaucgucugcguggagcugaccagccaggagcggcagugcucccucaucgaggccggcacgcgcuucaaccuggggccggucaccaucacccugagcgagccccggaacauccagcagaagcucccccccgagaucaucacccugcacccgcgcaucgaggagggcuucuucgaccugaugcacgugcagaaggugcucuccgccagcaccgucugcaagcugcaguccugcacgcacggcgugcccggggaccugcagguguaccacaucggcaaccuccugaagggggaccgggucaacggccaccugauccacaagaucgagccccacuucaacaccagcuggauguccugggacgggugcgaccucgacuacuacugcaacaugggcgacuggcccagcugcaccuacaccggcgugacgcagcacaaccacgcguccuucgugaaccugcugaacaucgagaccgacuacaccaagagcuuccacuuccacuccaagcgcgucaccgcccacggggacacgccgcagcucgaccugaaggcccggcccaacuacggcgccggggagaucaccgugcugguggaggucgccgacauggagcuccacaccaagaagaucgagaucagcggccugaaguucgcgucccugaccugcacggggugcuacgccugcagcuccggcaucagcugcaaggugcgcauccacguggacgagcccgacgagcucaccguccacgugaaguccgacgaccccgacguggucgccgccagcagcucccugauggcccggaagcuggaguucggcaccgacagcaccuucaaggcguucuccgccaugccgaagacgagccucugcuucuacaucguggagcgcgaguacugcaaguccugcagcaaggaggacacccagaagugcgugaacaccaagcuggagcagccccaguccauccugaucgagcacaaggggaccaucaucggcaagcagaacaacacgugcaccgccaagaccagcugcuggcucgaguccgucaagagcuucuucuacgggcugaagaacaugcuguccggcaucuucgggaacguguucgugggcaucuuccucuuccuggcccccuucauccugcugauccucuucuucauguucggcuggcggauccuguucugcuucaagugcugccgccgcacccgggggcuguuccgcuacaagcaccucgagaacgacgaggagacgggcuaccggcgcaucaucgagcggcugaacaacaagaaggggaagaacaagcugcucgacggcgagcgccuggccgaccggcgcaucgcggagcuguucagcaccaagacccacaucggcuga

SEQ ID NO: 12014 - RNA, 5055 nt, Artificial Sequence
  derived and/or modified CDS sequence (opt1) from CCHFV(K168_125)__KX013460.1__GP
augcacaucagccugaugugcgccgugcucugccugcagcuguacggccucgggggcacccacgggcugcacaacggcaccgagcacaacaagacgaacgccgucaccaccuccagcaacucccagagcuccgagagccccgcgcgcaccgccccgcccgugacgcccgacucccccaccgugaccccgaccacgcccgccagcgcccccgagggguccggcgaggcccacagcucccccccgaacaacaccgagggccccagccugcccgaguccaccagcgagcccccggcggccaccuccacggggauccccagcgccuccgacgucaacagcuccacccaggccgcgcgggacaccagcacccccacggugcgcaccagccccccgaacucccccagcaccccccccaccccgcaggagacgcaccaccccgugcggaaccuccuguccgucaccagccacaagcccgaggagaccuccgcccccagcgaguccggcaaggagagcccggccgccaacuccccccaccccguggccagccgccccccgacccccuccacgaccgcgcaggggcccaccgagaacaacaacuacaacaccacgggccagcuggagagccucacccaguccaccacccuggggccgaugacgagccugacccagaccgaccucccccaguccgugaccagcaucgccguccaggacacgcaccccucccccaccaaccggagcaagcgcaaccuggagauggagaucauccugacccucccgcagggccugaagaaguacuacggcaaggugcugcggcuccugcagcugacccucgaggaggacaccgaggggcugcuggaguggugcaagcgcaaccucggccuggacugcgacgacacguucuuccagaagcggaucgaggaguucuucaucaccggggagggccacuucaacgaggugcugcaguuccgcacccccggcacccucuccacgaccgagagcacccacgccgggcugcccaccgccgagcccuucaagagcuacuucgccaagggcuuccuguccaucgacagcggguacuucuccgcgaagugcuacagccggacguccaacagcggccuccagcugaucaacgucacccgccacuccacccggaucgccgacaccccggggcugaagaucacgaaccucaagaccaucagcugcaucaaccugaaggccuccguguucaaggagcaccgcgagguggagaucaacguccugcucccccagguggccgugaaccugagcaacugccacgucaccaucaagucccacgugugcgacuacagccuggacaucgacggcaccgugcggcucccccacauccaccacgacggcacguucauccccgggaccuacaagaucgucaucgaccgcaagaacaagcugaacgaccggugcacccuguucaccaacugcgugaucaagggccgcgaggugcggaaggggcaguccguccuccgccaguacaagacggagauccggaucggcaaggccagcaccgggucccgccgccugcugagcgacgaguccggcgacgacugcaucagccggacccagcuccugcgcaccgagacggcggagauccacggcgacaacuacgggggcccgggggacaagaucaccaucugcaacggcagcaccaucguggaccagcggcugggguccgagcucggcugcuacaccaucaaccgcgucaagagcuucaagcugugcgagaacuccgccacgggcaagagcugcgagguggacuccauccccgugaagugccggcagggguacugccugaagaucacccaggagggccgcgggcacgucaagcugagccggggcuccgagguggugcucgacgccugcgacagcuccugcgaggucaugauccccaagggcaccggggacauccugguggacugcagcggcgggcagcagcacuuccugaaggacaaccucaucgaccugggcugccccaaggugccgcugcucgggaagauggccaucuacaucugccgcauguccaaccaccccaagaccacgauggccuuccuguucugguucagcuucggcuacgucaucaccugcaucgugugcaaggcgaucuucuaccugcucaucaucgugggcacccuggggaagcgguucaagcaguaccgcgagcugaagccccagaccugcacgaucugcgagaccacccccaccaacgccaucgacgccgagaugcacgaccucaacugcuccuacaacaucugcccguacugcgccagccggcugaccuccgacggccuggcgcgccacgucacgcacugccccaagcggaaggagaagguggaggagaccgagcucuaccugaaccuggagcgcauccccugggugguccggaagcuccugcaggugagcgaguccaccgggguggcccugaagcgcagcuccuggcucaucguccugcuggugcucuucgccgugagccugagccccguccaguccgccccgaucggccacgggaagaccaucgagacguaccaggugcgggaggaguacaccagcaucugccuguucgugcucggcuccauccuguucaucgucagcugccugaugaagggccucgugaacuccguggggaacaucuucuuccccggccugagcaucugcaagaccugcuccaucgggagcaucaacggcuucgagaucgagucccacaagugcuacugcagccugcucugcugccccuacugccgccacugcuccgccgaccgggagauccaccagcugcaccugagcaucugcaagaagcgcaagaccggguccaacgucaugcucgcggugugcaagcgcaugugcuuccgggccacgguggaggucagcaacaaggcccuguccauccgcagcaucaucaacaccaccuucguggugugcauccugauccucgccgucugcgugguguccaccagcgccgucgagauggagucccugccggcgggcacgugggagcgggaggaggaccugaccaacuucugccaccaggagugccaggugaccgagaccgagugccucugccccuacgaggcccuggugcugcgccggccccucuuccuggacagcaucgucaagggcaagaagaaccugcucaacagcacgucccuggagaccagccuguccaucgaggcccccuggggggccaucaacgugcagagcaccuacaagccgaccguguccgccgcgaacaucgcccucagcugguccagcgucgagcaccgcggcaacaagauccugguguccgggcggagcgaguccaucaugaagcuggaggagcgcacgggcaucagcugggaccucgggguggaggacgccuccgagagcaagcugcugaccgucuccgugauggaccucagccagauguacucccccguguucgaguaccugagcggcgaccggcaggucgaggaguggcccaaggccaccugcaccggcgacugccccgagcgcugcgggugcacguccagcaccugccugcacaaggaguggccgcacagccggaacuggcgcugcaaccccaccuggugcuggggcguggggaccggcugcacgugcugcggccucgacgugaaggaccuguucaccgacuacauguucgucaaguggaagguggaguacaucaagaccgaggcgaucgucugcguggagcugaccucccaggagcggcagugcagccucaucgaggccgggacgcgcuucaaccugggccccgugaccaucacccuguccgagccccggaacauccagcagaagcucccgcccgagaucaucacccugcacccccgcaucgaggagggguucuucgaccugaugcacguccagaaggugcucagcgccuccacggugugcaagcugcagagcugcacccacggcguccccggggaccugcagguguaccacaucggcaaccuccugaagggcgacaaggugaacgggcaccugauccacaagaucgagccgcacuucaacaccuccuggaugagcugggacggcugcgaccucgacuacuacugcaacaugggggacuggcccuccugcaccuacaccggcgucacgcagcacaaccacgccagcuucaucaaccugcugaacaucgagaccgacuacaccaaguccuuccacuuccacagcaagcgggugaccgcccacggggacacgccccagcucgaccugaaggcgcgccccaacuacggcgccggcgagaucaccgugcuggucgagguggccgacauggagcuccacaccaagaagaucgagaucuccgggcugaaguucgccagccugaccugcacgggcugcuacgccugcuccagcgggaucuccugcaaggugcggauccacgucgacgagccggacgagcucaccgugcacgugaagagcgacgaccccgacgucguggcggccuccagcagccugauggcccgcaagcuggaguucggcaccgacuccaccuucaaggccuucagcgccaugcccaagacgucccucugcuucuacaucguggagcgggaguacugcaagagcugcuccaaggaggacacccagaagugcgucaacaccaagcuggagcacccccagagcauccugaucgagcacaaggggaccaucaucggcaagcagaacaacacgugcaccgcgaagaccuccugcuggcucgagagcgugaaguccuucuucuacggccugaagaacaugcugagcgggaucuucggcaacguguucgucgggaucuuccucuuccuggccccguucauccugcugauccucuucuucauguucggcuggcgcauccuguucugcuucaagugcugccgccggacccgcggccuguuccgguacaagcaccucgaggacgacgaggagacgggguaccgccggaucaucgagcgccugaacaacaagaagggcaagaacaagcugcucgacggggagcggcuggccgaccgccggaucgccgagcuguucuccaccaagacccacaucggcuga

SEQ ID NO: 12015 - RNA, 5052 nt, Artificial Sequence
  derived and/or modified CDS sequence (opt1) from CCHFV(Kosova Hoti)__EU037902.1__GP
augcacacccugcucgugugcuucauccuguaccugcagcuccugggccuggggggcgcccacgggcagagcaacgccaccgagcacaacggcacgaacaccaccaccgcgcccgggacgucccagagcccgaagccccccgccuccaccacccccagccacgccccggagcccuccaccaucaagcucacgacccccaccagcgagaccgagggcuccggcgagacgacccccccgaccaacaccacgcaggacagccccccccuggagaccacccccgagcgcuccgccaccacggccaccagcaccuccgggaccgacaacaugaacagcacgacccagaugaccgacaacaccccgacguccaccgucagcaccucccugagcuccagccccuccacccccagcacgagccagggcaugcaccaccccgugcggucccuccugagcguguccagcccgaagaccgcgaccacccccacgcccaugucccccggggagaugagcuccgagaccagcucccagcacagcgccaugucccgcaccccgaccccccacaccgccacgcaggucagcaccgagaacgccaaccgguccaccagccgccaguccgagagcuccgcgcagcccgccacccagagccccgugacguccccggcccagagcauccugcucaugagcgccacccccaccaccauccagaacauccaccccucccccacgaaccggagcaagcgcaaccuggagauggagaucauccugacccucucccagggccugaagaaguacuacgggaagauccugaagcuccugcaccugacccucgaggaggacaccgagggccugcuggaguggugcaagcggaaccucggcagcaacugcgacgacgacuucuuccagaagcgcaucgaggaguucuucaucacgggggagggcuacuucaacgaggugcugcaguucaagacccuguccaccccgagcuccaccgagcccagccacgcccggcuccccacggcggagccguucaaguccuacuucgccaagggguuccugagcaucgacuccggcuacuucagcgccaagugcuacccccgcuccagcaccuccggccugcagcucaucaacgucacccagcaccccgcccggaucgccgagacccccgggccgaagacgaccagccugaagaccaucaacugcaucaaccugcgcgcguccguguucaaggagcaccgggagguggagaucaacguccuccugccccagaucgccgugaaccugagcaacugccacguggucaucaacagccacgugugcgacuacucccucgacaccgacggccccgugcgccugccccggaucuaccacgaggggacguucaugccgggcaccuacaagaucgucaucgaccgcaagaacaagcugaacgaccggugcacccucgugaccaacugcgugaucaaggggcgcgagguccggaagggccagagcgugcugcgccaguacaagacggagaucaagaucggcaaggcccccaccgggucccggaagcugcucagcgaggagcccggcgacgacugcaucucccgcacccagcugcugcgcaccgagacggccgagauccacgacgacaacuacgggggccccggggacaagaucaccaucugcaacggcagcaccaucguggaccagcggcucggcuccgagcuggggugcuacaccaucaaccgcgucaagagcuucaagcugugcgagaacuccgccacgggcaagaccugcgagaucgacagcaccccggugaagugccggcagggguucugccucaagaucacccagaagggccgcgggcacgugaagcugucccggggcagcgaggucgugcuggacgcgugcgacuccaacugcgaggucaugauccccaagggcaccggggacauccugguggacugcagcggcgggcagcagcacuuccucaaggacaaccugaucgaccugggcugcccccacaucccccuccugggcaagauggccaucuacaucugccgcauguccaaccacccgaagacgaccauggccuuccuguucugguucagcuucggguacgugaucaccugcaucuucugcaaggcccucuucuacucccugaucaucaucggcacccuggggaagaagaucaagcaguaccgggagcucaagccccagacgugcaccaucugcgagaccgcccccgucaacgcgaucgacgccgagaugcacgaccugaacugcagcuacaacaucugccccuacugcgccucccgccugaccagcgacggccucgcccggcacgugaagcagugcccgaagcgcaaggagaagguggaggagacggagcuguaccugaaccucgagcggauccccugggucgugcgcaagcugcugcaggugagcgaguccaccggggucgcgcucaagcggagcuccuggcugaucgugcugcucgugcugcugaccgucagccucucccccgugcagagcgcccccgugggccacggcaagaccaucgagacguaccagacccgcgagggguucaccuccaucugccuguucaugcugggcagcauccucuucaucgucuccugccuggugaaggggcugguggacagcgucuccgacagcuucuucccgggccucuccgugugcaagaccugcagcaucggguccaucaacggcuucgagaucgagagccacaagugcuacugcucccuguucugcugccccuacugccggcacugcagcgccgaccgcgagauccaccagcugcaccucaacaucugcaagaagcggaagacgggcuccaacgugaugcuggccgucugcaagcgcaugugcuuccgggccaccaucgaggcgagccgccgcgcccugcucauccggagcaucaucaacaccaccuucgugaucugcauccugacgcugaccaucugcguggucuccaccagcgccguggagauggagaaccuccccgccgggaccugggagcgcgaggaggaccugacgaacuucugccaccaggagugccaggugaccgagaccgagugccugugcccguacgaggcccucguccugcggaagccccuguuccucgacuccaucgugaagggcaugaagaaccugcugaacagcaccucccucgagacgagccuguccaucgaggcgcccuggggggccaucaacgugcagagcaccuucaagcccaccgucuccaccgccaacaucgcccugagcugguccagcguggagcaccgcggcaacaagauccucgugacggggcgguccgagagcaucaugaagcuggaggagcgcaccggcaucuccugggaccugggcgucgaggacgccagcgaguccaagcuccugaccgugagcaucauggaccugucccagauguacagcccgguguucgaguaccucagcggggaccggcaggucgaggaguggcccaaggcgaccugcacgggcgacugcccccagcgcugcgggugcaccuccagcaccugccugcacaaggaguggccccacucccggaacuggcgcugcaacccgaccuggugcuggggcguggggaccggcugcacgugcugcggcguggacgucaaggaccuguucaccgaccacauguucgugaaguggaagguggaguacaucaagaccgaggccaucgucugcguggagcucaccagccaggagcggcagugcucccugaucgaggccgggacgcgcuucaaccugggccccgugaccaucacccucagcgagccccggaacauccagcagaagcugcccccggagaucaucacccugcaccccaagaucgaggagggguucuucgaccucaugcacguccagaaggugcuguccgccagcacggugugcaagcugcaguccugcacccacggcauccccggcgaccuccaggucuaccacaucgggaaccugcugaagggcgaccgcgugaacgggcaccucauccacaagaucgagccccacuucaacaccagcuggauguccugggacggcugcgaccuggacuacuacugcaacaugggggacuggccgagcugcaccuacacgggcgugacccagcacaaccacgcggccuucgucaaccugcucaacaucgagaccgacuacaccaagacguuccacuuccacuccaagcgggugaccgcccacggcgacaccccccagcuggaccugaaggcccgccccaccuacggggccggcgagaucacgguccucguggagguggcggacauggagcugcacaccaagaaggucgagaucagcgggcugaaguucgccucccucgccugcaccggcugcuacgccugcagcuccgggaucagcugcaaggugcggauccacguggacgagcccgacgagcugaccguccacgugaaguccagcgacccggacguggucgccgcgggcacgagccugauggcccgcaagcucgaguucggcaccgacuccaccuucaaggccuucagcgccaugcccaagaccucccugugcuucuacaucguggagaaggaguacugcaagagcugcuccgaggacgacacgaagaagugcguggacaccaagcuggagcagccccagagcauccucaucgagcaccgggggaccaucaucggcaagcagaacgacaccugcacggccaaggcguccugcuggcuggagagcgucaaguccuucuucuacgggcugaagaacaugcucggcagcguguucgggaacuucuucaucggcauccugcuguuccucgcccccuucgugcugcugguccuguucuucauguucggcuggaagauccucuucugcuucaagugcugccgccggacccgcgggcuguucaaguaccgccaccugaaggacgacgaggagaccggcuaccggcgcaucaucgagcggcucaacaacaagaaggggaagaaccgccugcuggacggcgagcggcucgccgaccgcaagaucgccgagcuguucuccaccaagacgcacaucggcuga

SEQ ID NO: 12016 - RNA, 5049 nt, Artificial Sequence
  derived and/or modified CDS sequence (opt1) from CCHFV(Oman)__DQ211632.1__GP
augcacacccugcucguguacgccgucuucugccugcagcuguggagccccggcgggacccgcggccucuccaacgagacgcagcacaacgagaccgggaucacccgggccccggagggcagccaggggcccucccugcccgugagcaccgcgucccccaucaugagcgacccguccaucacgacccccagcgccuccaccagcggccuggagggcuccggggacaccacgccgcccgccaucacccagggccccaccccgcccgagaccacgcccgagcccagcaccaccaccgggacgaacgccuucuccaccgccaucgcgaacgugagcacccagaccgucaaggacacgcccacccccaccgugcagaccuccccgcccagcacgcccgacgccuccaccaucccccagggcacccaccacaccgcccgcgggcuccugagcgugacggucaccaagcccgaggaggugccgacccccaccggccccgagcaggccuccaucgagacgaacagcccccggcuggcgaccagcaagaccccgucccccagccccaccgcccaggugacgaccgagaacuccaaccccaacaccagccgccagcucguccuguccacccagccggccaccagcucccccgugacgagccccgcccagcugaucuucgugcaguccgccaccaccgucgcggugcaggacgcccacccgagccccaccaaccgguccaagcgcaaccucgagauggaggugauccugacgcugagccagggccuccggaaguacuacgggcgcauccugaagcugcucgaccugacccuggaggaggacaccgagggccuccuggaguggugcaagcggaaccuggggcucacgugcgacgacaacuucuuccagaagcgcaucgaggaguucuuccugacgggcgagggccacuucaacgagguccugcaguucaagacccccuccacccucagcuccaccgagagcgccuccguggggcugcccacgguggagccguucaagagcuacuucgccaagggcuuccuguccaucgacagcggguacuucagcgccaagugcuacccccgggcguccaacagcggccuccagcugaucaacgucacccagcacuccgcccgcaucgccgacacccccgggcccaagaucaccaaccugaagacgaucaacugcaucaaccucaaggcccugguguucaaggagcaccgggagaucgagaucaacgugcugcucccgcaggucgccgugaaccugagcaacugccacgugcacaucaagucccacgucugcgacuacagccuggacaucgacggcaccgugcgccucccccggauccaccacgagggcaccuucauccccgggaccuacaagaucgucaucgacaagaagaacaagcagaacgaccgcugcaaccuggugacgaacugcgugaucaagggccgggagguccgcaaggggcaguccgugcugcggcaguaccgcaccgagauccggaucggcaaggcgagcuccgggagccgccgccuccuguccgaggagagcggcgaggacugcaucucccggacccagcugcuccgcaccgagacggccgagauccacggcgacaacuacgggggccccggggacaagaucaccaucugcaacggcagcaccaucguggaccagcggcugggguccgagcugggcugcuacaccaucaaccgcgucaagagcuucaagcucugcgagaacuccgccaccggcaagagcugcgagaucgacaacaccccggugaagugcaagcagggguucugccugaagaucacccaggagggccgggggcacgugaagcugagccgcgacuccgaggucgugcuggacgccugcgacagcuccugcgagaucaugauccccaagggcaccggcgacauccucguggacugcagcgggggccagcagcacuuccugaaggacaaccugaucgaccucgggugccccaacaucccccugcugggcaagauggccaucuacaucugccggauguccaaccacccgaagacgaccauggcguuccucuucugguucagcuucggguacgucaucacgugcauccugugcaaggugaucuucuaccugcucaucguggucggcacccugggcaagaaguucaagcaguaccgcgagcugaagccccagaccugcaccaucugcgagaccacccccgugaacgccaucgacgccgagaugcacgaccucaacugcuccuacaacaucugccccuacugcgccagccggcugaccuccgacgggcuggcgcgccacgugaugcagugcccgaagcggaaggagaagaucgaggagacggagcucuaccugaaccuggagcgcauccccugggucgugcggaagcuccuccaggugagcgaguccaccggcgucgcccugaagcgcagcuccuggcucaucgugcugcuggugcuccugaccgucagccugucccccgugcagagcgcccccaucgggcacggcaagaccaucgagacguaccagacccgggagggguacaccuccaucugccucuucgugcugggcagcauccuguucaucgucucccaccucaugaagggccugguggacagcguggggaacagcuucuucccgggccuguccaucugcaagaccugcagcaucggguccaucaacggcuucgagaucgagagccacaagugcuucugcucccucuucugcugccccuacugccgccacugcagcgccgacaaggagauccacaagcugcaccuguccaucugcaagaagcggaaggccgggagcaacgucaugcucgcggugugcaagcgcaugugcuuccgggccacgauggagguguccaacaaggcccugcugauccgcagcgucaucaacaccaccuucguggugugcauccucauccuggccgucugcgugguguccaccagcgccgucgagauggagucccugcccgcgggcacgugggagcgcgaggaggaccucaccaacuucugccaccaggagugccaggugaccgagaccgagugccugugcccguacgaggcccuggugcuccggaagccccuguuccuggacagcaucgccaagggcaugaagaaccuccugaacuccacgagccuggagaccucccucagcaucgaggcccccuggggcgccaucaacguccaguccaccuucaagcccaccgugagcacggcgaacaucgcccugagcugguccagcguggagcaccgcgggaacaagauccuggucuccgggcggagcgaguccaucaugaagcucgaggagcgcaccggcaucagcugggaccuggggguggaggacgccuccgagagcaagcugcucaccguguccgucauggaccugagccagauguacuccccgguguucgaguaccugagcggcgaccgccagguggaggaguggcccaaggcgaccugcacgggcgacugccccgagcggugcgggugcaccuccuccacgugccuccacaaggaguggccccacagccggaacuggcgcugcaacccgaccuggugcuggggcgucgggaccggcugcacgugcugcggccuggacgugaaggaccuguucaccgacuacauguucgucaaguggaagguggaguacaucaagaccgaggccaucgugugcgucgagcucaccagccaggagcggcagugcucccugaucgaggccgggacccgcuucaaccugggccccgugaccaucacccucagcgagccccggaacauccagcagaagcugcccccggagaucgugacgcugcacccccgcaucgaggagggguucuucgaccucaugcacguccagaaggugcuguccgccagcaccgugugcaagcugcagagcugcacccacggcguccccggggaccuccagguguaccacaucggcaaccugcugaagggcgacaaggugaacgggcaccucauccacaaggucgagccccacuucaacaccuccuggaugagcugggacggcugcgaccuggacuacuacugcaacaugggggacuggccguccugcaccuacacgggcgugacccagcacaaccacgccgccuucgugaaccugcucaacaucgagaccgacuacaccaagaacuuccacuuccacagcaagcgggucacggcgcacggggacaccccgcagcuggaccugaaggcccgccccaacuacggcgccggcgaggugaccgugcucgucgagguggccgacauggagcugcacaccaagaagaucgagaucuccgggcugaaguucgccagccucacgugcaccggcugcuacgcgugcuccagcgggaucuccugcaaggugcggauccacgucgacgagcccgacgagcugaccgugcacgucaagagcgaggaccccgacaucguggccgccuccagcucccugauggcccgcaagcucgaguucggcaccgacagcacguucaaggccuucuccgcgaugcccaagaccagccugugcuucuacaucguggagcgggaguacugcaaguccugcagcaaggaggacacccagaagugcgugaacgccaagcuggagcgcccccaguccauccucaucgagcacaaggggaccaucaucggcaagcagaacgacacgugcaccgccaaggccagcugcuggcuggagagcgucaaguccuucuucuacggccugaagaacaugcucagcgggaucuucggcaacguguucaucgggaucuuccuguuccuggcgcccuucauccugcucauccuguucuucauguucggcuggcggauccuguucugcuucaagugcugccgccggacccgcggccucuucaaguaccgccaccugaaggacgacgaggagaccggguaccggaagaucaucgagcgccugaacaacaagaagggcaagaacaagcuccuggacggggagcggcuggccgaccgcaagaucgccgagcuguucuccacgaagacccacaucggcuga

SEQ ID NO: 12017 - RNA, 5049 nt, Artificial Sequence
  derived and/or modified CDS sequence (opt1) from CCHFV(Oman_812956)__KY362518.1__GP
augcacacccugcucguguacgccguguucugccugcagcuguggagccccggcgggacccgcggccucuccaacgagacgcagcacaacgagaccgggaucacccgggccccggagggcagccaggggcccucccugcccgugagcaccgcgucccccaucaugagcgacccguccaucacgacccugagcgccuccaccagcggccucgagggcuccggggacaccacgccgcccgccaucacccagggccccacccugccggagaccacgcccgagcccagcaccaccaccgggacgaacgccuucuccaccgccaucgcgaacgugagcacccagaccgucaaggacacgcccaccccgaccgugcagaccuccccgcccagcacgcccgacgccuccaccaucccccagggcacccaccacaccgcccgcgggcugcucagcgugacggucaccaagcccgaggaggugcccacccccaccggcccggagcaggccuccaucgagacgaacagcccccggcuggcgaccagcaagacccccucccccagcccgaccgcccaggugacgaccgagaacuccaaccccaacaccagccgccagcugguccucuccacccagcccgccaccagcucccccgugacgagcccggcccagcugaacuucgugcaguccgccaccaccaucgcgguccaggacgcccaccccagccccaccaaccgguccaagcgcaaccuggagauggaggugauccucacgcugagccagggccugcggaaguacuacgggcgcauccucaagcugcuggaccucacccuggaggaggacaccgagggccugcucgaguggugcaagcggaaccuggggcugaccugcgacgacaacuucuuccagaagcgcaucgaggaguucuuccucacgggcgagggccacuucaacgaggugcugcaguucaagaccccguccacccugagccccaccgaguccgccagcgucgggcuccccacgguggagcccuucaaguccuacuucgccaagggcuuccugagcaucgacuccggguacuucagcgccaagugcuacccgcgggcgagcaacuccggccugcagcucaucaacgugacccagcacagcgcccgcaucgccgacacccccgggcccaagaucaccaaccugaagacgaucaacugcaucaaccugaaggcccucgucuucaaggagcaccgggagaucgagaucaacgugcugcugccccagguggccgucaaccucuccaacugccacgugcacaucaagagccacgugugcgacuacucccuggacaucgacggcaccguccgccugccgcggauccaccacgagggcaccuucauccccgggaccuacaagaucgugaucgacaagaagaacaagcagaacgaccgcugcaaccucgucacgaacugcgugaucaagggccgggaggugcgcaaggggcagagcguccugcggcaguaccgcaccgagauccggaucggcaaggcguccagcgggucccgccgccugcucagcgaggaguccggcgaggacugcaucagccggacccagcugcugcgcaccgagacggccgagauccacggcgacaacuacgggggccccggggacaagaucaccaucugcaacggcuccaccaucguggaccagcggcucgggagcgagcugggcugcuacaccaucaaccgcgugaaguccuucaagcugugcgagaacagcgccacgggcaaguccugcgagaucgacaacacccccgucaagugcaagcagggguucugccugaagaucacccaggagggccgggggcacgugaagcucagccgcgacagcgaggugguccuggacgccugcgacuccagcugcgagaucaugaucccgaagggcaccggcgacauccugguggacugcuccgggggccagcagcacuuccucaaggacaaccugaucgaccuggggugccccaacaucccccuccugggcaagauggccaucuacaucugccggaugagcaaccaccccaagacgaccauggcguuccuguucugguucuccuucggguacgugaucacgugcauccucugcaaggucaucuucuaccugcugaucguggugggcacccucggcaagaaguucaagcaguaccgcgagcugaagccgcagaccugcaccaucugcgagaccacccccgucaacgccaucgacgccgagaugcacgaccugaacugcagcuacaacaucugccccuacugcgccucccggcucaccagcgacgggcuggcgcgccacgugaugcagugccccaagcggaaggagaagaucgaggagacggagcuguaccucaaccuggagcgcaucccgugggugguccggaagcugcuccagguguccgagagcaccggcguggcccugaagcgcuccagcuggcugaucguccuccuggugcugcucaccgugucccugagccccguccaguccgcccccaucgggcacggcaagaccaucgagacguaccagacccgggagggguacaccagcaucugccuguucgugcucggcuccauccuguucaucgugagccaccugaugaagggccucgucgacuccguggggaacagcuucuuccccggccugagcaucugcaagaccugcuccaucgggagcaucaacggcuucgagaucgagucccacaagugcuacugcagccuguucugcugcccguacugccgccacugcuccgccgacaaggagauccacaagcuccaccugagcaucugcaagaagcggaaggccggguccaacgugaugcuggcggucugcaagcgcaugugcuuccgggccacgauggaggugagcaacaaggcccuccugauccgcuccgugaucaacaccaccuucgucgugugcauccugauccucgccgugugcgucgugagcaccuccgccguggagauggagagccugcccgcgggcacgugggagcgcgaggaggaccugaccaacuucugccaccaggagugccaggucaccgagaccgagugccucugccccuacgaggcccuggugcugcggaagccccucuucuucgacuccaucgccaagggcaugaagaaccugcugaacagcacgucccucgagaccagccuguccaucgaggcccccuggggcgccaucaacgugcagagcaccuucaagcccaccgucuccacggcgaacaucgcccugagcuggagcuccguggagcaccgcgggaacaagauccucgugagcgggcgguccgagagcaucaugaagcuggaggagcgcaccggcaucuccugggaccugggggucgaggacgccagcgaguccaagcuccugaccgugagcgugauggaccugucccagauguacagccccgucuucgaguaccucuccggcgaccgccagguggaggaguggccgaaggcgaccugcacgggcgacugccccgagcggugcgggugcaccagcuccacgugccugcacaaggaguggccccacagccggaacuggcgcugcaaccccaccuggugcuggggcguggggaccggcugcacgugcugcggccuggacgucaaggaccucuucaccgacuacauguucgugaaguggaaggucgaguacaucaagaccgaggccaucgugugcguggagcugaccucccaggagcggcagugcagccugaucgaggccgggacccgcuucaaccucggcccggucaccaucacccuguccgagccccggaacauccagcagaagcugccgcccgagaucgugacgcuccacccccgcaucgaggagggguucuucgaccugaugcacgugcagaagguccugagcgccuccaccgugugcaagcuccagagcugcacccacggcgugcccggggaccugcaggucuaccacaucggcaaccugcucaagggcgacaaggugaacgggcaccugauccacaagguggagccccacuucaacaccagcuggauguccugggacggcugcgaccuggacuacuacugcaacaugggggacuggcccagcugcaccuacacgggcgucacccagcacaaccacgccgccuucgugaaccuccugaacaucgagaccgacuacaccaagaacuuccacuuccacuccaagcgggugacggcgcacggggacaccccgcagcuggaccucaaggcccgccccaacuacggcgccggcgagaucaccguccugguggagguggccgacauggagcugcacaccaagaagaucgagaucagcgggcucaaguucgccucccugacgugcaccggcugcuacgcgugcagcuccgggaucagcugcaagguccggauccacguggacgagcccgacgagcugaccgugcacgucaaguccgaggaccccgacaucguggccgccagcuccagccucauggcccgcaagcuggaguucggcaccgacuccacguucaaggccuucagcgcgaugccgaagaccucccugugcuucuacaucguggagcgggaguacugcaagagcugcuccaaggaggacacccagaagugcgucaacgccaagcucgagcgcccccagagcauccugaucgagcacaaggggaccaucaucggcaagcagaacgacacgugcaccgccaaggccuccugcuggcuggagagcgucaagagcuucuucuacggccucaagaacaugcuguccgggaucuucggcaacguguucaucgggaucuuccuguuccuggcgcccuucauccuccugauccuguucuucauguucggcuggcggauccucuucugcuucaagugcugccgccggacccgcggccuguucaaguaccgccaccugaaggacgacgaggagaccggguaccggaagaucaucgagcgccucaacaacaagaagggcaagaacaagcugcuggacggggagcggcucgccgaccgcaagaucgccgagcuguucagcacgaagacccacaucggcuga

SEQ ID NO: 12018 - RNA, 5049 nt, Artificial Sequence
  derived and/or modified CDS sequence (opt1) from CCHFV(Oman-199809166)__KR864901.1__GP
augcacacccugcucguguacgccgucuucugccugcagcuguggagccccggcgggacccgcggccucuccaacgagacgcagcacaacgagaccgggaucacccgggccccggagggcagccaggggcccucccugcccgugagcaccgcgucccccaucaugagcgacccguccaucacgacccugagcgccuccaccagcggccucgagggcuccggggacaccacgccgcccgccaucacccagggccccacccugcccgagaccacgcccgagcccagcaccaccaccgggacgaacgccuucuccaccgccaucgcgaacgugagcacccagaccgucaaggacacgcccaccccgaccgugcagaccuccccgcccagcacgcccgacgccuccaccaucccccagggcacccaccacaccgcccgcgggcugcucagcgugacggucaccaagcccgaggaggugcccacccccaccggcccggagcaggccuccaucgagacgaacagcagccggcuggcgaccuccaagacccccagccccucccccaccgcccaggugacgaccgagaacagcaacccgaacaccucccgccagcugguccucagcacccagcccgccaccuccagccccgugacgucccccgcccagcugaacuucgugcagagcgccaccaccaucgcgguccaggacgcccacccgucccccaccaaccggagcaagcgcaaccuggagauggaggugauccucacgcugucccagggccugcggaaguacuacgggcgcauccucaagcugcuggaccucacccuggaggaggacaccgagggccugcucgaguggugcaagcggaaccuggggcugaccugcgacgacaacuucuuccagaagcgcaucgaggaguucuuccucacgggcgagggccacuucaacgaggugcugcaguucaagacccccagcacccuguccccgaccgagagcgccuccgucgggcuccccacgguggagcccuucaagagcuacuucgccaagggcuuccuguccaucgacagcggguacuucagcgccaagugcuacccccgggcguccaacagcggccugcagcucaucaacgugacccagcacuccgcccgcaucgccgacaccccggggcccaagaucaccaaccugaagacgaucaacugcaucaaccugaaggcccucgucuucaaggagcaccgggagaucgagaucaacgugcugcugccccagguggccgucaaccucagcaacugccacgugcacaucaagucccacgugugcgacuacagccuggacaucgacggcaccguccgccugccccggauccaccacgagggcaccuucaucccggggaccuacaagaucgugaucgacaagaagaacaagcagaacgaccgcugcaaccucgucacgaacugcgugaucaagggccgggaggugcgcaaggggcaguccguccugcggcaguaccgcaccgagauccggaucggcaaggcgagcuccgggagccgccgccugcucuccgaggagagcggcgaggacugcaucucccggacccagcugcugcgcaccgagacggccgagauccacggcgacaacuacgggggccccggggacaagaucaccaucugcaacggcagcaccaucguggaccagcggcucggguccgagcugggcugcuacaccaucaaccgcgucaagagcuucaagcugugcgagaacuccgccacgggcaagagcugcgagaucgacaacacccccgugaagugcaagcagggguucugccugaagaucacccaggagggccgggggcacgugaagcucagccgcgacuccgaggugguccuggacgccugcgacagcuccugcgagaucaugauccccaagggcaccggcgacauccugguggacugcagcgggggccagcagcacuuccucaaggacaaccugaucgaccuggggugcccgaacaucccccuccugggcaagauggccaucuacaucugccggauguccaaccaccccaagacgaccauggcguuccuguucugguucagcuucggguacgugaucacgugcauccucugcaaggucaucuucuaccugcugaucguggugggcacccucggcaagaaguucaagcaguaccgcgagcugaagccccagaccugcaccaucugcgagaccaccccggucaacgccaucgacgccgagaugcacgaccugaacugcuccuacaacaucugccccuacugcgccagccggcucaccuccgacgggcuggcgcgccacgugaugcagugccccaagcggaaggagaagaucgaggagacggagcuguaccucaaccuggagcgcauccccugggugguccggaagcugcuccaggugagcgaguccaccggcguggcccugaagcgcagcuccuggcugaucguccuccuggugcugcucaccgugagccuguccccgguccagagcgcccccaucgggcacggcaagaccaucgagacguaccagacccgggagggguacaccuccaucugccuguucgugcucggcagcauccuguucaucgugucccaccugaugaagggccucgucgacagcguggggaacagcuucuuccccggccuguccaucugcaagaccugcagcaucggguccaucaacggcuucgagaucgagagccacaagugcuacugcucccuguucugcugccccuacugccgccacugcagcgccgacaaggagauccacaagcuccaccuguccaucugcaagaagcggaaggccgggagcaacgugaugcuggcggucugcaagcgcaugugcuuccgggccacgauggagguguccaacaaggcccuccugauccgcagcgugaucaacaccaccuucgucgugugcauccugauccucgccgugugcgucguguccaccagcgccguggagauggagucccugccggcgggcacgugggagcgcgaggaggaccugaccaacuucugccaccaggagugccaggucaccgagaccgagugccucugccccuacgaggcccuggugcugcggaagccccucuuccuggacagcaucgccaagggcaugaagaaccugcucaacuccacgagccuggagaccucccugagcaucgaggccccguggggcgccaucaacgugcaguccaccuucaagcccaccgucagcacggcgaacaucgcccucagcugguccagcguggagcaccgcgggaacaagauccugguguccgggcggagcgaguccaucaugaagcuggaggagcgcaccggcaucagcugggaccucggggucgaggacgccuccgagagcaagcugcugaccguguccgugauggaccucagccagauguacucccccgucuucgaguaccugagcggcgaccgccagguggaggaguggcccaaggcgaccugcacgggcgacugcccggagcggugcgggugcaccuccagcacgugccugcacaaggaguggccccacucccggaacuggcgcugcaaccccaccuggugcuggggcguggggaccggcugcacgugcugcggccucgacgucaaggaccuguucaccgacuacauguucgugaaguggaaggucgaguacaucaagaccgaggccaucgugugcguggagcugaccagccaggagcggcagugcucccucaucgaggccgggacccgcuucaaccugggccccgucaccaucacccugagcgagccgcggaacauccagcagaagcucccgcccgagaucgugacgcugcacccccgcaucgaggagggguucuucgaccugaugcacgugcagaagguccucuccgccagcaccgugugcaagcugcagagcugcacccacggcgugcccggggaccugcaggucuaccacaucggcaaccuccugaagggcgacaaggugaacgggcaccugauccacaagguggagccccacuucaacaccuccuggaugagcugggacggcugcgaccucgacuacuacugcaacaugggggacuggcccuccugcaccuacacgggcgucacccagcacaaccacgccgccuucgugaaccugcugaacaucgagaccgacuacaccaagaacuuccacuuccacagcaagcgggugacggcgcacggggacacgccccagcucgaccugaaggcccgcccgaacuacggcgccggcgagaucaccguccugguggagguggccgacauggagcuccacaccaagaagaucgagaucuccgggcugaaguucgccagccugaccugcaccggcugcuacgcgugcuccagcgggaucuccugcaagguccggauccacguggacgagcccgacgagcucaccgugcacgucaagagcgaggaccccgacaucguggccgccuccagcucccugauggcccgcaagcuggaguucggcaccgacagcacguucaaggccuucuccgcgaugcccaagaccagccucugcuucuacaucguggagcgggaguacugcaaguccugcagcaaggaggacacccagaagugcgucaacgccaagcuggagcgcccgcaguccauccugaucgagcacaaggggaccaucaucggcaagcagaacgacacgugcaccgccaaggccagcugcuggcucgagagcgugaaguccuucuucuacggccugaagaacaugcugagcgggaucuucggcaacguguucaucgggaucuuccuguuccucgcgcccuucauccugcugauccucuucuucauguucggcuggcggauccuguucugcuucaagugcugccgccggacccgcggccuguucaaguaccgccaccucaaggacgacgaggagaccggguaccggaagaucaucgagcgccugaacaacaagaagggcaagaacaagcugcucgacggggagcggcuggccgaccgcaagaucgccgagcuguucuccacgaagacccacaucggcuga

SEQ ID NO: 12019 - RNA, 5055 nt, Artificial Sequence
  derived and/or modified CDS sequence (opt1) from CCHFV(BA66019)__AF350448.1__GP
auguacacccugcucgugugcgccguccugugcccccagcuguggagccucgagggcacccacgugccgcacaacgagacgaagcacaacgggaccggcaucaccgccgcgcccggggagucccagggccccaugagccccgccuccaccgccgugccgcugacgcccgagccgcccaacaccaagcccgccgccagcgcguccgagcuggagagcuccggggagggccacaccagccuccuggccaccacgcagggccugaccucccccgaggccacccccgagcuccccaccacgaccgacaccggggucagcuccaccagcgugguggacaucggcacgcagauggccaaggacaccccgaccuccaccgcgcacacgagccugcccuccaaccccagcgcccccuccaccgcccaggggacccaccacaccauccgcggccugcucagcgucacguccaccaagccggaggaggccagcacccccaccgaccccgggaaggccggcgcggagacgggcagcccccggccggccaucucccgcaagcccacccugagccccaccgccgaggcccccaccgagaucaacaacuccagcacgccgaagcagcccgagcccuccauccagcccgccaccccgagccuggugaucucccccgcgcagcccgccuucccgcagagcgccaccuccaccgccgcccaggacaucuacagcucccccacgaaccggagcaagcgcaaccucaagauggagaucauccugacccugucccaggggcucaagaaguacuacggcaagauccagaagacccuggggcugacccucgaggaggacaccgagggccugcuggaguggugcaagcggaaccucggccugacgugcgacgacaacuucuuccagaagcgcaucgaggaguucuuccugaccggggagggcuacuucaacgaggugcuccaguucaagacccccagcacccccggguccacggagccgacccacgcggaggcccccaccgucaagcccuucaagagcuacuucgcccggggcuuccugaccaucaacuccggguacuucagcgccaagugcuacuccuggacgagcaacagcggccugcagcucaucaacgugacccagcaccccgcccgcaucgcggacaccccgggccccaagaucaccaaccugaagacgaucaacugcaucaaccugaaggccuccguguucaaggagcaccgggagaucgagaucaacguccuccugccccagguggccgugaaccugagcaacugccacguccucaucaagucccacgugugcgacuacagccuggacaucgacgggaccauccgccugccccggaucuaccacgagggcaccuucaucccggggaccuacaagaucgugaucgacaagcgcgacaagcagaacgaccggugcacgcucgucaccaacugcgugaucaagggccgcgaggugcggaaggggcaguccgcccugcgccaguaccggaccgagauccgcaucggcaaggcgagcgccggcucccggcgccugcucagcgaggaguccggggacgacugcaucagccggacccagcugcugcgcacggagaccgccgagguccacggcgacaacuacgggggccccggggacaagaucaccaucugcaacggcuccaccaucguggaccagcgccucggcagcgagcuggggugcuacacgaucaaccgggugaaguccuucaagcugugcgagaacagcggcaccgggaaguccugcaagaucgacaagcaccccgucaagugccgccagggcuucugccucaagaucacccaggagggccgggggcacgugaagcugagccgcggcuccgaggucgugcuggacgccugcgacagcagcugcgagaucaugauccccaaggggaccggcgacauccugguggacugcuccgggggccagcagcacuuccucaaggacaaccuggucgaccugggcugcccgaacaucccccuccuggggaagauggccaucuacaucugccggaugagcaaccaccccaagacgaccauggcguuccuguucugguucuccuucggcuacgugaucacgugcaucuucugcaagaucaucuucuaccuccugaucguggucgggacccugggcaagaaguucaagcaguaccgcgagcucaagccccagaccugcaccaucugcgagaccaccccgacgaacgccaucgacgccgagaugcacgaccugaagugcagcuacaacaucugccccuacugcgccucccggcugaccagcgacgggcucgcccgccacgugacccagugccccaagcggaaggagaagguggaggagaccgagcuguaccugaaccucgagcgcauccccuggaucguccggaagcugcuccagguguccgagagcaccggcguggcgcugaagcgcuccagcuggcugaucguccugcucgugcugcugacggugucccucagcccgguccaguccgcccccaucggccacgggaagaccaucgaggccuaccagacccgggagggcuacaccagcgugugccuguucaugcucgggggcauccuguucguggucuccugccugaugaaggggcugguggacagcguguccaacagcuucuuccccggccucuccaucugcaagacgugcagcaucggcagcgucaacggguucgagaucgagucccacaagugcuacugcagccugcugugcugccucuacugccgccacugcuccgccgaccgggagauccaccagcugcaccugagcaucugcaagaagcgccgggccggcgggaacgugaugcucgcggugugcaagcgcaugugccugcgggccaccauggaggucuccaacaaggugcuguucauccgcagcaucaucaacaccaccuucgugaucugcauccucguccuggccgugugcaucguguccacgagcgccgucgagauggagucccugccggcgggcaccugggagcgcgaggaggaccucaccaacuucugccaccaggagugccaggugaccgagacggagugccugugccccuacgaggcccuggugcuccggaagccccuguucagcgacuccaucgucaaggggaugaagaaccugcucaacagcaccucccuggagaccagccuguccaucgaggcccccuggggcgccaucaacgugcagagcaccuucaagccgacgguguccaccgccaacaucgcgcucagcugguccagcgucgagcaccgcggcaacaagauccuggugagcgggcgguccgagagcaucaugaagcuggaggagcgcaccggcaucuccugggaccucgggguggaggacgccagcgaguccaagcugcugaccgucagcgugauggaccucucccagauguacagccccguguucgaguaccuguccggcgaccggcaggucgaggaguggcccaaggccacgugcaccggcgacugccccgaccgcugcgggugcaccagcuccacgugccugcacaaggaguggccgcacagccggaacuggcgcugcaaccccaccuggugcuggggcguggggaccggcugcacgugcugcgggcucgacgugaaggaccuguucaccgacuacauguucgucaaguggaagguggaguacaucaagaccgaggccaucgugugcgucgagcugaacucccaggagcggcagugcagccucaucgaggccggcacccgcuucaaccugggccccgugaccaucacccuguccgagccccggaacauccagcagaagcucccgcccgagaucaucacgcugcacccccgcaucgaggagggguucuucgaccugaugcacgugcagaagguccucagcgcguccaccgugugcaagcugcagagcugcacccacggcguccccggggaccugcagaucuaccacaucggcaaccuccugaagggggaccgggugaacggccaccugauccacaagaucgagccgcacuucaacaccuccuggaugagcugggacggcugcgaccucgacuacuacugcaacaugggggacuggcccagcugcacguacaccggcgugacccagcacaaccacgccgccuucgucaaccugcugaacaucgagaccgacuacaccaagaacuuccacuuccacuccaagcgcgugacggcccacggggacacgccccagcucgaccugaaggcccggcccaccuacggcgcgggggagaucaccgugcuggucgagguggccgacauggagcuccacaccaagaagaucgccaucagcggccugaaguucgccucccugaccugcaccggcugcuacgcgugcagcuccgggaucagcugcaaggugcgcauccacgucgacgagccggacgagcucaccgugcacgugaaguccgaggaccccgacaucgucgccgccagcuccagccugauggcccggaagcuggaguucggcacggacuccaccuucaaggccuucagcgcgaugcccaagaccucccucugcuucuacaucguggagcgcgaguacugcgagagcugcuccaaggaggacacccagaagugcgugaacacgaagcuggagcagccccagagcauccugaucgagcacaaggggaccaucaucggcaagcagaacgacacgugcaccgccaaggccuccugcuggcucgagagcgucaaguccuucuucuacggccugaagaacaugcugagcgggaucuucggcaacguguucaucgggaucuuccucuuccuggccccguucauccugcugauccucuucuucauguucggcuggcggauccuguucugcuucaagugcugccgccggacccgcgggcuguucaaguaccgcuaccucaaggacgacgaggagagcggcuaccggcgcaucaucgagcggcugaacaacaagaagggcaagaacaagcugcucgacggggagcgccuggccgaccggcgcaucgcggagcuguucuccaccaagacccacaucggcuga

SEQ ID NO: 12020 - RNA, 5055 nt, Artificial Sequence
  derived and/or modified CDS sequence (opt1) from CCHFV(SPU 18/88)__KJ682810.1__GP
auguacacgccccugcucugcgccauccugugccugcagcucuggagccuggagggcaucuacgggcuguccaacaagacccagcacaacgacaccagcaccaucaaggugccggaggagucccagaagaccagccuccccgccaacaccgcgucccccaucacgagcgaccccuccagcgccaccuccaccgcccuggccagcggcccggagggguccggcgacaccagcacgucccccagcgucaccacccaggggcccacccugcucgagacgacccccgagccgcacaccaccaucgacaucgacgaguccagcacggccaucgcggacaucuccacccagaccgugaaggacauccccacccccacgacccacaccagccugcccuccaccccgagcgcccccacgaucccccaggaggcccaccacaccgcccgcggccugcucagcgugaccuccaccaagcccggcgagacgagcaccccgaccucccccggggaggcgagcaccgaggccuccagcccccagcccacgaucuccgagaccccgagcccgccgcccaccacccaggcccccacggagaucaacaaccccaacaccucccggcagcccaugcccagcacccagccggccgcccccaacuccgucacgcccccggugcagcccaccuucagccaguccgacgugagcaccgucgcgcaggacauccaccccucccccaccaaccgcagcaagcggaaccuggagauggagaucauccugacccucucccagggccugaagaaguacuacgggaaggugcugaagcuccuggaccugacccucgaggaggacacggagggccugcuggaguggugcaagcgcaaccucgggcugaccugcgacgacaacuucuuccagaagcggaucgaggaguucuuccugaccggcgagggccacuucaacgaggugcuccaguucaagaccccgagcacgcugucccccaccgagcccgcccgcgucgagagccccaccguggagccguucaagagcuacuucgccaagggguuccuguccauggacagcggcuacuucuccgccaagugcuaccccaagagcuccaacagcgggcuccagcugaucaacgugacccagcacuccauccggaucacggacacccccggccccaagaucaccagccugaagaccaucaacugcaucaaccucaaggcccuggucuucaaggagcaccgcgagaucgagaucaacgugcugcucccccagguggcggucaaccuguccaacugccacgugcugaucaagagccacgccugcgacuacucccucgacaucgacggccccgugcggcugccccgcauccaccacgaggggacguucauccccggcaccuacaagaucgucaucgacaagaagaacaagcagaacgaccggugcacccuggugaccaacugcgugaucaaggggcgcgagauccggaagggccagagcguccuccgccaguaccggacggagaucaagaucgggaaggccuccagcggcucccgccggcugcugagcgaggaguccaacgacgacugccucagccgcacccagcugcugcggaccgagaacgccgagauccacagcgacaacuacggcgggccgggcgacaagaucaccaucugcaacggguccacgaucguggaccagcgccucggcagcgagcuggggugcuacaccaucaaccgggugaaguccuucaagcugugcgagaacagcgccaccggcaaguccugcgagaucgacagcacccccguccgcugccgccagggcuucugccugaagaucacgcaggaggggcggggccacgugaagcucucccgcgggagcgaggucgugcuggacgcgugcgacuccagcugcgagaucaugauccccaagggcaccggggacauccugguggacugcuccggcggccagcagcacuuccucaaggacaaccuggucgaccuggggugccccaacaucccgcuccugggcaagauggccaucuacaucugccggaugagcaaccaccccaagaccaccaugggguuccuguucugguucuccuucggcuacgugaucacgugcauccucugcaaggugaucuucuaccugcugaucgucgugggcacccucgggaagaaguucaagcaguaccgcgagcugaagccccagaccugcaccaucugcgagacgaaccccgugaacgccaucgacgccgagaugcacgaccugaacugcagcuacaacaucugcccguacugcgccucccggcucaccagcgacggccuggcgcgccacgucaugcagugccccaagcggaaggagaagaucgaggagaccgagcuguaccucaaccuggagcgcauccccuggguggugcggaagcugcuccaggucuccgagagcaccgggguggcccugaagcgcuccagcuggcuggugauccuccugguccugcucaccgugagccuguccccggugcagagcgcccccaucucccacggcgagacggucgagguguaccagacccgggagggguacaccagcaucugccuguucgugcucggcuccauccuguuccuggucagcugccucaugaagggccugguggacuccguggggaacagcuucucccccggccugagcaucugcaagaccugcuccaucgggagcaucaacggcuucgagaucgagucccacaagugcuacugcagccucuucugcugccccuacugccgccacugcuccgccgacaucgagauccacaagcugcaccugagcaucugcaagaagcggaagacgggguccaacgucaugcucgcggugugcaagcgcaugugcuuccgggccaccguggaggucagcaacaaggcccugcugauccgcaacaucaucaacaccaccuucguggugugcauccucauccuggccgucugcgugguguccacgagcgccgucgagauggagaaccugccggcgggcaccugggagaaggaggaggaccucaccaacuucugccaccaggagugccaggugaccgagacggagugccugugccccuacgaggcccuggugcuccggaagccccuguuccuggacagcaucgucaagggcaagaagaaccuccugaacuccaccagccuggagaccucccucagcaucgaggcccccuggggcgccaucaacgugcaguccaccuucaagccgacggugagcgccgcgaacaucgcccuguccuggagcuccgucgagcaccgcgggaacaagauccuggugagcgggcgguccgagagcaucaugaagcucgaggagcgcaccggcaucuccugggaccuggggguggaggacgccagcgaguccaagcugcucaccgucagcgugauggaccugucccagauguacagccccguguucgaguaccuguccggcgaccgccaggucgaggaguggcccaaggcgaccugcacgggcgacugccccgagcggugcgggugcaccagcagcacgugccuccacaaggaguggccgcacucccgcaacuggcggugcaaccccaccuggugcuggggcguggggaccggcugcacgugcugcgggcuggacgugaaggaccuguucaccgacuacauguucgucaaguggaagguggacuacaucaagaccgaggccaucgugugcgucgagcucaccagccaggagcgccagugcucccugaucgaggccggcacccgguucaaccugggccccgugaccaucacccucagcgagccccgcaacauccagcagaagcugccgcccgagaucgucacgcugcacccccggaucgaggagggguucuucgaccucaugcacauccagaaggugcuguccgccagcaccgugugcaagcugcaguccugcacccacggcguccccggggaccuccagaucuaccacaucggcaaccugcugaagggcgacaaggugaacgggcaccucauccacaagaucgagccgcacuucaacaccagcuggauguccugggacggcugcgaccuggacuacuacugcaacaugggggacuggcccagcugcuccuacacgggcgugacccagcacaaccacgccgccuucgucaacaugcugaacaucgagaccgacuacaccaagaacuuccacuuccacagcaagcgcgugaccgcgcacggggacacgccccagcucgaccugaaggcccggcccaccuacggcgccggcgagaucaccgugcuggucgagguggccgacauggagcuccacaccaagaagaucgagaucuccgggcugaaguucgccagccugacgugcaccggcugcuacgcgugcuccagcgggaucuccugcaaggugcgcauccacgucgacgagccggacgagcucaccgugcacgucaagagcgaggaccccgacaucguggccgccuccagcagccugauggcccggaagcuggaguucggcaccgacuccacguucaaggccuucagcgcgaugcccaagaccucccucugcuucuacaucguggagcgcgaguacugcaagagcugcuccaaggaggacacccagaagugcgugaacaccaagcuggagcagccccagagcauccugaucgagcacaaggggacgaucaucggcaagcagaacgacacgugcaccggcaaggccgggugcuggcucgaguccaucaagagcuucuucuacggccugaagaacaugcuguccgggaucuucggcaacgucuucaucgggaucuuccuguuccucgccccguucaucaugcugauccuguucuucauguucggcuggcggauccucuucugcuucaagugcugccgccggacccgcggccuguucaaguaccggcaccugaaggacgacgaggagaucggguaccgcaagaucaucgagcggcucaagaacaagaagggcaagaacaagcugcuggacggggagcgccucgccgaccggaagaucgccgagcuguucagcaccaagacccacaucggcuga

SEQ ID NO: 12021 - RNA, 5055 nt, Artificial Sequence
  derived and/or modified CDS sequence (opt1) from CCHFV(66019)__AB069669.1__GP
auguacacccugcucgugugcgccguccugugcccccagcuguggagccucgagggcacccacgugccgcacaacgagacgaagcacaacgggaccggcaucaccgccgcgcccggggagucccagggccccaugagccccgccuccaccgccgugccgcugacgcccgagccccccaacaccaagccggccgccagcgcguccgagcuggagagcuccggggagggccacaccagccuccuggccaccacgcagggccugaccucccccgaggccacccccgagcuccccaccacgaccgacaccggggucagcuccaccagcgugguggacaucggcacgcagauggccaaggacaccccgaccuccaccgcgcacacgagccugcccuccaaccccagcgcccccuccaccgcccaggggacccaccacaccauccgcggccugcucagcgucacguccaccaagccggaggaggccagcacccccaccgaccccgggaaggccggcgcggagacgggcagcccccggccggccaucucccgcaagcccacccugagccccaccgccgaggcccccaccgagaucaacaacuccagcacgccgaagcagcccgagcccuccauccagcccgccaccccgagccuggugaucucccccgcgcagcccgccuucccgcagagcgccaccuccaccgccgcccaggacaucuacagcucccccacgaaccggagcaagcgcaaccucaagauggagaucauccugacccugucccaggggcucaagaaguacuacggcaagauccagaagacccuggggcugacccucgaggaggacaccgagggccugcuggaguggugcaagcggaaccucggccugacgugcgacgacaacuucuuccagaagcgcaucgaggaguucuuccugaccggggagggcuacuucaacgaggugcuccaguucaagacccccagcacccccggguccacggagccgacccacaccgaggcgcccaccgucaagcccuucaagagcuacuucgcccggggcuuccugacgaucgacuccggguacuucagcgccaagugcuacucccgcaccagcaacagcggccugcagcucaucaacgugacccagcaccccgcccggaucgccgacaccccgggccccaagaucacgaaccugaagaccaucaacugcaucaaccugaaggcguccguguucaaggagcaccgcgagaucgagaucaacguccuccugccccagguggccgugaaccugagcaacugccacguccucaucaagucccacgugugcgacuacagccuggacaucgacgggaccauccggcugccccgcaucuaccacgagggcaccuucaucccggggacguacaagaucgugaucgacaagcgggacaagcagaacgaccgcugcacccucgucaccaacugcgugaucaagggccgggaggugcgccgggggcaguccgcccugcgccaguaccggaccgagauccgcaucggcaaggccagcgcgggcucccggcgccugcucagcgaggaguccggggacgacugcaucagccgcacgcagcugcugcggaccgagaccgccgagguccacggcgacaacuacgggggccccggggacaagaucaccaucugcaacggcuccacgaucguggaccagcgccucggcagcgagcuggggugcuacaccaucaaccgggugaaguccuucaagcugugcgagaacagcggcaccgggaaguccugcaagaucgacaacacccccgucaagugccgccagggcuucugccucaagaucacgcaggagggccgggggcacgugaagcugagccgcggcuccgaggucgugcuggacgccugcgacagcagcugcgagaucaugauccccaaggggaccggcgacauccugguggacugcuccgggggccagcagcacuuccucaaggacaaccuggucgaccugggcugcccgaacaucccccuccuggggaagauggccaucuacaucugccggaugagcaaccaccccaagaccaccauggccuuccuguucugguucuccuucggcuacgugaucacgugcaucuucugcaagaucaucuucuaccuccugaucguggucgggacccugggcaagaaguucaagcaguaccgcgagcucaagccccagaccugcaccaucugcgagacgaccccgaccaacgcgaucgacgccgagaugcacgaccugaagugcagcuacaacaucugccccuacugcgccucccggcugaccagcgacgggcucgcccgccacgugacccagugccccaagcggaaggagaagguggaggagacggagcuguaccugaaccucgagcgcauccccuggaucguccggaagcugcugcagguguccgagagcaccggcguggcccucaagcgcuccagcuggcugaucguccugcucgugcugcugaccgugucccucagcccgguccaguccgcgcccaucggccacgggaagaccaucgaggccuaccagacgcgggagggcuacaccagcgugugccuguucaugcuggggggcauccucuucguggucuccugccugaugaaggggcugguggacagcguguccaacagcuucuuccccggccucuccaucugcaagaccugcagcaucggcagcgucaacggguucgagaucgagucccacaagugcuacugcagccugcugugcugccucuacugccgccacugcuccgccgaccgggagauccaccagcugcaccugagcaucugcaagaagcgccgggccggcgggaacgugaugcucgccgugugcaagcgcaugugccugcgcgcgaccauggaggucuccaacaaggugcuguucauccggagcaucaucaacacgaccuucgugaucugcauccucguccuggccgugugcaucguguccaccagcgccgucgagauggagucccugccggccggcaccugggagcgcgaggaggaccucacgaacuucugccaccaggagugccaggugaccgagaccgagugccugugccccuacgaggcgcuggugcuccggaagccccuguucagcgacuccaucgucaaggggaugaagaaccugcucaacagcaccucccuggagacgagccuguccaucgaggcccccuggggcgccaucaacgugcagagcaccuucaagccgaccguguccaccgccaacaucgcccucagcugguccagcgucgagcaccgcggcaacaagauccuggugagcgggcgguccgagagcaucaugaagcuggaggagcgcacgggcaucuccugggaccucgggguggaggacgcgagcgaguccaagcugcugaccgucagcgugauggaccucucccagauguacagccccguguucgaguaccuguccggcgaccggcaggucgaggaguggcccaaggccaccugcaccggcaacugccccgaccgcugcgggugcacgagcuccaccugccugcacaaggaguggccgcacagccggaacuggcgcugcaaccccaccuggugcuggggcguggggaccggcugcacgugcugcgggcucgacgugaaggaccuguucaccgacuacauguucgucaaguggaagguggaguacaucaagaccgaggccaucgugugcgucgagcugaacucccaggagcggcagugcagccucaucgaggccggcacccgcuucaaccugggccccgugacgaucacccuguccgagccccggaacauccagcagaagcucccgagcgagaucaucacccugcacccccgcaucgaggagggguucuucgaccugaugcacgugcagaagguccucuccgccagcaccgugugcaagcugcaguccugcacgcacggcguccccggggaccugcagaucuaccacaucggcaaccuccugaagggggaccgggugaacggccaccugauccacaagaucgagccccacuucaacaccagcuggaugagcugggacggcugcgaccucgacuacuacugcaacaugggggacuggccguccugcaccuacaccggcgugacccagcacaaccacgcggccuucgucaaccugcugaacaucgagacggacuacaccaagaacuuccacuuccacagcaagcgcgugaccgcccacggggacaccccccagcucgaccugaaggcccggcccacguacggcgccggggagaucaccgugcuggucgagguggcggacauggagcuccacaccaagaagaucgccaucuccggccugaaguucgccagccugaccugcacgggcugcuacgccugcuccagcgggaucuccugcaaggugcgcauccacgucgacgagcccgacgagcucaccgugcacgugaagagcgaggacccggacaucgucgcggccuccagcucccugauggcccggaagcuggaguucggcaccgacagcaccuucaaggccuucuccgccaugcccaagacgagccucugcuucuacaucguggagcgcgaguacugcgaguccugcagcaaggaggacacccagaagugcgugaacaccaagcuggagcagccccaguccauccugaucgagcacaaggggaccaucaucggcaagcagaacgacacgugcaccgcgaaggccagcugcuggcucgaguccgucaagagcuucuucuacggccugaagaacaugcugagcgggaucuucggcaacguguucaucgggaucuuccucuuccuggcccccuucauccugcugauccucuucuucauguucggcuggcggauccuguucugcuucaagugcugccgccgcacccgggggcuguucaaguaccgcuaccucaaggacgacgaggaguccggcuaccggcgcaucaucgagcggcugaacaacaagaagggcaagaacaagcugcucgacggggagcgccuggccgaccggcgcaucgccgagcuguucagcaccaagacgcacaucggcuga

SEQ ID NO: 12022 - RNA, 5052 nt, Artificial Sequence
  derived and/or modified CDS sequence (opt1) from CCHFV(Gaib)__KX013445.1__GP
auguacaucccccugguguacgccgucaucuaccuccagcuguacggccucgggggcgcccacgggcuccugaacaagaccgagcagaacgagaccggcaucacggcgacccacgggcgcgugcagggcccgcccagcgccuccaucacccugcccgugacccccgacccgcucagcgccacguccgccgccagcaccuccggccccgaggggagcggcgagguccccaccucccccagcaccaucacgcaggggcugaccuccagcgagaacaccccgcagcugcccaccgcgacggacaccggcaucuccagcaccuccaucaucgacgugagcacccagacggccggggacaccuccacccccaccgcccacacgagccuccccaacuccccgagcgcccccuucaccucccaggacacccggcacaccgugcgcggccugcugacggucaccagcaccaagagcgacgaggcguccacccucacggaccccaaggaggccagcaccgaggcccggucccccagcccguccaucagccgcacccccacccccucccccacggugcaggccagcaccgagaacaacaccccguccacgccccggcagcccgagcccaccacccgcccggcccugcccagccccaccaccucccccacccagccgagccugucccagagcgcgacguccgccgccauccaggacaugcaccccagccccaccaaccggucccgccggaaccucgagauggagaucauccugacccugagccagggccucaagaaguacuacgggaagauccugaagcugcucgaccugacccuggaggaggacacggagggccuccuggaguggugcaagcgcaaccuggaccugaccugcgacgagaacuucuuccugaagcggaucgaggaguucuuccuguccggggagggccacuucaacgaggugcuccaguucaaggccccgagcaccaugagcuccaccgagcccacgcacgccggcccgcccaccgucgagcccuucaagagcuacuucgcgaagggguuccuguccaucgacagcggcuacuucuccgccaagugcuacccccgcaccagcaacuccgggcugcagcucaucaacgugacccagcacacggcccggaucgccgacacccccggccccaagaucaccaacgugaagaccaucaacugcaucaaccugaaggccagcgucuucaagaagcaccgcgagguggagaucaacgugcugcucccgcagaucgcggucaaccuguccaacugccacgugcugaucaagagccacgugugcgacuacucccucaacuucgacgggaugguccggcugccccgcauccaccacgagggcacguucauccccggcaccuacaagaucgugaucgaccggaagaacaagcagaacgaccgcugcacccuggugaccaacugcgucaucaaggggcgggaggugcgcaagggccagagcgcccuccggcaguaccgcacggagaucaagaucggggaggccuccaucggcagccgccggcugcuguccgaggagagcuccgacgacugcaucagccgcacccagcuccugcggaccgagaccgccgagauccacaacgacaacuacgggggccccggcgacaagaucacgaucugcaacgggagcaccaucguggaccagcgccugggcuccgagcucgggugcuacaccaucaaccgggucaagagcuucaagcugugcgagaacuccgccaccggcaagagcugcgagaucgacuccaucccggugaagugccgccagggguucugccugaagaucacgcaggagggccggggccacgucaagcugagccgcggguccgagguggugcucgacgcgugcgacagcuccugcgagaucaugauccccaagggcaccggggacauccuggucgacugcagcggcggccagcagcacuuccugaaggacaaccucaucgaccuggggugccccaacaucccccugcucggcaagauggccaucuacaucugccggauguccaaccacccgaagaccaccauggccuuccuguucugguucagcuucggguacgugaucacgugcaucuucugcaaggccaucuucuaccugcucaucaucgugggcacccuggggaagaaguucaagcaguaccgcgagcugaagccccagaccugcaccaucugcgagacgacccccgucaacgcgaucgacgccgagaugcacgaccucaacugcuccuacaacaucugccccuacugcgccagccggcugaccuccgacggccuggcccgccacguggugcacugcccgaagcggaaggagaagaucgaggagaccgagcucuaccugaaccuggagcgcguccccuggguggugcggaagcuccugcaggucagcgaguccaccggcguggcccugaagcgcagcuccuggcucaucgugcugcugguccuccugacggugagccugagccccgugcaguccgcgcccaucgggcacggcaagaccaucgagaccuaccagacccgggagggguacacgagcaucugccucuucguccugggcgggauccuguucaucguguccugccucaugaagggccugguggacagcgucggcaacaacuucuucccggggcugaccaucugcaagaccugcuccaucagcuccaucaacggcuucgagaucgagagccacaagugcuacugcucccuccugugcugccccuacugccgccacugcagcgccgaccgggagauccaccagcugcaccucuccaucugcaagaagcgcaagaccgggagcaacgugaugcuggccgugugcaagcgcaugugccugcgggucacgaccgagguguccaaccgcgcccucuucauccggagcaucaucaacaccaccuucgugaucugcauccugauccuggccgucugcgugaucuccacgagcgcgguggagauggagaaccuccccgccggcaccugggagcgcgaggaggaccugaccaacuucugccaccaggagugccaggucaccgagacggagugccugugcccguacgaggcccucgugcugcggaagccccuguucuccgacagcaucgugaaggggaugaagaaccuccugaacuccaccagccuggagaccagccucuccaucgaggcccccuggggcgccaucaacguccagagcaccuucaagcccacgguguccaccgcgaacaucgcccugagcugguccagcaucgagcaccgcggcaacaagauccugguguccgggcggagcgaguccaucaugaagcucgaggagcgcaccggcaucagcugggaccugggggucgaggacgccuccgagagccggcugcucaccguguccgugauggaccugagccagauguacuccccggucuucgaguaccugagcggcgaccgccagguggaggaguggcccaaggccacgugcaccggggacugccccgagcggugcggcugcaccuccagcacgugccuccacaaggaguggccccacucccgcaacuggcggugcaacccgaccuggugcuggggcguggggaccggcugcacgugcugcgggcuggacgucaaggaccuguucaccgacuacauguucgugaaguggaagguggaguacaucaagaccgaggcgaucgucugcguggagcucaccagccaggagcgccagugcagccugaucgaggccggcacccgguucaaccugggccccgugaccaucacgcucuccgagccccgcaacauccagcagaagcugcccccggagaucaucacccugcacccccggaucgaggagggguucuucgaccucaugcacguccagaaggugcugagcgccuccaccgugugcaagcugcagagcugcacccacggcguccccggggaccuccagguguaccacaucggcaaccugcugaagggggacaaggucaacggccaccucauccacaagaucgagccccacuucaacaccuccuggaugagcugggacggcugcgaccuggacuacuacugcaacaugggggacuggccguccugcacguacaccggcgugacccagcacaaccacgccgccuucgugaaccugcucaacaucgagaccgacuacacgaagaacuuccacuuccacagcaagcgcgucaccgcgcacggggacacgccccagcuggaccugaaggcccggcccaccuacggcgccggggagaucaccgugcucguggaggucgccgacauggagcugcacaccaagaagaucgagaucuccggccugaaguucgccagccugaccugcaccggcugcuacgcgugcuccagcgggaucuccugcaaggugcgcauccacguggacgagcccgacgagcucacgguccacgucaagagcgaggacccggacaucguggccgccuccagcucccugauggcccggaagcucgaguucggcaccgacagcaccuucaaggccuucuccgcgaugcccaagaccagccugugcuucuacaucguggagcgcgaguacugcaagagcugcucccgcgaggacacgcagaagugcgugagcaccaagcuggagcagccccaguccauccucaucgagcacaaggggaccaucaucggcaagcagaacaacacgugcaccaccaagacgaccugcuggcuggagagcgugaaguccuucuucuacgggcugaagaacaugcucagcuccaucuucggcaacgucuucgugggcaucuucagcuuccuggcccccuucauccugcugauccucuucuucauguucggguggcggauccuguucugcuucaagugcugccgccggacccgcggccuguucaaguaccggcaccucaaggacgacgaggagaccggguaccgccggaucaucgagcgccugaacaacaagaagggcaaguccaagcugcucgacggcgagcggcuggccgaccgcaagaucgccgagcuguucagcaccaagacccacaucggguga

SEQ ID NO: 12023 - RNA, 5055 nt, Artificial Sequence
  derived and/or modified CDS sequence (opt1) from CCHFV(SPU415/85)__DQ211635.1__GP
auguacaccccccuggugugcgccgucaucugccuccagcuguggaaccugggcgggacccucguguucaucaaccgcacgcagcacaacgagaccggcaccguggccaccccggaggggacgcugcggccccgccugcccgucagcaccgcgcuccccaccaaguccgaccggccgagcgugggccccgccgccuccagcuccgggcuggagggcagcggcgagcccaacaccucccccagcaucacgaccaaggggcugaccccgcccgagaccacgcccgcccuccccaccgccaccgacaccgacgcguccagcacgggcguggucgacguguccacccagaugaccaaggacaucccgaugagcaccgccuacacgaacccccccuccacccccagcgccccguccaccccccaggggacccaccacacggcccgcggccugcugagcguggcguccaccaagagcgaggaggucuccaugagcaccagccccgccaagaccuccacggagaccagcucccccccgcccgccaccagcgagacccccacgcccuccccgaccacccaggugcccaccgggaacaacaaccccaacacgagccggcagcccaccccguccgcccagcccgccaugagcaaccccgcgaccuccccggcccagcccaaccucagccaguccgccccccccaccgccgaccagggcgugcacccgagccccaccaaccgcuccaagcggaaccuggagaucgagaucauccugacgcucagccagggccugcgcaaguacuacgggaagauccugaagcuccuggaccugacccucgaggaggacaccgagggccugcuggaguggugcaagcggaaccucgggcugaccugcgacgacaacuucuuccagaagcgcaucgaggaguucuuccugacgggcgagggcuacuucaacgagguccuccaguucaaggugcccuccacccugagcuccaccgagcccacccacacgcggccgcccaccguggagcccuucaagagcuacuucgccaagggguuccuguccaugaacagcggcuacuucagcgcgaagugcuacccccgcaccuccaacagcgggcuccagcugaucaacgucaccaagcacuccgccaagaucgccgacacgccgggccccaagaucaccaaccugaagaccaucaacugcaucaaccuccgggccagcguguucaaggagcaccgcgagguggagaucaacguccugcugccccagguggccgugaaccucuccaacugccacgcgcagaucaagagccacgucugcgacuacucccuggccaccgacgggauggugcggcugccccacauccaccacgagggcacguucaucccgggcaccuacaagaucgugaucgacaagaagaacaagcagaacgaccgcugcacccucgucaccaacugcgugaucaaggggcgggagguccgcaagggccagagcgcccugcggcaguacaagacggagauccgcaucgggaaggccuccagcggcucccggcgccugcucagcgaggaguccgacggggacugcaucagccgcacccagcugcugcggaccgagaccacggagauccacuccgacaacuacggcggccccggggacaagaucaccaucugcaacggcagcaccaucguggaccagcgccucggguccgagcugggcugcuacaccaucaaccgggugaagagcuucaagcugugcgagaacagcgccacggggaaguccugcgagaucgacagcacccccgucaagugccgccagggcuucugccucaagaucacccaggagggccgggggcacgugaagcugucccgcggcagcgagaucgugcuggacgcgugcgacuccaacugcgagaucaugauccccaaggggaccggcgacauccuggucgacugcagcggcgggcagcagcacuuccucaaggacaaccugaucgaccugggcugcccgaacaucccccuccuggggaagauggccaucuacaucugccggauguccaaccaccccaagacgaccauggccuuccuguucugguucagcuucggcuacgugaucaccugcauccucugcaaggugaucuucuaccugcugaucgucgccgggaccgugggcaagaaguucaagcaguaccgcgagcuccggccccagacgugcaccaucugcgagaccaucccggugaacgcgaucgacgccgagaugcacgaccugaacugcuccuacaacaucugccccuacugcgccagccgccugaccuccgacggccucgcccggcacgucaugcagugccccaagcgcaaggagaagguggaggagaccgagcuguaccugaaccucgagcggaucccgugggugguccgcaagcugcugcaggugagcgaguccacggggguggcccucaagcggagcuccuggcugaccguccugcucgugcugcugaucgugagccucucccccguccagagcgcgcccaucggccacgggaagaccaucgagaccuaccaggcccgcgagggcuacacguccuucugccuguucauccuggggagcauccucuucguggugagcugccuggucaagggccugaucgacuccgugggcaacagcuucuuccccgggcucuccaucugcaagaccugcagcaucggcuccaucaacggguucgagaucgagagccacaagugcuacugcucccuguucugcugcccguacugccggcacugcagcgccgaccgcgagauccacaagcugcaccucuccaucugcaagaagcggaagaccggcagcaacgugaugcuggccgucugcaagcgcaugugcuuccgcgccaccaucgagguguccaaccgggcgcugcucauccgcaacaucaucaacacgaccuucguggucugcauccugacccuggccgugugcguggucagcaccuccgccguggagauggagagccuccccgccgggacgugggagaaggaggaggaccugaccaacuucugccaccaggagugccaggugaccgagaccgagugccugugccccuacgaggcccucguccugcggaagccccuguuccucgacuccaucgugaagggcaugaagaaccugcugaacagcacgucccucgagaccagccuguccaucgaggcgccguggggcgccaucaacgugcagagcaccuucaagcccaccgucagcgccgccaacaucgcgcuguccuggagcuccguggagcaccgcgggaacaagauccucgugagcggccgguccgagagcaucaugaagcuggaggagcgcacggggaucuccugggaccugggcgucgaggacgccagcgaguccaagcuccugaccgugagcgugauggaccugucccagauguacagccccgucuucgaguaccucuccggggaccggcagguggaggaguggcccaaggccaccugcaccggcgacugcccggagcgcugcggcugcacgagcuccaccugccugcacaaggaguggccccacagccggaacuggcgcugcaaccccaccuggugcuggggggugggcaccgggugcacgugcugcggccuggacgucaaggaccucuucaccgacuacauguucgugaaguggaagguggaguacaucaagaccgaggccaucgucugcguggagcugaccucccaggagcggcagugcagccugaucgaggccggcacgcgcuucaaccucgggcccgucaccaucacccuguccgagccgcggaacauccagcagaagcugccccccgagaucaucacccuccacccccgcaucgaggagggcuucuucgaccugaugcacgugcagcgggugcugagcgcgagcacggucugcaagcuccaguccugcacccacggggugccgggcgaccugcagguguaccacaucgggaaccugcucaagggcgacaaggucaacggccaccugauccacaagaucgagccccacuucaacaccagcuggauguccugggacgggugcgaccuggacuacuacugcaacaugggcgacuggcccagcugcaccuacaccggggugacgcagcacaaccacgccgccuucgugaaccuccugaacaucgagaccgacuacaccaagaacuuccacuuccacuccaagcgcgucaccgcccacggcgacacgccccagcuggaccucaaggcccggccgaccuacggggcgggcgaggugaccgugcuggucgagguggccgacauggagcugcacaccaagaagaucgagaucagcggccucaaguucgccucccugacgugcaccgggugcuacgccugcagcuccggcaucagcugcaaggugaagauccacgucgacgagcccgacgagcugaccgugcacgugaaguccgaggaccccgacaucgucgccgcggggagcucccucauggcccgcaagcuggaguucggcgccgacagcaccuucaaggccuucuccgcgaugcccaagacgagccugugcuucuacaucguggagcgggaguacugcaaguccugcagccgcgaggacacccggaagugcgugaacaccaagcucgaccgcccgcaguccauccugaucgagcacaaggggaccaucaucggcaagcagaacaacacgugcaccgccaaggccagcugcuggcuggagagcgucaaguccuucuucuacggccucaagaacaugcugagcgggaucuucggcaacguguucaucgggaucuuccuguucaucgcccccuucgugcuccugauccuguucuucauguucggcuggcgcauccuguucugcuucaagugcugccggcgcacccggggccucuucaaguaccgccaccugaaggacgacgaggagaccggguaccggaagaucaucgagcgccugaacaacaagaagggcaagaacaagcuccuggacggggagcggcuggccgaccgcaagaucgcggagcucuucuccacgaagagccacaucggcuga

SEQ ID NO: 12024 - RNA, 5055 nt, Artificial Sequence
  derived and/or modified CDS sequence (opt1) from CCHFV(SPU 431/85)__KJ682812.1__GP
auguacacgccccuggugugcgccgucaucugccuccagcuguggaaccugggcgggacccuggugagcaccaaccgcacccagcacaacgagaccgggaccguggccacccccgaggggacccugcggccccgccugcccguguccaccgcccuccccaccaagagcgaccggcccuccguggggcccgccgccagcuccagcgggcuggagggcuccggcgagcccaacaccagccccuccaucaccaccaaggggcugaccccgcccgagaccacccccgcccuccccaccgccaccgacaccgacgccagcuccaccggcguggucgacgugagcacccagaugaccaaggacaucccgauguccacggccuacaccaacccgcccagcacccccuccgccccgagcacgccccaggggacgcaccacaccgcccgcggccugcuguccguggcgagcaccaaguccgaggaggucagcaugagcaccucccccgccaagacgagcaccgagaccuccuccccgccgcccgccaccuccgagacgcccacccccagccccaccacccaggugcccacggggaacaacaaccccaacaccucccggcagcccacccccagcgcccagcccgccauguccaaccccgcgaccagcccggcccagcccaaccucucccagagcgcgccgcccaccgccgaccagggcgugcacccgucccccacgaaccgcagcaagcggaaccuggagaucgagaucauccugacccucucccagggccugcgcaaguacuacgggaagauccugaagcuccuggaccugacccucgaggaggacaccgagggccugcuggaguggugcaagcggaaccucgggcugacgugcgacgacaacuucuuccagaagcgcaucgaggaguucuuccugaccggcgagggcuacuucaacgagguccuccaguucaaggugcccagcacccuguccagcaccgagcccacgcacacccggccgcccaccguggagcccuucaaguccuacuucgccaagggguuccugagcaugaacagcggcuacuucuccgcgaagugcuacccccgcaccagcaacuccgggcuccagcugaucaacgucacgaagcacagcgccaagaucgccgacaccccgggccccaagaucaccaaccugaagaccaucaacugcaucaaccuccgggccuccguguucaaggagcaccgcgagguggagaucaacguccugcugccccagguggccgugaaccucagcaacugccacgcgcagaucaagucccacgucugcgacuacagccuggccacggacgggauggugcggcugccccacauccaccacgagggcaccuucaucccgggcaccuacaagaucgugaucgacaagaagaacaagcagaacgaccgcugcacccucgucacgaacugcgugaucaaggggcgggagguccgcaagggccaguccgcccugcggcaguacaagaccgagauccgcaucgggaaggccagcuccggcagccggcgccugcucuccgaggagagcgacggggacugcaucucccgcacccagcugcugcggaccgagacgaccgagauccacagcgacaacuacggcggccccggggacaagaucaccaucugcaacggcuccaccaucguggaccagcgccucgggagcgagcugggcugcuacacgaucaaccgggucaagagcuucaagcugugcgagaacuccgccaccggcaagagcugcgagaucgacuccacccccgucaagugccgccagggcuucugccucaagaucacccaggagggccgggggcacgugaagcugagccgcggcuccgagaucgugcuggacgcgugcgacagcaacugcgagaucaugauccccaaggggacgggcgacauccuggucgacugcuccggcgggcagcagcacuuccucaaggacaaccugaucgaccugggcugcccgaacaucccccuccuggggaagauggccaucuacaucugccggaugagcaaccaccccaagaccaccauggccuuccuguucugguucuccuucggcuacgugaucacgugcauccucugcaaggugaucuucuaccugcugaucgucgccgggacggugggcaagaaguucaagcaguaccgcgagcuccggccccagaccugcaccaucugcgagaccaucccggugaacgcgaucgacgccgagaugcacgaccugaacugcagcuacaacaucugccccuacugcgccucccgccugaccagcgacggccucgcccggcacgucaugcagugccccaagcgcaaggagaagguggaggagacggagcuguaccugaaccucgagcggaucccgugggugguccgcaagcugcuccagguguccgagagcaccgggguggcccucaagcgguccagcuggcugaccguccugcucgugcugcugaucgugucccucagccccguccaguccgcgcccaucggccacgggaagaccaucgagacguaccaggcccgcgagggcuacaccagcuucugccuguucauccuggggagcauccucuucgugguguccugccuggucaagggccugaucgacagcgugggcaacuccuucuuccccgggcucagcaucugcaagaccugcuccaucggcagcaucaacggguucgagaucgagucccacaagugcuacugcagccuguucugcugcccguacugccggcacugccccgccgaccgcgagauccacaagcugcaccucuccaucugcaagaagcggaagaccggcagcaacgugaugcuggccgucugcaagcgcaugugcuuccgcgccacgaucgagguguccaaccgggcgcugcucauccgcaacaucaucaacaccaccuucguggucugcauccugacccuggccgugugcguggucagcacguccgccguggagauggagagccuccccgccgggaccugggagaaggaggaggaccugaccaacuucugccaccaggagugccaggugaccgagacggagugccugugccccuacgaggcccucguccugcggaagccgcuguuccucgacuccaucgugaagggccgcaagaaccugcugaacagcaccucccucgagaccagccuguccaucgaggcgcccuggggcgccaucaacgugcagagcaccuucaagcccacggucagcgccgccaacaucgcgcuguccuggagcuccguggagcaccgggggaacaagauccucgugagcggccgcuccgagagcaucaugaagcuggaggagcggaccgggaucuccugggaccugggcgucgaggacgccagcgaguccaagcuccugaccgugagcgugauggaccugucccagauguacagccccgucuucgaguaccucuccggggaccgccagguggaggaguggccgaaggcgaccugcacgggcgacugccccgagcggugcggcugcaccagcagcacgugccugcacaaggaguggccccacagccgcaacuggcggugcaaccccaccuggugcuggggcgugggcaccgggugcacgugcugcggccuggacgucaaggaccucuucaccgacuacauguucgugaaguggaagguggaguacaucaagaccgaggccaucgucugcguggagcugacgucccaggagcgccagugcagccugaucgaggccggcacccgguucaaccucgggccggucaccaucacccuguccgagccccgcaacauccagcagaagcugccgcccgagaucaucacgcuccacccgcggaucgaggagggcuucuucgaccugaugcacgugcagcgcgugcugagcgcgagcaccgucugcaagcuccaguccugcacccacggggugcccggcgaccuccagguguaccacaucgggaaccugcucaagggcgacaaggucaacggccaccugauccacaagaucgagccccacuucaacaccagcuggauguccugggacgggugcgaccuggacuacuacugcaacaugggcgacuggcccagcugcaccuacacgggggugacccagcacaaccacgccgccuucgugaaccuccugaacaucgagaccgacuacaccaagaacuuccacuuccacuccaagcgggucacggcccacggcgacaccccgcagcuggaccucaaggcccgccccaccuacggggcgggcgaggugaccgugcuggucgagguggccgacauggagcugcacacgaagaagaucgagaucagcggccucaaguucgccucccugaccugcaccgggugcuacgccugcagcuccggcaucagcugcaaggugaagauccacgucgacgagcccgacgagcugaccgugcacgugaaguccgaggaccccgacaucgucgccgcggggagcucccucauggcccggaagcuggaguucggcgccgacagcacguucaaggccuucuccgcgaugccgaagaccagccugugcuucuacaucguggagcgcgaguacugcaaguccugcagccgggaggacacccgcaagugcgugaacaccaagcucgaccgcccccaguccauccugaucgagcacaaggggacgaucaucggcaagcagaacaacacgugcaccgccaaggccagcugcuggcuggagagcgucaaguccuucuucuacggccucaagaacaugcugagcgggaucuucggcaacguguucaucgggaucuuccuguucaucgcccccuucgugcuccugauccuguucuucauguucggcuggcggauccuguucugcuucaagugcugccgccggacccgcggccucuucaaguaccggcaccugaaggacgacgaggagacgggguaccgcaagaucaucgagcggcugaacaacaagaagggcaagaacaagcuccuggacggggagcgccuggccgaccggaagaucgcggagcuguucuccaccaagagccacaucggcuga

SEQ ID NO: 12025 - RNA, 5055 nt, Artificial Sequence
  derived and/or modified CDS sequence (opt1) from CCHFV(8402)__AB069674.1__GP
auguacacgccccugcucugcgccgugcugugccugcagcucuggagccuggagggcucccacgggcugagcaacaagacccagcacuccaacaccagcaccaccaaggccccggaggucucccaggagcucggccugcccgugagcaccguguccacgaucaccagcgacccgcccuccaucaccagcgcggucuccgugagcggguccgagggcagcggggacaccaacacgucccccagcgugaccacccagggccccacccugcccgagacgacccucgagccccugaccaccacggacaccgacgccuccagcaccgucgugguggacgucuccacccagacggugaaggacaccccgaucagcaccaccuacacgagccugcccuccacccccagcgagcccaccaccccgcagggcacgcaccacaccgcccgcgggcuccuguccgugaccagcaccaagcccgaggaggccuccacgcaggccaaccccggcaagaucagcauggagaccaacgggccccggcuggcgaucuccgagaccccgagcuucucccccaccacgcaggcccccaccgagaacagcaaccccaucaccuccaagcagcucaugcugagcgcccagccggucacccccaaccccaugaccucccccgugcagccggcccugagccaguccgacacgagcaccgcgauccaggacgugcaccccucccccaccggccgcagcaagcggaaccucgagauggagaucauccugacccugucccaggggcucaagaaguacuacggcaagauccugaagcugcucgaccugacgcuggaggaggacaccgagggccuccuggaguggugcaagcgcaaccuggggcucgucugcgacgacaacuucuuccagaagcggaucgaggaguucuuccugaccggcaaggggcacuucaacgaggugcugcaguucaagacccccagcacgcucagcccgaccggccccgcccgcaccggcucccccaccguggagccguucaagagcuacuucgccaagggguuccuguccauggacagcggcuacuucuccgccaagugcuacccccgggccagcaacuccgggcugcagcucaucaacgucacgcagcacagcacccgcaucaccgacacccccggccccaagaucacgaaccugaagaccaucaacugcaucaaccugaaggcguccguguucaaggagcaccgggagaucgagaucaacgugcuccugccgcaggucgccgugaaccugagcuccugccacgugcucaucaagagccacgucugcgacuacucccuggacaucgacgggcccgugcgccugccccggauccaccacgagggcaccuucauccccggcaccuacaagaucgucaucgacaagaagaacaagcagaacgaccgcugcacgcucgugaccaacugcgugaucaaggggcgggagauccgcaagggccagagcguccugcggcaguaccgcaccgagaucaagaucgggaaggccuccagcggcucccggcgccugcucagcgaggagagcggggacgacugcaucucccggacccagcugcugcgcacggagaccgccgagauccacaacgacaacuacggcggcccgggggacaagaucaccaucugcaacggcagcaccgugguggaccagcggcugggguccgagcucggcugcuacacgaucaaccgcgucaagagcuucaagcugugcgagaacuccgccaccggcaagagcugcgagaucgacuccacccccgugaagugccgccagggguucugccugaagaucacccaggagggccgggggcacgugaagcucagccgcggcuccgaggucgugcuggacgcgugcgacagcuccugcgagaucaugauccccaaggggacgggcgacauccugguggacugcagcggcgggcagcagcacuuccucaaggacaaccugaucgaccugggcugccccaacaucccgcuccuggggaagauggccaucuacaucugccggauguccaaccaccccaagaccaccauggccuuccuguucugguucagcuucggcuacgucgugaccugcauccucugcaaggugaucuucuaccugcugaucgucguggggacgcucggcaagaaguucaagcaguaccgcgagcugaagccccagaccugcaccaucugcgagaccacccccgugaacgccaucgacgccgagaugcacgaccugaacugcuccuacaacaucugcccguacugcgcgagccggcucacguccgacggccuggcccgccacgucaugcagugccccaagcggaaggagaagaucgaggagaccgagcuguaccucaaccuggagcgcauccccuggguggugcggaagcugcuccaggucagcgaguccaccgggguggcccugaagcgcagcagcuggcuggugguccuccuggugcugcucaccgugucccugagccccguccaguccgccccgaucggccacgggaagacgguggagaccuaccagacccgggagggcuacaccagcaucugccuguucgugcucggguccauccuguucaucgucagcugccugaugaagggccucguggacuccgugggcaacagcuucuuccccgggcuguccaucugcaagacgugcagcaucggcuccgucaacggguucgagaucgagagccacaagugcuacugcucccuguucugcugccccuacugccgccacugcagcgccgaccgggagauccaccgccuccaccuguccaucugcaagaagcggaagaccggcagcaacgugaugcuggcggugugcaagcgcaugugcuuccgggccaccgucgagguguccaacaaggcccuccugauccgcaacaucaucaacaccacguucgugcugugcauccucauccuggccgucugcguggugagcaccuccgcggucgagauggagagccugcccgccgggaccugggagcgggaggaggaccucaccaacuucugccaccaggagugccaggugacggagaccgagugccugugcccguacgaggcccuggugcuccgcaagccccuguucagcgacuccaucgucaagggcaugaagaaccugcucaacagcaccucccuggagaccagccuguccaucgaggcccccuggggcgccaucaacgugcagagcacguucaagccgaccguguccgcggccaacaucgcccucagcugguccagcgucgagcaccgcgggaacaagauccugguguccggccggagcgaguccaucaugaagcuggaggagcgcaccgggaucagcugggaccucggcguggaggacgccuccgagagcaagcugcugaccgucuccgugauggaccucagccagauguacucccccgucuucgaguaccugagcggggaccgccagguggaggaguggcccaaggccacgugcaccggcgacugccccgagcggugcggcugcaccagcuccacgugccugcacaaggaguggccgcacagccggaacuggcgcugcaaccccaccuggugcuggggcguggggaccgggugcacgugcugcggccucgacgucaaggaccuguucaccgacuacauguucaucaaguggaagguggaguacaucaagaccgaggcgaucgugugcgucgagcugaccucccaggagcggcagugcacccucaucgaggccggcacccgcuucaaccuggggcccgugacgaucacccugagcgagccccggaacauccagcagaagcucccgcccgagaucgugacccugcacccccgcaucgaggagggcuucuucgaccugaugcacguccagaaggugcucuccgccagcaccgugugcaagcugcaguccugcacccacgggguccccggcgaccuccagguguaccacaucgggaaccuccugaagggcgacaaggugaacggccaccugauccacaagaucgagccgcacuucaacacgagcuggauguccugggacgggugcgaccucgacuacuacugcaacaugggcgacuggcccagcugcaccuacaccggggucacccagcacaaccacgccgccuucgugaacaugcugaacaucgagacggacuacaccaagaacuuccacuuccacuccaagcgggugaccgcgcacggcgacacgccccagcuggaccucaaggcccgccccaccuacggggccggcgagaucaccguccugguggagguggccgacauggagcugcacaccaagaagaucgagaucagcggccucaaguucgcgucccugaccugcacggggugcuacgccugcagcuccggcaucagcugcaagguccggauccacguggacgagccggacgagcugaccgugcacgucaaguccgaggaccccgacaucguggccgccagcuccagccucauggcccgcaagcuggaguucgggaccgacagcaccuucaaggcguucuccgccaugcccaagacgagccugugcuucuacaucguggagcgggaguacugcaaguccugcagcaaggaggacacccagaagugcgucaacaccaagcucgagcagccccaguccauccugaucgagcacaagggcaccaucaucgggaagcagagcaacacgugcaccgccaaggccuccugcuggcuggagagcgugaaguccuucuucuacggccugaagaacaugcucagcggcaucuucgggaacguguucaucggcgucuuccuguucuucgccccguucauccugcucauccuguucuucauguucggguggcgcauccuguucugcuucaagugcugccggcgcacccggggccucuucaaguaccgccaccugaaggacgacgaggagaccggcuaccggaagaucaucgagcgccugaacaacaagaaggggaagaacaagcuccuggacggcgagcgccuggcggaccggaagaucgccgagcuguucuccacgaagacccacaucggguga

SEQ ID NO: 12026 - RNA, 5055 nt, Artificial Sequence
  derived and/or modified CDS sequence (opt1) from CCHFV(SPU 383/87)__KJ682806.1__GP
auguacacgccccugcucugcgccauccugugccugcagcucuggagccuggagggcaucuacgggcuguccaaccgcacccagcacaacgacaccagcaccaucaaggugccggaggagucccagaagaccagccuccccgccaacaccgcgucccccaucacgagcgacccgcccuccaccaccagcaccgccuccgccagcggccccgagggguccggcgacacgagcaccuccccgcccgucaccacccaggggcccacgccgcccgagaccacccccgagccccacaccacgaucgacaucgacaagagcuccaccgccaucgccgacaucagcacccagaccgugaaggacauccccacgcccaccacccacaccucccugcccagcacgcuguccgcgccgaccaucccccaggaggcccaccacaccgcccggggccuccugagcaucaccagcacgaagcccggcgaggccuccacccccaucagcccgggggaggcguccaccgaggccagcagcccccagcccaccaucuccgagacgcccuccccgccgcccaccgcccaggcccccaccgagaucaacagccccaacaccucccgccagcccaugcccagcacgcagccggccgcgcccaacuccgugacccaccccgcccagcccaccccgagccaguccgacguccccaccgccgcccaggacauccaccccaaccccaucaaccggagcaagcgcaaccuggagauggagaucauccucacccugucccagggccugaagaaguacuacgggaaggugcucaagcugcuggaccucacgcuggaggaggacaccgagggccugcucgagagcugcaagcggaaccuggggcugaccugcgacgacaacuucuuccagaagcgcaucgaggaguucuuccucaccggcgagggccacuucaacgaggugcugcaguucaagacgccguccacccugagccccaccgagcccgcccgggucgagucccccaccguggagccguucaagagcuacuucgcgaagggguuccucagcauggacuccggcuacuucagcgccaagugcuacuccaagagcuccaacagcgggcugcagcugaucaacgugacgcagcaccucauccgcaucaccgacacccccggccccaagaucaccaaccugaagacgaucaacugcaucaaccugaaggcccucgucuucaaggagcaccgggagaucgagaucaacgugcugcugccccagguggccgucaaccucuccaacugccacgugcugaucaagagccacgugugcgacuacucccuggacaucgacggcccgguccgccucccccggauccaccacgaggggaccuucauccccggcaccuacaagaucgugaucgacaagaacaacaagcagaacgaccgcugcacccuggugacgaacugcgucaucaaggggcgggagauccgcaagggccagagcgugcugcggcaguaccgcaccgagaucaagaucgggaaggccuccagcggcucccggcgccuccugagcgaggaguccaacgacgacugccugagccggacccagcuccugcgcaccgagaacgcggagauccacuccgacaacuacggcgggcccggcgacaagaucacgaucugcaacgggagcaccaucguggaccagcggcugggcagcgagcucgggugcuacaccaucaaccgcgucaaguccuucaagcugugcgagaacagcgccaccggcaaguccugcgagaucgacagcacgccggugcgcugccggcagggcuucugccugaagaucacccaggaggggcgcggccacgugaagcugucccgggggagcgaggucgugcucgacgccugcgacuccagcugcgagaucaugauccccaagggcaccggggacauccuggucgacugcuccggcggccagcagcacuuccugaaggacaaccucguggaccuggggugccccaacaucccccugcucggcaagauggccaucuacaucugccgcaugagcaaccacccgaagaccacgauggccuuccuguucugguucuccuucggguacgugaucacgugcauccugugcaaggucaucuucuaccuccuggugguggucggcacccugggcaagaaguucaagcaguaccgggagcucaagccccagaccugcaccaucugcgagaccaaccccgugaacgcgaucgacgccgagaugcacgaccugaacugcagcuacaacaucugcccguacugcgccucccgccugaccagcgacgggcucgcccggcacgugauccagugccccaagcgcaaggagaagaucgaggagaccgagcuguaccugaaccucgagcggauccccugggucgugcgcaagcugcuccagguguccgagagcacgggcgucgcgcucaagcgguccagcuggcuggugauccugcucgugcugcugaccgucucccucagccccgugcagagcgccccgaucucccacggggagaccguggaggucuaccagacccgcgagggcuacaccagcaucugccuguucgugcugggguccauccucuuccuggugagcugccugaugaagggccucgucgacuccgugggcaacagcuucuuccccgggcuguccaucugcaagacgugcagcaucggcuccaucaacggguucgagaucgagagccacaagugcuacugcucccuguucugcugccccuacugccggcacugcagcgccgacaucgagauccaccgccuccaccuguccaucugcaagaagcggaagaccggcagcaacgugaugcuggccgucugcaagcgcaugugcuuccgggccaccguggagguguccaacaaggcgcuccugauccgcaacaucaucaacaccacguucgucgugugcauccugauccucgccgugugcgucgugagcaccuccgccguggagauggagaaccugcccgccgggaccugggagaaggaggaggaccugaccaacuucugccaccaggagugccaggucacggagaccgagugccucugcccguacgaggcccuggugcugcggaagccccucuuccuggacagcaucgugaagggcaugaagaaccugcucaacuccaccagccuggagaccagccuguccaucgaggcgcccuggggcgccaucaacguccagagcacguucaagcccaccguguccgccgccaacaucgcccucagcugguccagcguggagcaccgcgggaacaagauccuggucuccggccgcagcgaguccaucaugaagcuggaggagcggaccgggaucagcugggaccucggcguggaggacgcguccgagagcaagcugcugaccguguccgucauggaccucagccagauguacuccccgguguucgaguaccugagcggggaccgccagguggaggaguggcccaaggccacgugcaccggcgacugccccgagcggugcggcugcaccuccuccacgugccugcacaaggaguggccccacagccgcaacuggcggugcaacccgaccuggugcuggggcgucgggaccgggugcacgugcugcggccucgacgugaaggaccuguucaccgacuacauguucgugaaguggaaggucgacuacaucaagaccgaggccaucgugugcguggagcugaccagccaggagcgccagugcagccucaucgaggccgggacccgguucaaccugggccccgucaccaucacgcuguccgagccccgcaacauccagcagaagcugcccccggagaucgugacccuccacccccggaucgaggagggcuucuucgaccugaugcacauccagaagguccucagcgcguccaccgugugcaagcugcagagcugcacccacggggugcccggcgaccugcagaucuaccacaucgggaaccuccugaagggcgacaaggucaacggccaccugauccacaagaucgagccccacuucaacacguccuggaugagcugggacgggugcgaccucgacuacuacugcaacaugggcgacuggccguccugcagcuacaccggggugacccagcacaaccacgccgccuucgugaacaugcugaacaucgagaccgacuacacgaagaacuuccacuuccacuccaagcgcgucaccgcccacggcgacacgccccagcuggaccucaaggcccggcccaccuacggggcgggcgagaucaccgugcugguggaggucgccgacauggagcugcacaccaagaagaucgagaucagcggccucaaguucgccucccugaccugcaccgggugcuacgccugcagcuccggcaucagcugcaaggugcgcauccacguggacgagcccgacgagcugaccguccacgugaaguccgaggacccggacaucguggccgcgagcuccagccucauggcccggaagcuggaguucgggacggacuccaccuucaaggccuucagcgccaugcccaagaccagccugugcuucuacaucgucgagcgcgaguacugcaaguccugcagcaaggaggacacccagaagugcgugaacacgaagcucgagcagccccaguccauccugaucgagcacaagggcaccaucuucgggaagcagaacgacacgugcaccgccaaggcgagcugcuggcuggaguccgucaagagcuucuucuacggccucaagaacaugcuguccggcaucuucgggaacguguucaucggcguguuccuguuccuggccccguucaucaugcucauccuguucuucauguucggguggcggauccuguucugcuucaagugcugccgccggacccgcggccucuucaaguaccggcaccugaaggacgacgaggagaucggguaccgcaagaucaucgagcggcugaacaacaagaagggcaagaacaagcuccuggacggcgagcgccuggccgaccgcaagaucgccgagcuguucagcaccaagacccacaucggguga

SEQ ID NO: 12027 - RNA, 5055 nt, Artificial Sequence
  derived and/or modified CDS sequence (opt1) from CCHFV(SPU 497/88)__KJ682808.1__GP
auguacaccccccugcucugcgccauccugugccugcagcucuggagccuggagggcaucuacgggcuguccaacaagacccagcacaacgacacgagcaccaucaaggugccggaggagucccagaagaccagccuccccgccaacaucgcgucccccaccacgagcgaccccccguccgccaccagcaccgccuccgccagcggccccgagggguccggcgacaccagcacgucccccagcgucaccacccaggggcccaccccgcuggagaucacgcccgagccccacaccaccaucgacaucgacaaguccagcaccuccaucgccgacaucagcacgcgcaccgugaaggacauccccaccccgaccacgcacaccucccugcccagcacccccagcgcgcccaccaucccgcaggaggugcaccacacggcccggggccuccuguccgucaccagcaccaagcccgaggaggccuccacccugacgagccccggcgaggccuccaccgaggcgagcuccccccagccgaccaucagcgagacccccuccccccccccgacgacccaggcccccaccgagaucaacaaccccaacaccagccgccagcccaugccguccacgcagcccgccgcccccaacagcgugaccccgcccgugcagcccaccuucucccagagcgacgucuccaccgccgcgcaggacauccaccccagcccgaccaaccgguccaagcgcaaccucgagauggagaucauccugacgcugagccaggggcucaagaaguacuacggcaaggugcugaagcugcucgaccugacccuggaggaggacaccgaggggcuccuggaguggugcaagcggaaccugggccucaccugcgacgacaacuucuuccagaagcgcaucgaggaguucuuccugacgggggagggccacuucaacgaggugcugcaguucaagacccccuccacccucagccccaccgagcccgcccgggucgagagcccgacgguggagcccuucaaguccuacuucgccaagggcuuccugagcauggacuccggguacuucagcgccaagugcuaccccaaguccagcaacuccggccugcagcucaucaacgugacccagcaccugauccgcaucaccgacacccccgggccgaagaucacgaaccugaagaccaucaacugcaucaaccucaaggcccuggucuucaaggagcaccgggagaucgagaucaacgugcugcucccccagguggcggucaaccugagcaacugccacgugcugaucaagucccacgugugcgacuacagccucgacaucgacggccccguccgccugccccggauccaccacgagggcaccuucaucccggggaccuacaagaucgugaucgacaagaagacgaagcagaacgaccgcugcacccuggugaccaacugcgucaucaagggccgggagauccgcaaggggcaguccgugcuccggcaguaccgcaccgagaucaagaucggcaaggccagcuccgggagccggcgccugcuguccgaggagagcaacgacgacugccucucccggacgcagcugcugcgcaccgagaacgccgagauccacagcgacaacuacggcggccccggggacaagaucaccaucugcaacggcagcaccaucguggaccagcggcucggguccgagcugggcugcuacacgaucaaccgcgucaagagcuucaagcugugcgagaacuccgccaccgggaagagcugcgagaucgacuccacccccgugcgcugccggcagggcuucugccugaagaucacccaggagggcaaggggcacgucaagcucagccgcggcuccgagguggugcuggacgccugcgacagcuccugcgagaucaugauccccaaggggacgggcgacauccuggucgacugcagcgggggccagcagcacuuccucaaggacaaccugguggaccugggcugcccgaacaucccccuccuggggaagauggcgaucuacaucugccggauguccaaccaccccaagaccaccaugguguuccuguucugguucagcuucggcuacgucaucaccugcauccucugcaaggugaucuucuaccugcugaucguggucgggacgcucggcaagaaguucaagcaguaccgcgagcugaagccccagaccugcaccaucugcgagaccaacccggugaacgccaucgacgccgagaugcacgaccugaacugcuccuacaacaucugccccuacugcgccagccggcucacguccgacggccuggcccgccacgugaugcagugccccaagcggaaggagaagaucgaggagaccgagcuguaccucaaccuggagcgcaucccgugggucgugcggaagcugcuccaggugagcgaguccaccggggucgcgcugaagcgcagcuccuggcuggugauccuccuggugcugcucaccgucagccugagccccgugcaguccgcccccaucagccacggcgagaccguggaggucuaccagacgcgggagggguacaccuccaucugccuguucgugcucggcgggauccuguuccuggugagcugccucaugaagggccuggucgacuccgugggcaacagcuucuuccccgggcuguccaucugcaagaccugcagcaucggcuccaucaacggguucgagaucgagagccacaagugcuacugcucccucuucugcugcccguacugccgccacugcagcgccgacaucgagauccacaagcugcaccuguccaucugcaagaagcggaagaccuggagcaacgugaugcucgccgucugcaagcgcaugugcuuccgggcgacgguggagguguccaacaaggcccugcugauccgcaacaucaucaacaccaccuucgucgugugcauccucauccuggccaucugcguggucagcaccuccgccguggagauggagaaccugcccgccggcacgugggagaaggaggaggaccucaccaacuucugccaccaggagugccaggugaccgagaccgagugccugugccccuacgaggcgcugguccuccggaagccccuguuccuggacagcaucgugaaggggaugcgcaaccuccugaacuccacgagccuggagaccagccucuccaucgaggccccguggggcgccaucaacgugcagagcaccuucaagcccaccgucuccgccgccaacaucgcgcugagcugguccagcguggagcaccggggcaacaagauccugguguccgggcgcagcgaguccaucaugaagcucgaggagcgcacgggcaucagcugggaccugggggucgaggacgccuccgagagcaagcugcucaccguguccgugauggaccugagccagauguacucccccgucuucgaguaccugagcggcgaccggcagguggaggaguggcccaaggccaccugcaccggggacugcccggagcgcugcggcugcacguccagcaccugccuccacaaggaguggccccacucccggaacuggcgcugcaaccccaccuggugcuggggcguggggaccggcugcacgugcugcgggcuggacgucaaggaccuguucaccgacuacauguucgugaaguggaagguggacuacaucaagaccgaggccaucgucugcguggagcucaccagccaggagcggcagugcagccugaucgaggccggcacgcgcuucaaccuggggcccgucaccaucacccucuccgagccgcggaacauccagcagaagcugccccccgagaucgugacccugcacccccgcaucgaggagggcuucuucgaccucaugcacauccagaaggugcugagcgcguccacggucugcaagcugcagagcugcacccacggcgugccgggggaccuccagaucuaccacaucggcaaccugcugaagggggacaaggugaacggccaccucauccacaagaucgagccccacuucaacaccuccuggaugagcugggacggcugcgaccuggacuacuacugcaacaugggggacuggcccuccugcagcuacaccggcgucacgcagcacaaccacgccgccuucgugaacaugcugaacaucgagaccgacuacaccaagaacuuccacuuccacuccaagcgggugaccgcccacggggacaccccccagcucgaccugaaggcgcgcccgacguacggcgccggggagaucaccguccugguggagguggccgacauggagcuccacaccaagaagaucgagaucagcggccugaaguucgccucccugaccugcacgggcugcuacgccugcagcuccgggaucagcugcaagguccggauccacguggacgagcccgacgagcucaccgugcacgucaaguccgaggaccccgacaucguggcggccagcuccagccugauggcccgcaagcuggaguucggcaccgacuccaccuucaaggccuucagcgccaugcccaagacgagccucugcuucuacaucguggagcgggaguacugcaaguccugcagcaaggaggacacccagaagugcgucaacaccaagcuggagcagccgcaguccauccugaucgagcacaaggggaccaucaucggcaagcagaacgacacgugcaccgcgcgcgccagcugcuggcucgaguccaucaagagcuucuucuacgggcugaagaacaugcuguccggcaucuucggcaacguguucaucgggaucuuccuguucuucgcccccuucaucaugcucauccuguucuucauguucggcuggcggauccuguucugcuucaagugcugccgccggacccgcgggcucuucaaguaccggcaccugaaggacgacgaggaggugggcuaccgcaagaucaucgagcggcugaacaacaagaaggggaagaacaagcuccuggacggcgagcgccuggccgaccgcaagaucgccgagcucuucagcaccaagacgcacaucggcuga

SEQ ID NO: 12028 - RNA, 5055 nt, Artificial Sequence
  derived and/or modified CDS sequence (opt1) from CCHFV(88166)__AB069675.1__GP
auguacacgccccugcucugcgccgugcugugccugcagcucuggagccuggagggcucccacgggcugagcaacaagacccagcacuccaacaccagcaccaccaaggccccggaggucucccaggagcucggccugcccgugagcaccguguccacgaucaccagcgacccgcccuccaucaccagcgcggucuccgugagcggguccgagggcagcggggacaccaacacguccccgagcgugaccacccagggccccacccugcccgagacgacccucgagccccugaccaccacggacaccgacgccuccagcaccgucgugguggacgucuccacccagacggugaaggacaccccgaucagcaccaccuacacgagccugcccuccacccccagcgagcccaccaccccgcagggcacgcaccacaccgcccgcgggcuccuguccgugaccagcaccaagcccgaggaggccuccacgcaggccaaccccggcaagaucagcauggagaccaacagcccccggcuggcgaucagcgagaccccguccuucagccccaccacgcaggcccccaccgagaacuccaaccccaucaccagcaagcagcucaugcuguccgcccagccggucacccccaaccccaugaccagccccgugcagccggcccugucccagagcgacacguccaccgcgauccaggacauccaccccagccccaccgggcgcuccaagcggaaccucgagauggagaucauccugacccugagccagggccucaagaaguacuacgggaagauccugaagcugcucgaccugacgcuggaggaggacaccgagggccuccuggaguggugcaagcgcaaccugggccucgugugcgacgacaacuucuuccagaagcggaucgaggaguucuuccugaccgggaagggccacuucaacgagguccugcaguucaagacccccagcacgcucuccccgaccgggcccgcccgcaccggcagccccaccguggagccguucaaguccuacuucgccaagggcuuccugagcauggacuccggguacuucagcgccaagugcuacccccgggccuccaacagcggccugcagcucaucaacgugacgcagcacuccacccgcaucaccgacacccccgggcccaagaucacgaaccugaagaccaucaacugcaucaaccugaaggcgagcgucuucaaggagcaccgggagaucgagaucaacgugcuccugccccagguggccgucaaccuguccagcugccacgugcucaucaagucccacgugugcgacuacagccuggacaucgacggccccguccgccugccccggauccaccacgaggggaccuucauccccggcaccuacaagaucgugaucgacaagaagaacaagcagaacgaccgcugcacgcucgucaccaacugcgugaucaagggccgggagauccgcaaggggcaguccgugcugcggcaguaccgcaccgagaucaagaucggcaaggccagcuccgggagccggcgccugcucagcgaggaguccggcgacgacugcaucagccggacccagcugcugcgcacggagaccgccgagauccacuccgacaacuacgggggcccgggcgacaagaucaccaucugcaacgggagcaccgucguggaccagcggcugggcuccgagcucgggugcuacacgaucaaccgcgugaaguccuucaagcugugcgagaacuccgccaccggcaagagcugcgagaucgacuccacccccgucaagugccgccagggguucugccugaagaucacccaggagggccggggccacgugaagcucagccgcggguccgaggugguccuggacgcgugcgacagcuccugcgagaucaugauccccaagggcacgggggacauccugguggacugcagcggcggccagcagcacuuccucaaggacaaccugaucgaccuggggugccccaacaucccgcuccugggcaagauggccaucuacaucugccggauguccaaccaccccaagaccaccaugggguuccuguucugguucagcuucggcuacguggugaccugcauccucugcaaggugaucuucuaccugcugaucguggucgggacgcucggcaagaaguucaagcaguaccgcgagcugaagccccagaccugcaccaucugcgagaccacccccgugaacgccaucgacgccgagaugcacgaccugaacugcuccuacaacaucugcccguacugcgccagccggcucacguccgacggccuggcgcgccacgugaugcagugccccaagcggaaggagaagaucgaggagaccgagcuguaccucaaccuggagcgcauccccugggucgugcggaagcugcuccaggugagcgagagcaccggggucgcccugaagcgcuccagcuggcugguggugcuccugguccugcucaccgugucccugagccccgugcaguccgccccgaucggccacgggaagacggucgagaccuaccagacccgggagggcuacaccagcaucugccuguucgugcucggguccauccuguucaucgugagcugccugaugaagggccucgucgacuccgugggcaacagcuucuuccccgggcuguccaucugcaagacgugcagcaucggcuccgugaacggguucgagaucgagagccacaagugcuacugcucccuguucugcugccccuacugccgccacugcagcgccgaccgggagauccaccgccuccaccuguccaucugcaagaagcggaagaccuggagcaacgucaugcuggccgugugcaagcgcaugugcuuccgggcgaccguggaggucuccaacaaggcccuccugauccgcaacaucaucaacaccacguucgugcugugcauccucauccuggccgugugcgucgugagcaccagcgccguggagauggagucccugcccgcgggcaccugggagcgggaggaggaccucaccaacuucugccaccaggagugccaggucacggagaccgagugccugugcccguacgaggcccuggugcuccgcaagccccuguucagcgacuccaucgugaaggggaugaagaaccugcucaacagcaccucccuggagaccagccuguccaucgaggcccccuggggcgccaucaacguccagagcacguucaagccgaccauguccgccgcgaacaucgcccucagcugguccagcguggagcaccgcggcaacaagauccugguguccgggcggagcgaguccaucaugaagcuggaggagcgcaccggcaucagcuggaaccucggggucgaggacgccuccgagagcaagcugcugaccguguccgugauggaccucagccagauguacagccccgucuucgaguaccuguccggcgaccgccagguggaggaguggcccaaggccacgugcaccggggacugccccgagcggugcggcugcaccagcuccacgugccugcacaaggaguggccgcacagccggaacuggcgcugcaaccccaccuggugcuggggcgucgggaccggcugcacgugcugcgggcucgacgugaaggaccuguucaccgacuacauguucaucaaguggaagguggaguacaucaagaccgaggccaucgucugcguggagcugaccucccaggagcggcagugcacccucaucgaggcgggcacccgcuucaaccugggccccgugacgaucacccugagcgagccccggaacauccagcagaagcucccgcccgagaucgucacccugcacccccgcaucgaggagggguucuucgaccugaugcacgugcagaaggugcucuccgccagcaccgucugcaagcugcaguccugcacccacggcgugcccggggaccuccagguguaccacaucggcaaccugcugaagggggacaaggucaacggccaccugauccacaagaucgagccgcacuucaacacgagcuggauguccugggacggcugcgaccucgacuacuacugcaacaugggggacuggcccagcugcaccuacaccggcgugacccagcacaaccacgccgccuucgugaacaugcugaacaucgagacggacuacaccaagaacuuccacuuccacuccaagcgggucaccgcccacggggacacgccccagcuggaccucaaggcgcgccccaccuacggcgccggggagaucaccgugcugguggaggucgccgacauggagcugcacaccaagaagaucgagaucagcggccucaaguucgccucccugaccugcacgggcugcuacgcgugcagcuccgggaucagcugcaaggugcggauccacguggacgagccggacgagcugaccguccacgugaaguccgaggaccccgaccucguggccgccagcagcucccugauggcccgcaagcuggaguucggcaccgacagcaccuucaaggccuucuccgcgaugcccaagacgagccucugcuucuacaucgucgagcgggaguacugcaaguccugcagcaaggaggacacccagaagugcgugaacaccaagcuggagcagccccaguccauccugaucgagcacaaggggaccaucaucggcaagcagaacaacacgugcaccgccaaggccagcugcuggcuggaguccgucaagagcuucuucuacgggcucaagaacaugcuguccggcaucuucggcaacgucuucaucgggguguuccuguucuucgccccguucauccuccugauccuguucuucauguucggcuggcgcauccucuucugcuucaagugcugccggcgcacccgggggcuguucaaguaccgccaccugaaggacgacgaggagaccggcuaccggaagaucaucgagcgccucaacaacaagaagggcaagaacaagcugcuggacggggagcgccucgccgaccggaagaucgcggagcuguucagcacgaagacccacaucggcuga

SEQ ID NO: 12029 - RNA, 5055 nt, Artificial Sequence
  derived and/or modified CDS sequence (opt1) from CCHFV(strain BA88166)__AF338470.1__GP
auguacacgccccugcucugcgccgugcugugccugcagcucuggagccuggagggcucccacgggcugagcaacaagacccagcacuccaacaccagcaccaccaaggccccggaggucucccaggagcucggccugcccgugagcaccguguccacgaucaccagcgacccgcccuccaucaccagcgcggucuccgugagcggguccgagggcagcggggacaccaacacguccccgagcgugaccacccagggccccacccugcccgagacgacccucgagccccugaccaccacggacaccgacgccuccagcaccgucgugguggacgucuccacccagacggugaaggacaccccgaucagcaccaccuacacgagccugcccuccacccccagcgagcccaccaccccgcagggcacgcaccacaccgcccgcgggcuccuguccgugaccagcaccaagcccgaggaggccuccacgcaggccaaccccggcaagaucagcauggagaccaacagcccccggcuggcgaucuccgagaccccguccuucagccccaccacgcaggcccccaccgagaacuccaaccccaucaccagcaagcagcucaugcuguccgcccagccggucacccccaaccccaugaccagccccgugcagccggcccugucccagagcgacacguccaccgcgauccaggacauccaccccagccccaccgggcgcuccaagcggaaccucgagauggagaucauccugacccugagccagggccucaagaaguacuacgggaagauccugaagcugcucgaccugacgcuggaggaggacaccgagggccuccuggaguggugcaagcgcaaccugggccucgugugcgacgacaacuucuuccagaagcggaucgaggaguucuuccugaccgggaagggccacuucaacgagguccugcaguucaagacccccagcacgcucuccccgaccgggcccgcccgcaccggcagccccaccguggagccguucaaguccuacuucgccaagggcuuccugagcauggacuccggguacuucagcgccaagugcuacccccgggccuccaacagcggccugcagcucaucaacgugacgcagcacuccacccgcaucaccgacacccccgggcccaagaucacgaaccugaagaccaucaacugcaucaaccugaaggcgagcgucuucaaggagcaccgggagaucgagaucaacgugcuccugccccagguggccgucaaccuguccagcugccacgugcucaucaagucccacgugugcgacuacagccuggacaucgacggccccguccgccugccccggauccaccacgaggggaccuucauccccggcaccuacaagaucgugaucgacaagaagaacaagcagaacgaccgcugcacgcucgucaccaacugcgugaucaagggccgggagauccgcaaggggcaguccgugcugcggcaguaccgcaccgagaucaagaucggcaaggccagcuccgggagccggcgccugcucagcgaggaguccggcgacgacugcaucagccggacccagcugcugcgcacggagaccgccgagauccacuccgacaacuacgggggcccgggcgacaagaucaccaucugcaacgggagcaccgucguggaccagcggcugggcuccgagcucgggugcuacacgaucaaccgcgucaagagcuucaagcugugcgagaacuccgccaccggcaagagcugcgagaucgacuccacccccgucaagugccgccagggguucugccugaagaucacccaggagggccggggccacgugaagcucagccgcggguccgaggugguccuggacgcgugcgacagcuccugcgagaucaugauccccaagggcacgggggacauccugguggacugcagcggcggccagcagcacuuccucaaggacaaccugaucgaccuggggugccccaacaucccgcuccugggcaagauggccaucuacaucugccggauguccaaccaccccaagaccaccaugggguuccuguucugguucagcuucggcuacguggugaccugcauccucugcaaggggaucuucuaccugcugaucguggugggcacgcucggcaagaaguucaagcaguaccgcgagcugaagccccagaccugcaccaucugcgagaccacccccgucaacgccaucgacgccgagaugcacgaccugaacugcuccuacaacaucugcccguacugcgccagccggcucacguccgacgggcuggcgcgccacgugaugcagugccccaagcggaaggagaagaucgaggagaccgagcuguaccucaaccuggagcgcauccccugggugguccggaagcugcuccaggugagcgagagcaccggcguggcccugaagcgcuccagcuggcuggucgugcuccuggugcugcucaccgucucccugagccccgugcaguccgccccgaucgggcacggcaagacgguggagaccuaccagacccgggagggguacaccagcaucugccuguucguccucggcuccauccuguucaucgugagcugccugaugaagggccucguggacuccgucgggaacagcuucuuccccggccuguccaucugcaagacgugcagcaucggguccgugaacggcuucgagaucgagagccacaagugcuacugcucccuguucugcugccccuacugccgccacugcagcgccgaccgggagauccaccgccuccaccuguccaucugcaagaagcggaagaccuggagcaacgugaugcuggccgucugcaagcgcaugugcuuccgggcgaccguggagguguccaacaaggcccuccugauccgcaacaucaucaacaccacguucguccugugcauccucauccuggccgugugcguggucagcaccagcgccguggagauggagucccugcccgcggggaccugggagcgggaggaggaccucaccaacuucugccaccaggagugccaggugacggagaccgagugccugugcccguacgaggcccugguccuccgcaagccccuguaccuggacagcaucgugaagggcaugaagaaccuccugaacuccaccagccuggagaccucccucagcaucgaggcccccuggggcgccaucaacgugcaguccacguucaagccgaccaugagcgccgcgaacaucgcccuguccuggagcuccgucgagcaccgcgggaacaagauccuggugagcggccgguccgagagcaucaugaagcucgaggagcgcaccgggaucuccuggaaccugggcguggaggacgccagcgaguccaagcugcucaccgucagcgugauggaccugucccagauguacagccccguguucgaguaccugagcggggaccggcaggucgaggaguggcccaaggccacgugcaccggcgacugccccgagcgcugcggcugcaccuccagcacgugccuccacaaggaguggccgcacucccggaacuggcgcugcaaccccaccuggugcuggggcguggggaccgggugcacgugcugcggccuggacgucaaggaccuguucaccgacuacauguucaucaaguggaagguggaguacaucaagaccgaggccaucgugugcgucgagcucaccagccaggagcggcagugcacccugaucgaggcgggcacccgcuucaaccuggggcccgugaucaucacgcucuccgagccccggaacauccagcagaagcugccgcccgagaucgugacccugcacccccgcaucgaggagggcuucuucgaccucaugcacguccagaaggugcugagcgccuccaccgugugcaagcugcagagcugcacccacgggguccccggcgaccuccagguguaccacaucgggaaccugcugaagggcgacaaggugaacggccaccucauccacaagaucgagccgcacuucaacaccuccuggaugagcugggacgggugcgaccuggacuacuacugcaacaugggcgacuggcccuccugcacguacaccggggucacccagcacaaccacgccgccuucgugaacaugcugaacaucgagaccgacuacacgaagaacuuccacuuccacagcaagcgggugaccgcccacggcgacacgccccagcucgaccugaaggcgcgccccaccuacggggccggcgagaucaccguccugguggagguggccgacauggagcuccacaccaagaagaucgagaucuccggccugaaguucgccagccugaccugcaccgggugcuacgcgugcuccagcggcaucuccugcaagguccggauccacguggacgagccggacgagcucacggugcacgucaagagcgaggaccccgacaucguggccgccuccagcagccugauggcccgcaagcuggaguucgggaccgacuccaccuucaaggccuucagcgcgaugcccaagaccucccucugcuucuacaucguggagcgggaguacugcaagagcugcuccaaggaggacacgcagaagugcgucaacaccaagcuggagcagccccagagcauccugaucgagcacaagggcaccaucaucgggaagcagaacaacacgugcaccgccaaggccuccugcuggcuggagagcgugaaguccuucuucuacggccucaagaacaugcugagcggcaucuucgggaacguguucaucggcgucuuccuguucuucgccccguucauccuccugauccuguucuucauguucggguggcgcauccucuucugcuucaagugcugccggcgcacccggggccuguucaaguaccgccaccugaaggacgacgaggagaccggcuaccggaagaucaucgagcgccucaacaacaagaaggggaagaacaagcugcuggacggcgagcgccucgccgaccggaagaucgcggagcuguucuccaccaagacgcacaucggguga

SEQ ID NO: 12030 - RNA, 5055 nt, Artificial Sequence
  derived and/or modified CDS sequence (opt1) from CCHFV(SPU 130/89)__KJ682807.1__GP
auguacacgccccugcucugcgccauccugugccugcagcucuggagccuggagggcaucuacgggcuguccaacaagacccagcacaacgacaacagcaccaccaaggccccggaggagucccacaagaccagccuccccgcgaacaccgccucccccaucacgagcgacccgcccuccaccaccagcaccacguccgccagcggccccgagggguccggcgacaccagcaccuccccgcccgugaccacgcaggggcccgccagccccgagaccacccccgagccccacaccacgaucgacaucgacaaguccagcaccgccaucgcggacaucuccacccagaccgucaaggacaucccgacgcccaccacccacaccagccugcccuccacgcugagcgcccccaccaucccgcaggaggcccaccacaccgcccgcggccuccugagcgugacccggcacaagcccggcgaggcguccaagcccacgagccccggggaggccuccaccgaggccagcuccagccagccgaccaucuccgagacccccagcccgccgcccacgacccaggcccccaccgagaucaacaaccccaacaccucccgccagcccaugcccagcacgcagcccgccgcgcccuccagcgugacccacccggcccagcccacccccucccagagcgacguccccaccgccgcccaggacauccacccgucccccaccaaccggagcaagcgcaaccuggagauggagaucauccucacgcugucccagggccugaagaaguacuacgggaaggugcucaagcugcuggaccucacccuggaggaggacaccgagggccugcucgaguggugcaagcggaaccuggggcugaccugcgacgacaacuucuuccagaagcgcaucgaggaguucuuccucacgggcgagggccacuucaacgaggugcugcaguucaagacccccagcacccugucccccaccgagccggcccgggucgagagccccacgguggagcccuucaagagcuacuucgcgaagggguuccucuccauggacagcggcuacuucuccgccaagugcuaccccaagagcuccaacagcgggcugcagcugaucaacgugacccagcaccucauccgcaucaccgacaccccgggccccaagaucacgaaccugaagaccaucaacugcaucaaccugaaggcccucgucuucaaggagcaccgggagaucgagaucaacgugcugcugccccagguggccgucaaccucuccaacugccacgugcugaucaagagccacgugugcgacuacucccuggacaucgacggccccguccgccucccgagcauccaccacgaggggaccuucauccccggcaccuacaagaucgugaucgacaagaagaacaagcagaacgaccggugcacgcuggugaccaacugcgucaucaaggggcgcgagauccggaagggccaguccgugcugcgccaguaccggaccgagaucaagaucgggaaggccagcuccggcagccgccggcuccuguccgaggagcccaacuacgacugccugagccgcacccagcuccugcggacggagaacgcggagauccacuccgacaacuacggcgggcccggcgacaagaucaccaucugcaacgggagcaccaucguggaccagcgccugggcagcgagcucgggugcuacaccaucaaccgggucaaguccuucaagcugugcgagaacagcgccacgggcaaguccugcgagaucgacagcaccccggugcgcugccgccagggcuucugccugaagaucacccaggaggggcggggccacgugaagcugucccgcgggagcgaggucgugcucgacgccugcgacuccagcugcgagaucaugauccccaagggcaccggggacauccuggucgacugcuccggcggccagcagcacuuccugaaggacaaccucguggaccuggggugccccaacaucccccugcucggcaagauggccaucuacaucugccggaugagcaaccacccgaagacgaccauggccuuccuguucugguucuccuucggguacgugaucacgugcauccugugcaaggucaucuucuaccuccugaucguggugggcacccugggcaagaaguucaagcaguaccgcgagcucaagccccagaccugcaccaucugcgagaccaaccccgucaacgcgaucgacgccgagaugcacgaccugaacugcagcuacaacaucugcccguacugcgccucccggcugaccagcgacgggcucgcccgccacgugaugcagugccccaagcggaaggagaagaucgaggagacggagcuguaccugaaccucgagcgcauccccugggugguccggaagcugcuccagguguccgagagcaccggcguggcgcugaagcgcuccagcuggcuggucgugcugcucgugcugcugaccgucucccucagccccgugcagagcgccccgaucucccacggggagaccguggaggucuaccagacccgggagggcuacacgagcaucugccuguucgugcugggguccauccucuuccuggugagcugccugaugaagggccucgucgacuccgugggcaacagcuucuuccccgggcuguccaucugcaagaccugcagcaucggcuccaucaacggguucgagaucgagagccacaagugcuacugcucccuguucugcugccccuacugccgccacugcagcgccgacaucgagauccacaagcuccaccuguccaucugcaagaagcggaagaccggcagcaacgugaugcuggccgucugcaagcgcaugugcuuccgggccaccguggagguguccaacaaggcgcuccugauccgcaacaucaucaacacgaccuucgucgugugcauccugauccucgccgugugcgucgugagcaccuccgccguggagauggagaaccugcccgccgggaccugggagaaggaggaggaccugacgaacuucugccaccaggagugccaggucaccgagaccgagugccucugcccguacgaggcccuggugcugcggaagccccucagccuggacuccaucgugaagggcaugaagaaccugcucaacagcaccagccuggagacgucccugagcaucgaggcgcccuggggcgccaucaacguccaguccaccuucaagcccaccgugagcgccgccaacaucgcccucuccuggagcuccguggagcaccgcgggaacaagauccuggucagcggccgguccgagagcaucaugaagcuggaggagcgcaccgggaucuccugggaccucggcguggaggacgcgagcgaguccaagcugcugacggugagcgucauggaccucucccagauguacagcccgguguucgaguaccuguccggggaccgccagguggaggaguggcccaaggcgaccugcaccggcgacugccccgagcggugcggcugcaccagcuccacgugccugcacaaggaguggccccacagccgcaacuggcggugcaacccgaccuggugcuggggcgucgggaccgggugcacgugcugcggccucgacgugaaggaccuguucaccgacuacauguucgugaaguggaaggucgacuacaucaagaccgaggccaucgugugcguggagcugaccagccaggagcgccagugcucccucaucgaggccgggacccgguucaaccugggccccgucacgaucacccugagcgagccccgcaacauccagcagaagcugcccccggagaucgugacccuccacccccggaucgaggagggcuucuucgaccugaugcacauccagaagguccucuccgccagcaccgugugcaagcugcaguccugcacgcacggggugcccggcgaccugcagaucuaccacaucgggaaccuccugaagggcgacaaggucaacggccaccugauccacaagaucgagccccacuucaacaccagcuggauguccugggacgggugcgaccucgacuacuacugcaacaugggcgacuggccgagcugcuccuacaccggggugacccagcacaaccacgccgccuucgugaacaugcugaacaucgagacggacuacaccaagaacuuccacuuccacagcaagcgcgucaccgcccacggcgacacgccccagcuggaccucaaggcccggcccaccuacggggcgggcgagaucaccgugcugguggaggucgccgacauggagcugcacaccaagaagguggagaucuccggccucaaguucgccagccugaccugcaccgggugcuacgccugcuccagcggcaucuccugcaaggugcgcauccacgucgacgagcccgacgagcugacggugcacgucaagagcgaggacccggacaucguggccgcguccagcucccucauggcccggaagcuggaguucgggaccgacagcaccuucaaggccuucagcgccaugcccaagaccucccugugcuucuacaucguggagcgcgagcacugcaagagcugcuccaaggaggacacgcagcggugcgugaacaccaagcucgagcagccccagagcauccugaucgagcacaagggcaccaucaucgggaagcagaacgacacgugcaccgccaaggcguccugcuggcuggagagcaucaaguccuucuucuacggccucaagaacaugcugagcggcaucuucgggaacgucuucaucggcguguuccuguuccuggccccguucaucauccucauccuguucuucauguucggguggcgcauccuguucugcuucaagugcugccggcgcacccggggccuccugaaguaccgccaccugaaggacgacgaggagaucggguaccggaagaucaucgagcgccucaacaacaagaagggcaagaacaagcugcuggacggcgagcggcucgccgaccgcaagaucgccgagcuguucuccaccaagacccacaucggguga

SEQ ID NO: 12031 - RNA, 5052 nt, Artificial Sequence
  derived and/or modified CDS sequence (opt1) from CCHFV(4701-ST-2009)__KR814872.1__GP
augcacacccugcucgugugcuucauccuguaccugcagcucagcggccucgggggcgcccacgggcaguccaacgccaccgagcacaacggcacgaacaccaccaccgcgcccgggacgagccaguccccgaagccgcccgccagcaccacccugccccacacccccgaguccagcacggucaagcucaccacccccaccuccgagacggagggcagcggcgagaccaccccgccgcccaacaccacgcaggggcugccccugaccggcaccacccccgagcgcuccgccacgaccgccaccagcaccuccagcacggacaacaugaacuccaccacccaggugaccgacaacacgcccaccagcaccguguccaucagccccuccagcuccagcagcaugcccuccacgccccaggggacccaccaccccguccggagccuccuguccgugagcuccccgaagaccgugaccacccccacgcccaugagccccggcgagauguccccggagaccagcucccagcacagcgccaugucccgcguccccacccuguacaccgcgacccaggugagcacggagaacaccgaccgguccacgccccgccagagcgaguccagcgugcagcccgccacccaguccccgaucaccagccccgcccagaccauccuccugauguccgccgcgcccaaggccauccaggacaugcaccccagcccgaccaaccggagcaagcgcaaccuggaggucgagaucauccucacccugucccaggggcugaagaaguacuacggcaagauccucaagcugcugcaccucacgcuggaggaggacaccgagggccugcucgaguggugcaagcggaaccuggggagcaacugcgacgacgacuucuuccagaagcgcaucgaggaguucuucaucaccggcgagggguacuucaacgaggugcugcaguucaagacccucuccacgcugagccccaccgagcccucccacgugcggcugccgaccgccgagcccuucaagagcuacuucgccaagggcuuccucuccaucgacagcggcuacuucuccgccaagugcuacccccgcagcuccaccagcgggcugcagcugaucaacgucacgcagcaccccgcgcggaucgccgagaccccgggccccaagaccaccucccucaagacgaucaacugcaucaaccugcgcgccagcguguucaaggagcaccgggagguggagaucaacguccugcucccccagaucgccgugaaccuguccaacugccacguggucaucaacagccacgugugcgacuacucccuggacaccgacgggcccgugcgccucccgcggauccaccacgagggcaccuucauccccgggaccuacaagaucgucaucgaccgcaagaacaagcugaacgaccggugcagccuggugacgaacugcgugaucaagggccgcgagguccggaagggccagagcgugcuccgccaguacaagaccgagaucaagaucgggaaggccuccaccggcagccggaagcugcuguccgaggagcccggggacgacugcaucagccgcacccagcuccugaagacggagaccgcggagauccacgacgacaacuacggcgggcccggcgacaagaucaccaucugcaacggcuccaccgucguggaccagcgccuggggagcgagcucggcugcuacacgaucaaccgggugaaguccuucaagcugugcgagaacagcgccaccgggaagaccugcgagaucgacuccaccccggucaagugccgccagggcuucugccugaagaucacgcaggaggggcggggccacgugaagcugagccgcggcuccgaggugguccucgacgccugcgacagcuccugcgagaucaugauccccaaggggaccggcgacauccugguggacugcagcgggggccagcagcacuuccugaaggacaaccucaucgaccugggcugcccccacaucccccugcucgggaagauggccaucuacaucugccggauguccaaccacccgcgcaccaccauggccuuccuguucugguucagcuucggcuacgugaucacgugcaucuucugcaaggcgcuguucuacucccucaucaucaucgggacccugggcaagaagaucaagcaguaccgggagcugaagccccagaccugcaccaucugcgagaccgcccccgucaacgccaucgacgccgagaugcacgaccucaacugcagcuacaacaucugccccuacugcgccucccgccugacgagcgacgggcuggcgcggcacgugacccagugcccgaagcgcaaggagaagguggaggagaccgagcucuaccugaaccuggagcggauccccuggaucguccgcaagcuccuccaggugagcgaguccaccggcguggcccugaagcggagcuccuggcucaucguccugcuggugcuccugacggugagccugucccccguccagagcgcccccgugggccacgggaagaccaucgagaccuaccagacccgcgagggcuucacguccaucugccucuucaugcuggggagcauccuguucaucguguccugccucgucaagggccugguggacagcguguccgacagcuucuucccggggcuguccgucugcaagaccugcagcaucggcuccaucaacggcuucgagaucgagagccacaagugcuacugcucccucuucugcugccccuacugccggcacugcagcgccgaccgcgagauccaccagcugcaccuguccaucugcaagaagcggaagaccgggagcaacgugaugcucgcggugugcaagcgcaugugcuucaaggccaccaucgaggccagccggcgcgcccugcugauccgcuccaucaucaacacgaccuucgucaugugcauccucacccuggccaucugcguggugagcaccuccgcggucgagauggaggaccugcccgccggcacgugggagcgggaggaggaccucaccaacuucugccaccaggagugccaggugaccgagaccgagugccugugcccguacgaggcccuggugcuccgcaagccccuguuccuggacagcaucgucaaggggaugaagaaccuccugaacuccacgagccuggagaccucccucagcaucgaggcccccuggggcgccaucaacgugcaguccaccuucaagcccaccgugagcacggcgaacaucgcccuguccuggagcuccgucgagcaccgggggaacaagauccuggugaccggccgcagcgaguccaucaugaagcucgaggagcggaccggcgugagcugggaccugggggucgaggacgccuccgagagcaagcugcucaccguguccaucauggaccugagccagauguacagcccgguguucgaguaccuguccggcgaccgccaggucgaggaguggcccaaggccacgugcaccggggacugccccgagcggugcggcugcaccagcagcacgugccuccacaaggaguggccccacucccgcaacuggcggugcaacccgaccuggugcuggggcguggggaccggcugcacgugcugcgggguggacgucaaggaccuguucaccgaccacauguucaucaaguggaagguggaguacaucaagaccgaggccaucgugugcgucgagcugaccucccaggagcgccagugcagccucaucgaggcgggcacccgguucaaccuggggcccgugaccaucacccuguccgagccccgcaacauccagcagaagcugcccccggagaucaucacgcugcaccccaagaucgaggagggcuucuucgaccugaugcacgugcagaagguccucagcgccuccaccgugugcaagcugcagagcugcacccacggcauccccggggaccugcagaucuaccacaucggcaaccuccugaagggggaccgggucaacggccaccugauccacaagaucgagccccacuucaacaccuccuggaugagcugggacgggugcgaccucgacuacuacugcaacaugggcgacuggccguccugcacguacaccggcgugacccagcacaaccacgccgccuucgugaaccugcugaacaucgagaccgacuacacgaagaccuuccacuuccacagcaagcgcgucaccgcgcacggggacacgccccagcucgaccugaaggcccggcccaccuacggcgccggggagaucaccgugcugguggaggucgccgacauggagcuccacaccaagaagguggagaucuccggccugaaguucgccagccugaccugcacggggugcuacgcgugcuccagcggcaucuccugcaaggugcgcauccacgucgacgagcccgacgagcucaccgugcacgucaagagcagcgacccggacgugguggccgccuccaccagccugauggcccggaagcuggaguucggcaccgacuccacguucaaggccuucagcgcgaugcccaagaccucccucugcuucuacaucguggagcgcgaguacugcaagagcugcuccgaggacgacaccaagaagugcgucgacaccaagcuggagcagccccagagcauccugaucgagcacaaggggacgaucaucggcaagcagaacgacacgugcaccgccaaggccuccugcuggcucgagagcgugaaguccuucuucuacgggcugaagaacaugcugggcagcguguucgggggcuucuucgucggcauccuccuguuccuggcccccuucgugcugcucgugcuguucuucauguucggguggaagauccuguucugcuucaagugcugccggcgcacccggggccucuucaaguaccgccaccugaaggacgacgaggagaccggguaccgccggaucaucgagcgccugaacuccaagaagggcaagaaccggcuccuggacggcgagcgccuggccgaccggaagaucgcggagcuguucagcaccaagacccacaucggguga

SEQ ID NO: 12032 - RNA, 5052 nt, Artificial Sequence
  derived and/or modified CDS sequence (opt1) from CCHFV(36-ST-2014)__KR814857.1__GP
augcacacccugcucgugugcuucauccuguaccugcagcucagcggccuggggggcgcccacgggcaguccaacgccaccgagcacaacggcacgaacaccaccaccguccccgggacgagccaguccccgaagccccccgcgagcaccacccugccccacaccccggaguccagcacggugaagcucaccacccccaccuccgagacggagggcagcggcgagaccaccccccccccgaacaccacgcaggggcugcccccccccggcaccaccccggagcgccccgccaccacggccaccuccaugagcuccaccgacaacaugaacagcaccacgcaggugaccgacaacacccccaccuccacggucagcaucucccccagcuccagcccguccaugcccagcaccagccaggggauccacuaccccgugcggucccugcucagcguguccagccccaagaccgucaccacgccgacccccaugucccccggcgagaugagccccgagaccuccagccagcacuccgccaugagccgcaucccgacccuguacacggccacccagguguccaccgagaacaccaaccggagcaccccccgccaguccgagagcuccgcgcagcccgccacgcagagccccaccaccuccccgacccagacgauccugcucaugagcgccgcccccaaggcgauccaggacaugcaccccuccccgaccaaccggagcaagcgcaaccuggagguggagaucauccugacccucagccaggggcugaagaaguacuacggcaagauccugaagcuccugcaccugacccucgaggaggacacggagggccugcuggaguggugcaagcggaaccucggguccaacugcgacgacgacuucuuccagaagcgcaucgaggaguucuucaucaccggcgagggguacuucaacgagguccugcaguucaagacccugagcacccucucccccacggagcccagccacgugcggcugcccaccgccgagccguucaaguccuacuucgccaagggcuuccugagcaucgacuccggcuacuucagcgccaagugcuacccccgcuccagcaccuccgggcuccagcugaucaacgugacccagcaccccgcccggaucgcggagacgcccggcccgaagaccaccagccugaagaccaucaacugcaucaaccuccgcgccuccgucuucaaggagcaccgggagguggagaucaacgugcugcugccccagaucgccgucaaccucagcaacugccacguggugaucaacucccacgucugcgacuacagccuggacacggacgggcccgugcgccugccccggauccaccacgagggcaccuucaucccggggaccuacaagaucgugaucgacaagaagaacaagcucaacgaccgcugcucccuggucaccaacugcgugaucaagggccgggaggugcgcaagggccagagcguccugcggcaguacaagacggagaucaagaucgggaaggccagcaccggcucccgcaagcuccugagcgaggagcccggggacgacugcaucucccggacccagcugcucaagaccgagacggccgagauccacgacgacaacuacggcgggcccggcgacaagaucaccaucugcaacggcagcaccaucguggaccagcgccugggguccgagcugggcugcuacaccaucaaccgcgucaagagcuucaagcucugcgagaacuccgcgacggggaagaccugcgagaucgacagcacccccgugaagugccggcagggcuucugccugaagaucacccaggaggggcgcggccacgugaagcugucccggggcagcgaggucgugcuggacgccugcgacuccagcugcgagaucaugaucccgaaggggacgggcgacauccucguggacugcuccgggggccagcagcacuuccugaaggacaaccugaucgaccucggcugcccccacaucccccugcuggggaagauggccaucuacaucugccgcaugagcaaccacccccggaccaccauggccuuccucuucugguucuccuucggcuacgucaucaccugcaucuucugcaaggcccuguucuacagccugaucaucaucgggacccucggcaagaagaucaagcaguaccgcgagcugaagccgcagacgugcaccaucugcgagaccgcgcccgugaacgccaucgacgccgagaugcacgaccugaacugcuccuacaacaucugccccuacugcgccagccggcucaccuccgacgggcuggcccgccacgugacgcagugccccaagcggaaggagaaggucgaggagaccgagcuguaccucaaccuggagcgcaucccguggaucgugcggaagcugcuccaggugagcgagagcaccggcgucgcgcugaagcgcuccagcuggcugaucgugcuccuggugcugcucaccgucucccugagccccgugcaguccgcccccgugggccacgggaagacgaucgagaccuaccagacccgggagggcuucaccaacaucugccuguucaugcucgggagcauccuguucaucgucuccugccuggugaagggccucguggacagcgucuccgacagcuucuucccggggcuguccgugugcaagacgugcagcaucggcuccaucaacggcuucgagaucgagagccacaagugcuacugcucccuguucugcugccccuacugccgccacugcagcgccgaccgggagauccaccagcuccaccuggggaucugcaagaagcgcaagaccggcuccaacgugaugcuggccgucugcaagcggaugugcuucaaggcgaccaucgaggccagccgccgggcccuccugauccgcuccaucaucaacaccacguucgugaucugcauccugacccucgccaucugcguggucagcaccagcgccguggagauggagaaccugcccgcggggaccugggagcgcgaggaggaccugacgaacuucugccaccaggagugccagguguccgagaccgagugccucugccccuacgaggcccugguccugcggaagccgcucuuccuggacagcaucgugaagggcaugaagaaccugcucaacuccaccagccuggagaccucccugagcaucgaggcccccuggggggccaucaacgugcaguccacguucaagcccaccgucagcaccgccaacaucgcgcucuccuggagcuccguggagcaccgcggcaacaagauccuggugaccggccggagcgaguccaucaugaagcuggaggagcgcacgggggucagcugggaccucggcguggaggacgccuccgagagcaagcugcugaccguguccaucauggaccucagccagauguacucccccgucuucgaguaccugagcggggaccggcagguggaggaguggccgaaggccaccugcaccggcgacugccccgagcgcugcgggugcacgagcuccaccugccugcacaaggaguggccccacagccggaacuggcgcugcaaccccaccuggugcuggggcgugggcaccgggugcacgugcugcggcgucgacgugaaggaccucuucaccgaccacauguucaucaaguggaagguggaguacaucaagaccgaggccaucgucugcguggagcugaccucccaggagcggcagugcagccugaucgaggccgggacccgcuucaaccucggcccggugacgaucacccuguccgagccccggaacauccagcagaagcugccccccgagaucaucacccuccacccgaagaucgaggagggcuucuucgaccugaugcacguccagaaggugcugagcgcguccaccgugugcaagcuccagagcugcacgcacgggauccccggcgaccugcagaucuaccacaucgggaaccugcucaagggcgaccgccugaacgggcaccugauccacaagaucgagccccacuucaacaccuccuggaugagcugggacggcugcgaccucgacuacuacugcaacaugggcgacuggcccuccugcaccuacaccggggucacgcagcacaaccacgccgccuucgugaaccugcugaacaucgagaccgacuacaccaagaccuuccacuuccacagcaagcgggucacggcccacggcgacaccccgcagcucgaccugaaggcgcgccccaccuacggggccggcgagaucaccgugcugguggaggucgccgacauggagcuccacacgaagaagguggagaucuccgggcugaaguucgccagccuggccugcaccggcugcuacgcgugcuccagcggcaucuccugcaaggugcggauccacgucgacgagcccgacgagcucaccgugcacgugaagagcuccgaccccgacgucguggccgccagcaccagccugauggcccgcaagcuggaguucgggacggacuccaccuucaaggccuucagcgcgaugccgaagaccucccucugcuucuacaucguggagcgggaguacugcaagagcugcuccgaggacgacaccaagaagugcgucgacacgaagcuggaccagccccagagcauccugaucgagcacaagggcaccaucaucgggaagcagaacgacaccugcaccgccaaggccuccugcuggcucgagagcgugaaguccuucuucuacggccugaagaacaugcuggggagcguguucggcaacuucuucgucggcauccuccuguuccuggcccccuucgugcugcucgugcuguucuucaugugcggguggaaguuccuguucugcuucaagugcugccgccggacgcgcggccucuucaaguaccggcaccugaaggacgacgaggagaccggguaccgccgcaucaucgagcggcugaacuccaagaagggcaagaaccgccuccuggacggcgagcggcuggccgaccgcaagaucgcggagcucuucagcaccaagucccacaucggguga

SEQ ID NO: 12033 - RNA, 5055 nt, Artificial Sequence
  derived and/or modified CDS sequence (opt1) from CCHFV(Matin)__AF467769.2__GP
auguacacccugcugcugugcgccauccugugcagccagcucugguccagcgaggggauccacgggcuguccaacgagacccagcacggcaacgccagcaccaucaaggcccccgaggugucccaggggcugggccuccccgucagcaccgcgccgcccaucaccuccgacccgcccagcaucaccuccgccgccagcguguccgggcccgagggcagcggcgacaccaacaccagcccgcccgugaccacccaggggcugacccugcccgagaccacccucgagcugcugaccaccaccaacaccggcgccagcuccaccgucaucguggacgugagcacccagaccgucaaggacacccccguguccaccgcccacaccagcccgcccgggacccccuccgcccccaccacgccccagggcacgcaccacaccgcccgcgggcuccugagcgugaccagcaccaaguccgaggaggccagcacgcagaccaaccccaagaagaccuccauggagaccaacagcccgggccccgcgacguccgagacccccagccccucccccaccacccaggcccccacggagaacaacaaccccaacacgccccggcagccgacgccgcccacccagcccgccaccccgagccccgucacgucccccgcccugcucgccagcucccagggcgacaccagcaccgcggugcaggacgugcacccgucccccaccaaccgcagcaagcggaaccuggagauggagaucauccugacgcucucccaggggcugaagaaguacuacggcaagauccugaagcuccuggaccugacccucgaggaggacaccgaggggcugcuggaguggugcaagcgcaaccucggccuggucugcgacgacagcuucuuccagaagcggaucgaggaguucuuccugaccggcgaggggcacuucaacgaggugcuccaguucaagacgcccuccacccugagccccaccgagccggcccgcgccggcucccccaccguggagcccuucaagagcuacuucgcccgggggcugcucagcauggacuccggcuacuucagcgccaagugcuacccccgcgcguccaacagcgggcugcagcugaucaacaucacgcagcacuccgcccggaucaccgacaccccgggccccaagaucaccaaccucaagacgaucaacugcaucaaccugaaggccagcaccuucaaggagcaccgcgagaucgagaucaacguccugcucccccagguggccgugaaccuguccagcugccacguccugaucaagucccacgugugcgacuacagccucgacaucgacggccccgugcggcugccgcgcauccaccacgaggggaccuucauccccggcaccuacaagaucgucaucgacaagaagaacaagcagaacgaccggugcacgaucgugaccaacugcgugaucaaggggcgcgagauccggaagggccaguccguccugcgccaguacaagaccgagaucaagaucgggaaggccagcuccggcagccggcgccuccuguccgaggagagcggcgacgacugcaucucccggacccagcugcuccgcacggagaccgcggagauccacagcgacagcuacgggggccccggggacaagaucaccaucugcaacggcuccaccguggucgaccagcggcuggggagcgagcugggcugcuacacgaucaaccgcgugaaguccuucaagcugugcgagaacagcgccaccggcaaguccugcgagaucgacagcacccccgugaagugccgccagggguucugccucaagaucacccaggagggccgggggcacgucaagcugucccgcggcagcgagguggugcuggacgccugcgacuccagcugcgagaucaugauccccaagggcacgggggacauccucgucgacugcuccggcgggcagcagcacuuccugaaggacaaccugaucgaccucggcugccccaacaucccccugcuggggaagauggccaucuacaucugccggaugagcaaccaccccaagaccaccaugguguuccucuucugguucuccuucggcuacgugaucacgugcauccugugcaaggucaucuucuaccugcucaucguggugggcacgcuggggaagaaguucaagcaguaccgcgagcugaagccgcagaccugcaccaucugcgagaccacccccgucaacgccaucgacgcggagaugcacgaccucaacugcagcuacaacaucugccccuacugcgccucccggcugacgagcgacggccuggcccgccacgugaugcagugccccaagcggaaggagaagaucgaggagaccgagcucuaccugaaccuggagcgcaucccgugggugguccggaagcuccuccagguguccgagagcaccgggguggcccugaagcgcuccagcuggcucgucgugcugcuggugcuccugaccgucagccugucccccgugcagagcgcgcccaucggccacgggaagacgguggagaccuaccagauccgggagggcuacaccuccgucugccucuucgugcugggcagcauccuguucaucguguccugccucaugaaggggcuggucgacagcgacggcaacuccuucuucccggggcugagcaucugcaagaccugcuccaucggcagcaucaacggguucgagaucgagucccacaagugcuacugcagccucuucugcugccccuacugccgccacugcuccacggaccgggagauccacaagcugcaccugagcaucugcaagaagcgcaagaccggcuccaacgugaugcucgccgugugcaagcggaugugcuuccgcgccaccgucgaggugagcaacaaggcccugcugauccgguccaucaucaacaccacguucguggucugcauccucauccuggccgugugcguggucagcaccuccgcgguggagauggagagccugcccgccggcaccugggagcgcgaggaggaccucaucaacuucugccaccaggagugccaggugaccgagacggagugccugugccccuacgaggcccugguccuccggaagccgcuguuccuggacagcaucaucaaggggaugaagaaccuccugaacuccaccagccuggagaccucccucagcaucgaggcccccuggggcgccaucaacgugcaguccaccuucaagcccacgaugagcgcggccaacaucgcccuguccuggagcuccguggagcaccgcgggaacaagauccuggucagcggccgcuccgagagcaucaugaagcucgaggagcggaccgggaucuccugggaccugggcguggaggacgccagcgaguccaagcugcucaccgugagcgucauggaccugucccagauguacagccccguguucgaguaccuguccggcgaccgccagguggaggaguggccgaaggcgaccugcacgggggacugccccgagcggugcggcugcaccagcuccacgugccuccacaaggaguggccccacucccgcaacuggcggugcaaccccaccuggugcuggggcgugggcaccggcugcacgugcugcgggcuggacgugaaggaccuguucaccgacuacauguucgugaaguggaaggucgaguacaucaagaccgaggugaucgucugcguggagcucacgagccaggagcgccagugcucccugaucgaggcgggcacccgguucaaccuggggccggugaccaucacccucagcgagccccgcaacauccagcagaagcugccgcccgagaucgucacgcugcacccgcggaucgaggagggcuucuucgaccucaugcacgugcagaaggugcuguccgccagcaccgucugcaagcugcaguccugcacccacggggugcccggcgaccuccagguguaccacaucggcaaccugcugaagggggacaaggucaacggccaccucauccacaagaucgagccccacuucaacaccagcuggauguccugggacgggugcgaccuggacuacuacugcaacaugggcgacuggcccagcugcuccuacaccggggugacgcagcacaaccacgccgccuucgugaacaugcugagcaucgagaccgacuacaccaagaacuuccacuuccacuccaagcgcgucaccgcgcacggcgacacgccgcagcucgaccugaaggcccggcccaccuacggcgccggggagaucaccgugcugguggaggucgccgacauggagcuccacaccaagaagaucgagaucagcggccugaaguucgccucccugacgugcaccgggugcuacgcgugcagcuccggcaucagcugcaaggugcgcauccacguggacgagcccgacgagcucaccguccacgugaaguccgaggaccccgacaucguggccgccagcagcucccugauggcccggaagcuggaguucgggaccgacagcacguucaaggccuucuccgcgaugccgaagaccagccucugcuucuacaucgucgagcgcgaguacugcaaguccugcagcaaggaggacacccagaagugcgugaacaccaagcuggagcagccccaguccauccugaucgagcacaagggcacgaucaucggcaagcagaacgacacgugcaccgccaaggccagcugcuggcucgaguccgucaagagcuucuucuacgggcugaagaacaugcuguccggcaucuucgggaacgucuucaucggcaucuuccuguuccucgcccccuucgcccugcugauccucuucuucauguucggcuggcggauccuguucugcuucaagugcugccgccggacccgcgggcuguucaaguaccggcaccucaaggacgacgaggagacgggcuaccgcaagaucaucgagcggcugaacaacaagaaggggaagaacaagcugcucgacggcgagcgccuggcggaccgcaagaucgccgagcuguucagcaccaagacccacgugggguga

SEQ ID NO: 12034 - RNA, 5052 nt, Artificial Sequence
  derived and/or modified CDS sequence (opt1) from CCHFV(UCCR4405)__KY484029.1__GP
augcacgcccugcucgugugcuucauccuguaccugcagcucagcggccucgggggcgcccaccgccaguccaacgcgaccgagcacaacgggaccaacacgaccaccgcccccggcaccagccaguccccgaagccgcccgucagcacgacccugccccacacccccgaggccuccaccaucaagcugacgacccccaccagcgagaccgagggguccggcgagacgaccccgccgcccaacaccacccagggccugccccugcccgggacgacccccgagcggagcgccaccaccgccacguccaccagcuccaccgacgacaugaacagcaccacgcagaugaccgacaacacccccaccuccacggugagcaucggccucuccagcucccccagcaugcccuccaccagccaggggauccacuaccccgugcgcagccugcuguccgucagcuccccgaagaccgcgaccacgcccacccccaugagccccggcgagguguccccggagaccagcucccagcacagcgccaugucccggauccccacccucuacacggccacccaggugagcaccgagaacaccaaccgcuccaucccccggcagagcgaguccagcguccagcccgccacccaguccccgaucacgagccccgcgcagaccauccugcugauguccgccgcccccaccgccauccaggacaugcaccccagcccgaagaaccgcuccaagcggaaccucgagguggagaucauccugacccugagccaggggcucaagaaguacuacggcaagauccugaagcugcuccaccugacgcuggaggaggacaccgagggccuccuggaguggugcaagcgcaaccuggggagcaacugcgacgacgacuucuuccagaagcggaucgaggaguucuucaucaccggcgagggguacuucaacgaggugcuccaguucaagacccccuccacgcugagccccaccgagccgucccacguccgccugcccaccgccgagcccuucaagagcuacuucgcgaagggcuuccucuccaucgacagcggcuacuucuccgccaagugcuacccccggagcuccaccagcgggcugcagcugaucaacgugacgcagcacccggcccgcaucgccgagacccccggccccaagaccaccucccucaagacgaucaacugcaucaaccugcgggccagcguguucaaggagcaccgcgaggucgagaucaacgugcugcucccccagaucgcggugaaccuguccaacugccacgucgugaucaacagccacgugugcgacuacucccuggacaccgacgggccgguccggcucccccgcauccaccacgagggcgccuucauccccgggaccuacaagaucgugaucgacaagaagaacaagcugaacgaccggugcagccuggugaccaacugcgucaucaagggccgcgaggugcggaagggccaguccgugcuccgccaguacaagacggagaucaagaucgggaaggccagcaccggcagccggaagcugcuguccgaggagcccggggacgacugcaucagccgcacccagcuccugaagaccgagacggccgagauccacgacgacaacuacggcgggccgggcgacaagaucaccaucugcaacggcuccaccaucgucgaccagcgccuggggagcgagcucggcugcuacaccaucaaccgggugaaguccuucaagcugugcgagaacagcgccacggggaagaccugcgagaucgacuccacccccgucaagugccgccagggcuucugccugaagaucacccaggaggggcggggccacgugaagcugagccgcggcuccgaggugguccucgacgcgugcgacagcuccugcgaggugaugauccccaaggggacgggcgacauccugguggacugcagcgggggccagcagcacuuccugaaggacaaccucaucgaccugggcugcccccacaucccgcugcucgggaagauggccaucuacaucugccggauguccaaccacccccgcaccaccauggccuuccuguucugguucagcuucggcuacgucaucacgugcaucuucugcaaggcccuguucuacucccucaucaucaucgggacccugggcaagaagaucaagcaguaccgggagcugaagccccagaccugcaccaucugcgagaccgcccccgugaacgcgaucgacgccgagaugcacgaccucaagugcagcuacaacaucugcccguacugcgccucccgccugaccagcgacgggcuggcccggcacgugacgcagugccccaagcgcaaggagaaggucgaggagaccgagcucuaccugaaccuggagcggauccccuggaucgugcgcaagcuccuccagguguccgagagcaccggcgucgcgcugaagcggagcuccuggcucaucgugcugcuggugcuccugaccgucagccugucccccgugcagagcgccccggugggccacgggaagacgaucgagaccuaccagacccgcgagggcuucaccuccaucugccucuucaugcuggggagcauccuguucaucgucuccugccucgugaagggccugguggacagcgucuccgacagcuucuuccccgggcuguccgugugcaagacgugcagcaucggcuccaucaacggcuucgagaucgagagccacaagugcuacugcucccucuucugcugccccuacugccggcacuacagcgccgaccgcgagauccaccagcugcaccuguccaucugcaagaagcggaagaccgggagcaacgugaugcucgccgucugcaagcgcaugugcuucaaggccaccaucgaggcgucccggcgcgcccugcugauccgcagcaucaucaacaccacguucgugaucugcauccucauccuggccaucugcguggucagcaccuccgccguggagauggagaaccugccggccggcaccugggagcgggaggaggaccucaccaacuucugccaccaggagugccaggugacggagaccgagugccugugccccuacgaggcgcugguccuccgcaagccccuguuccuggacagcaccgugaaggggaugaagaaccuccugaacuccaccagccuggagacgucccucagcaucgaggcccccuggggcgccaucaacgugcaguccaccuucaagccgaccgucagcaccgccaacaucgcccuguccuggagcuccguggagcaccgggggaacaagauccuggugacgggccgcagcgaguccaucaugaagcucgaggagcggaccggcgucagcugggaccuggggguggaggacgcguccgagagcaagcugcucaccguguccaucauggaccugagccagauguacucccccgucuucgaguaccugagcggcgaccgccagguggaggaguggcccaaggcgaccugcacgggggacugccccgagcggugcggcugcaccagcagcacgugccuccacaaggaguggccgcacucccgcaacuggcggugcaaccccaccuggugcuggggcguggggaccggcugcacgugcugcggggucgacgugaaggaccuguucaccgaccacauguucgugaaguggaaggucgaguacaucaagaccgaggccaucgugugcguggagcugaccucccaggagcgccagugcagccucaucgaggccggcacccgguucaaccuggggcccgucaccaucacccuguccgagccccgcaacauccagcagaagcucccgcccgagaucaucacccugcaccccaagaucgaggagggcuucuucgaccugaugcacgugcagaaggugcucagcgccuccacggucugcaagcugcagagcugcacccacggcauccccggggaccugcagaucuaccacaucggcaaccuccugaagggggaccgggugaacggccaccugauccacaagaucgagccgcacuucaacaccuccuggaugagcugggacgggugcgaccucgacuacuacugcaacaugggcaacuggcccuccugcaccuacacgggcgucacccagcacaaccacgccgccuucgugaaccugcugaacaucgagaccgacuacaccaagacguuccacuuccacagcaagcgcgugaccgcccacggggacacgccccagcucgaccugaaggcccggcccaccuacggcgcgggggagaucaccguccugguggagguggccgacauggagcuccacaccaagaaggucgagaucuccggccugaaguucgccagccuggugugcaccgggugcuacgccugcuccagcggcaucuccugcaaggugcgcauccacgucgacgagccggacgagcucaccgugcacgucaagagcuccgaccccgacgugguggccgcgagcacgagccugauggcccggaagcuggaguucggcaccgacuccaucuucaaggccuucagcgccaugcccaagaccucccucugcuucuacaucguggagcgcgaguacugcaagagcugcuccgaggacgacaccaagaagugcgucgacacgaagcuggagcagccccagagcauccugaucgagcacaaggggaccaucaucggcaagcagaacgacacgugcaccgccaaggcguccugcuggcucgagagcgugaaguccuucuucuacgggcugaagaacaugcugggcagcguguucgggaacuucuucgucggcauccuccuguuccuggccccguucgugcugcucgugcuguucuucauguucggcuggaagauccuguucugcuucaagugcugccggcgcacccggggccucuucaaguaccgccaccugaaggacgacgaggagaccggguaccgccggaucaucgagcgccugaacuccaagaaggggaagaaccggcuccuggacggcgagcgccuggccgaccggaagaucgccgagcuguucagcaccaagacccacaucggcuga

SEQ ID NO: 12035 - RNA, 5052 nt, Artificial Sequence
  derived and/or modified CDS sequence (opt1) from CCHFV(Drosdov)__DQ211630.1__GP
augcacgcccugcucgugugcuucauccuguaccugcagcucagcggccucgggggcgcccaccgccaguccaacgcgaccgagcacaacgggaccaacacgaccaccgcccccggcaccagccaguccccgaagccgcccgucagcacgacccugccccacacccccgaggccuccaccaucaagcugacgacccccaccagcgagaccgagggguccggcgagacgaccccgccgcccaacaccacccagggccugccccugcccgggacgacccccgagcggagcgccaccaccgccacguccaccagcuccaccgacgacaugaacagcaccacgcagaugaccgacaacacccccaccuccacggugagcaucggccucuccagcucccccagcaugcccuccaccagccaggggauccacuaccccgugcgcagccugcuguccgucagcuccccgaagaccgcgaccacgcccacccccaugagccccggcgagguguccccggagaccagcucccagcacagcgccaugucccggauccccacccucuacacggccacccaggugagcaccgagaacaccaaccgcuccaucccccggcagagcgaguccagcguccagcccgccacccaguccccgaucacgagccccgcgcagaccauccugcugauguccgccgcccccaccgccauccaggacaugcaccccagcccgaagaaccgcuccaagcggaaccucgagguggagaucauccugacccugagccaggggcucaagaaguacuacggcaagauccugaagcugcuccaccugacgcuggaggaggacaccgagggccuccuggaguggugcaagcgcaaccuggggagcaacugcgacgacgacuucuuccagaagcggaucgaggaguucuucaucaccggcgagggguacuucaacgaggugcuccaguucaagacccccuccacgcugagccccaccgagccgucccacguccgccugcccaccgccgagcccuucaagagcuacuucgcgaagggcuuccucuccaucgacagcggcuacuucuccgccaagugcuacccccggagcuccaccagcgggcugcagcugaucaacgugacgcagcacccggcccgcaucgccgagacccccggccccaagaccaccucccucaagacgaucaacugcaucaaccugcgggccagcguguucaaggagcaccgcgaggucgagaucaacgugcugcucccccagaucgcggugaaccuguccaacugccacgucgugaucaacagccacgugugcgacuacucccuggacaccgacgggccgguccggcucccccgcauccaccacgagggcgccuucauccccgggaccuacaagaucgugaucgacaagaagaacaagcugaacgaccggugcagccuggugaccaacugcgucaucaagggccgcgaggugcggaagggccaguccgugcuccgccaguacaagacggagaucaagaucgggaaggccagcaccggcagccggaagcugcuguccgaggagcccggggacgacugcaucagccgcacccagcuccugaagaccgagacggccgagauccacgacgacaacuacggcgggccgggcgacaagaucaccaucugcaacggcuccaccaucgucgaccagcgccuggggagcgagcucggcugcuacaccaucaaccgggugaaguccuucaagcugugcgagaacagcgccacggggaagaccugcgagaucgacuccacccccgucaagugccgccagggcuucugccugaagaucacccaggaggggcggggccacgugaagcugagccgcggcuccgaggugguccucgacgcgugcgacagcuccugcgaggugaugauccccaaggggacgggcgacauccugguggacugcagcgggggccagcagcacuuccugaaggacaaccucaucgaccugggcugcccccacaucccgcugcucgggaagauggccaucuacaucugccggauguccaaccacccccgcaccaccauggccuuccuguucugguucagcuucggcuacgucaucacgugcaucuucugcaaggcccuguucuacucccucaucaucaucgggacccugggcaagaagaucaagcaguaccgggagcugaagccccagaccugcaccaucugcgagaccgcccccgugaacgcgaucgacgccgagaugcacgaccucaagugcagcuacaacaucugcccguacugcgccucccgccugaccagcgacgggcuggcccggcacgugacgcagugccccaagcgcaaggagaaggucgaggagaccgagcucuaccugaaccuggagcggauccccuggaucgugcgcaagcuccuccagguguccgagagcaccggcgucgcgcugaagcggagcuccuggcucaucgugcugcuggugcuccugaccgucagccugucccccgugcagagcgccccggugggccacgggaagacgaucgagaccuaccagacccgcgagggcuucaccuccaucugccucuucaugcuggggagcauccuguucaucgucuccugccucgugaagggccugguggacagcgucuccgacagcuucuuccccgggcuguccgugugcaagacgugcagcaucggcuccaucaacggcuucgagaucgagagccacaagugcuacugcucccucuucugcugccccuacugccggcacuacagcgccgaccgcgagauccaccagcugcaccuguccaucugcaagaagcggaagaccgggagcaacgugaugcucgccgucugcaagcgcaugugcuucaaggccaccaucgaggcgucccggcgcgcccugcugauccgcagcaucaucaacaccacguucgugaucugcauccucauccuggccaucugcguggucagcaccuccgccguggagauggagaaccugccggccggcaccugggagcgggaggaggaccucaccaacuucugccaccaggagugccaggugacggagaccgagugccugugccccuacgaggcgcugguccuccgcaagccccuguuccuggacagcaccgugaaggggaugaagaaccuccugaacuccaccagccuggagacgucccucagcaucgaggcccccuggggcgccaucaacgugcaguccaccuucaagccgaccgucagcaccgccaacaucgcccuguccuggagcuccguggagcaccgggggaacaagauccuggugacgggccgcagcgaguccaucaugaagcucgaggagcggaccggcgucagcugggaccuggggguggaggacgcguccgagagcaagcugcucaccguguccaucauggaccugagccagauguacucccccgucuucgaguaccugagcggcgaccgccagguggaggaguggcccaaggcgaccugcacgggggacugccccgagcggugcggcugcaccagcagcacgugccuccacaaggaguggccgcacucccgcaacuggcggugcaaccccaccuggugcuggggcguggggaccggcugcacgugcugcggggucgacgugaaggaccuguucaccgaccacauguucgugaaguggaaggucgaguacaugaagaccgaggccaucgugugcguggagcugaccucccaggagcgccagugcagccucaucgaggccggcacccgguucaaccuggggcccgucaccaucacccuguccgagccccgcaacauccagcagaagcucccgcccgagaucaucacccugcaccccaagaucgaggagggcuucuucgaccugaugcacgugcagaaggugcucagcgccuccacggucugcaagcugcagagcugcacccacggcauccccggggaccugcagaucuaccacaucggcaaccuccugaagggggaccgggugaacggccaccugauccacaagaucgagccgcacuucaacaccuccuggaugagcugggacgggugcgaccucgacuacuacugcaacaugggcaacuggcccuccugcaccuacacgggcgucacccagcacaaccacgccgccuucgugaaccugcugaacaucgagaccgacuacaccaagacguuccacuuccacagcaagcgcgugaccgcccacggggacacgccccagcucgaccugaaggcccggcccaccuacggcgcgggggagaucaccguccugguggagguggccgacauggagcuccacaccaagaaggucgagaucuccggccugaaguucgccagccuggugugcaccgggugcuacgccugcuccagcggcaucuccugcaaggugcgcauccacgucgacgagccggacgagcucaccgugcacgucaagagcuccgaccccgacgugguggccgcgagcacgagccugauggcccggaagcuggaguucggcaccgacuccaucuucaaggccuucagcgccaugcccaagaccucccucugcuucuacaucguggagcgcgaguacugcaagagcugcuccgaggacgacaccaagaagugcgucgacacgaagcuggagcagccccagagcauccugaucgagcacaaggggaccaucaucggcaagcagaacgacacgugcaccgccaaggcguccugcuggcucgagagcgugaaguccuucuucuacgggcugaagaacaugcugggcagcguguucgggaacuucuucgucggcauccuccuguuccuggccccguucgugcugcucgugcuguucuucauguucggcuggaagauccuguucugcuucaagugcugccggcgcacccggggccucuucaaguaccgccaccugaaggacgacgaggagaccggguaccgccggaucaucgagcgccugaacuccaagaaggggaagaaccggcuccuggacggcgagcgccuggccgaccggaagaucgccgagcuguucagcaccaagacccacaucggcuga

SEQ ID NO: 12036 - RNA, 5052 nt, Artificial Sequence
  derived and/or modified CDS sequence (opt1) from CCHFV(44-ST-2010)__KR814859.1__GP
augcacacccugcucgugugcuucauccuguaccugcagcucagcggccuggggggcgcccacgggcaguccaacgccaccgagcacaacggcacgaacaccaccaccguccccgggacgagccaguccccgaagccccccgcgagcaccacccugccccacaccccggaguccagcacggugaagcucaccacccccaccuccgagacggagggcagcggcgagaccaccccccccccgaacaccacgcaggggcugcccccccccggcaccaccccggagcgccccgccaccacggccaccuccaugagcuccaccgacaacaugaacagcaccacgcaggugaccgacaacacccccaccuccacggucagcaucucccccagcuccagcccguccaugcccagcaccagccaggggauccacuaccccgugcggucccugcucagcguguccagccccaagaccgucaccacgccgacccccaugucccccggcgagaugagccccgagaccuccagccagcacuccgccaugagccgcaucccgacccuguacacggccacccagguguccaccgagaacaccaaccggagcaccccccgccaguccgagagcuccgcgcagcccgccacgcagagccccaccaccuccccgacccagacgauccugcucaugagcgccgcccccaaggcgauccaggacaugcaccccuccccgaccaaccggagcaagcgcaaccuggagguggagaucauccugacccucagccaggggcugaagaaguacuacggcaagauccugaagcuccugcaccugacccucgaggaggacacggagggccugcuggaguggugcaagcggaaccucggguccaacugcgacgacgacuucuuccagaagcgcaucgaggaguucuucaucaccggcgagggguacuucaacgagguccugcaguucaagacccugagcacccucucccccacggagcccagccacgugcggcugcccaccgccgagccguucaaguccuacuucgccaagggcuuccugagcaucgacuccggcuacuucagcgccaagugcuacccccgcuccagcaccuccgggcuccagcugaucaacgugacccagcaccccgcccggaucgcggagacgcccggcccgaagaccaccagccugaagaccaucaacugcaucaaccuccgcgccuccgucuucaaggagcaccgggagguggagaucaacgugcugcugccccagaucgccgucaaccucagcaacugccacguggugaucaacucccacgucugcgacuacagccuggacacggacgggcccgugcgccugccccggauccaccacgagggcaccuucaucccggggaccuacaagaucgugaucgacaagaagaacaagcucaacgaccgcugcucccuggucaccaacugcgugaucaagggccgggaggugcgcaagggccagagcguccugcggcaguacaagacggagaucaagaucgggaaggccagcaccggcucccgcaagcuccugagcgaggagcccggggacgacugcaucucccggacccagcugcucaagaccgagacggccgagauccacgacgacaacuacggcgggcccggcgacaagaucaccaucugcaacggcagcaccaucguggaccagcgccugggguccgagcugggcugcuacaccaucaaccgcgucaagagcuucaagcucugcgagaacuccgcgacggggaagaccugcgagaucgacagcacccccgugaagugccggcagggcuucugccugaagaucacccaggaggggcgcggccacgugaagcugucccggggcagcgaggucgugcuggacgccugcgacuccagcugcgagaucaugaucccgaaggggacgggcgacauccucguggacugcuccgggggccagcagcacuuccugaaggacaaccugaucgaccucggcugcccccacaucccccugcuggggaagauggccaucuacaucugccgcaugagcaaccacccccggaccaccauggccuuccuccugugguucuccuucggcuacgucaucaccugcaucuucugcaaggcccuguucuacagccucaucaucaucgggacccugggcaagaagaucaagcaguaccgcgagcugaagccgcagacgugcaccaucugcgagaccgcgcccgugaacgccaucgacgccgagaugcacgaccucaacugcuccuacaacaucugccccuacugcgccagccggcugaccuccgacgggcuggcccgccacgugacgcagugccccaagcggaaggagaaggucgaggagaccgagcucuaccugaaccuggagcgcaucccguggaucgugcggaagcuccugcaggugagcgagagcaccggcgucgcgcugaagcgcuccagcuggcucaucgugcugcuggugcuccugaccgucucccugagccccgugcaguccgcccccgugggccacgggaagacgaucgagaccuaccagacccgggagggcuucaccaacaucugccucuucaugcuggggagcauccuguucaucgucuccugccucgugaagggccugguggacagcgucuccgacagcuucuucccggggcuguccgugugcaagacgugcagcuucggcuccaucaacggcuucgagaucgagagccacaagugcuacugcucccucuucugcugccccuacugccgccacugcagcgccgaccgggagauccaccagcugcaccuggggaucugcaagaagcgcaagaccggcuccaacgugaugcucgccgucugcaagcggaugugcuucaaggcgaccaucgaggccagccgccgggcccugcugauccgcuccaucaucaacaccacguucgugaucugcauccucacccuggccaucugcguggucagcaccagcgccguggagauggagaaccugcccgcggggaccugggagcgcgaggaggaccucacgaacuucugccaccaggagugccagguguccgagaccgagugccugugccccuacgaggcccugguccuccggaagccgcuguuccuggacagcaucgugaagggcaugaagaaccuccugaacuccaccagccuggagaccucccucagcaucgaggcccccuggggggccaucaacgugcaguccacguucaagcccaccgucagcaccgccaacaucgcgcuguccuggagcuccguggagcaccgcggcaacaagauccuggugaccggccggagcgaguccaucaugaagcucgaggagcgcacgggggucagcugggaccugggcguggaggacgccuccgagagcaagcugcucaccguguccaucauggaccugagccagauguacucccccgucuucgaguaccugagcggggaccggcagguggaggaguggccgaaggccaccugcaccggcgacugccccgagcgcugcgggugcacgagcuccaccugccuccacaaggaguggccccacagccggaacuggcgcugcaaccccaccuggugcuggggcgugggcaccgggugcacgugcugcggcgucgacgugaaggaccuguucaccgaccacauguucaucaaguggaagguggaguacaucaagaccgaggccaucgucugcguggagcugaccucccaggagcggcagugcagccucaucgaggccgggacccgcuucaaccugggcccggugacgaucacccuguccgagccccggaacauccagcagaagcucccccccgagaucaucacccugcacccgaagaucgaggagggcuucuucgaccugaugcacguccagaaggugcucagcgcguccaccgugugcaagcugcagagcugcacgcacgggauccccggcgaccugcagaucuaccacaucgggaaccuccugaagggcgaccgccugaacgggcaccucauccacaagaucgagccccacuucaacaccuccuggaugagcugggacggcugcgaccuggacuacuacugcaacaugggcgacuggcccuccugcaccuacaccggggucacgcagcacaaccacgccgccuucgugaaccugcucaacaucgagaccgacuacaccaagaccuuccacuuccacagcaagcgggucacggcccacggcgacaccccgcagcuggaccugaaggcgcgccccaccuacggggccggcgagaucaccgugcucguggaggucgccgacauggagcugcacacgaagaagguggagaucuccgggcugaaguucgccagccucgccugcaccggcugcuacgcgugcuccagcggcaucuccugcaaggugcggauccacgucgacgagcccgacgagcugaccgugcacgugaagagcuccgaccccgacgucguggccgccagcaccagccugauggcccgcaagcucgaguucgggacggacuccaccuucaaggccuucagcgcgaugccgaagaccucccugugcuucuacaucguggagcgggaguacugcaagagcugcuccgaggacgacaccaagaagugcgucgacacgaagcuggaccagccccagagcauccucaucgagcacaagggcaccaucaucgggaagcagaacgacaccugcaccgccaaggccuccugcuggcuggagagcgugaaguccuucuucuacggccugaagaacaugcucgggagcguguucggcaacuucuucgucggcauccugcuguuccuggcccccuucgugcuccuggugcuguucuucaugugcggguggaagauccucuucugcuucaagugcugccgccggacgcgcggccuguucaaguaccggcaccugaaggacgacgaggagaccggguaccgccgcaucaucgagcggcucaacuccaagaagggcaagaaccgccugcuggacggcgagcggcucgccgaccgcaagaucgcggagcuguucagcaccaagucccacaucggguga

SEQ ID NO: 12037 - RNA, 5052 nt, Artificial Sequence
  derived and/or modified CDS sequence (opt1) from CCHFV(3756-ST-2007)__KR814866.1__GP
augcacacccugcucgugugcuucauccuguaccugcagcucagcggccuggggggcgcccacgggcaguccaacgccaccgagcacaaccgcacgaacaccaccaccguccccggcacgagccaguccccgaagccccccgcgagcaccacccugccccacaccccggaguccagcacggugaagcucaccacccccaccuccgagacggaggggagcggcgagaccaccccccccccgaacaccacgcagggccugccccugcccgggaccacccccgagcgguccgccaccacggccaccagcaccuccagcaccgacaacaugaacacgaccacccaggugaccgacaacacgccgaccuccaccgucagcaucucccccagcuccagccccuccaugcccagcaccagccagggcauccacuacccggugcgcucccuccugagcguguccagccccaagacggucaccacccccacccccauguccccgggggagaugagccccgagacguccagccagcacuccgccaugagccggauccccacccuguacaccgccacccagguguccaccgagaacaucaaccgcagcacgccccggcaguccgagagcuccgugcagccggcgacccagagccccaucaccucccccgcccagaccauccuccugaugagcgccgcccccaaggcgauccaggacaugcacccgucccccacgaaccgcagcaagcggaaccuggaggucgagaucauccucacccugagccagggccugaagaaguacuacgggaagauccucaagcugcugcaccucacccuggaggaggacaccgagggccugcucgaguggugcaagcgcaaccugggcuccaacugcgacgacgacuucuuccagaagcggaucgaggaguucuucaucacgggggagggcuacuucaacgaggugcugcaguucaagacccucagcacccugucccccaccgagccgagccacgugcgccugcccacggccgagcccuucaaguccuacuucgccaagggguuccucagcaucgacuccggcuacuucagcgccaagugcuacccccgguccagcaccuccggccugcagcugaucaacgucacccagcacccggcccgcaucgcggagacccccgggcccaagacgaccagccucaagaccaucaacugcaucaaccugcgggccuccguguucaaggagcaccgcgagguggagaucaacguccugcucccccagaucgccgugaaccugagcaacugccacguggucaucaacucccacgugugcgacuacagccuggacaccgacggcccggugcggcucccccgcauccaccacgaggggacguucauccccggcaccuacaagaucgucaucgaccggaagaacaagcugaacgaccgcugcucccuggugaccaacugcgugaucaaggggcgggagguccgcaagggccagagcgugcuccggcaguacaagaccgagaucaagaucggcaaggccagcacggggucccgcaagcugcugagcgaggagcccggcgacgacugcaucucccgcacccagcuccugaagaccgagaccgccgagauccacgacgacaacuacgggggcccgggggacaagaucacgaucugcaacggcagcaccaucgucgaccagcggcugggcuccgagcucgggugcuacaccaucaaccgcgugaagagcuucaagcugugcgagaacuccgcgaccggcaagacgugcgagaucgacagcacccccgugaagugccggcagggguucugccugaagaucacccaggagggccgcgggcacgucaagcugucccggggcagcgagguggugcucgacgccugcgacuccagcugcgagaucaugauccccaagggcaccggggacauccuggucgacugcuccggcgggcagcagcacuuccugaaggacaaccucaucgaccugggcugcccccacaucccgcugcucggcaagauggccaucuacaucugccgcaugagcaaccacccccggacgaccauggccuuccuguucugguucuccuucggguacgugaucaccugcaucuucugcaaggcccuguucuacagccucaucaucaucggcacccuggggaagaagaucaagcaguaccgcgagcugaagccccagaccugcacgaucugcgagaccgcgcccgugaacgccaucgacgccgagaugcacgaccucaacugcuccuacaacaucugcccguacugcgccagccggcugaccuccgacggccuggcccgccacgucacccagugccccaagcggaaggagaagguggaggagacggagcucuaccugaaccuggagcgcauccccuggaucgugcggaagcuccugcaggucagcgagagcaccgggguggcgcugaagcgcuccagcuggcucaucgugcugcugguccuccugaccgugucccugagccccgugcaguccgccccggucggccacggcaagaccaucgagacguaccagacccgggagggguucaccagcaucugccucuucaugcugggcuccauccuguucaucgugagcugccucgugaaggggcuggucgacuccgugagcgacuccuucuuccccggccugagcgugugcaagaccugcuccaucgggagcaucaacggcuucgagaucgagucccacaagugcuacugcagccucuucugcugccccuacugccgccacugcuccgccgaccgggagauccaccagcugcaccugagcaucugcaagaagcgcaagacgggcuccaacgucaugcucgccgugugcaagcggaugugcuucaaggcgaccaucgaggccagccgccgcgcccugcugauccggagcaucaucaacaccaccuucgugaucugcauccucacgcuggccaucugcgucguguccaccagcgccguggagauggaggaccugccggcggggaccugggagcgcgaggaggaccucaccaacuucugccaccaggagugccaggucacggagaccgagugccugugccccuacgaggcccuggugcuccggaagccccuguuccuggacuccaucgugaagggcaugaagaaccuccugaacagcaccucccuggagaccagccucuccaucgaggcccccuggggggccaucaacguccagagcacguucaagccgaccguguccaccgccaacaucgcgcugagcugguccagcguggagcaccgcggcaacaagauccuggucaccgggcgguccgagagcaucaugaagcucgaggagcgcacgggcguguccugggaccugggcguggaggacgccagcgaguccaagcugcucaccgucagcaucauggaccugucccagauguacagccccguguucgaguaccugagcggggaccggcagguggaggaguggcccaaggccaccugcaccggcgacugccccgagcgcugcgggugcacguccagcaccugccuccacaaggaguggccgcacucccggaacuggcgcugcaaccccaccuggugcuggggcgucgggaccggcugcacgugcugcggcguggacgugaaggaccuguucaccgaccacauguucaucaaguggaaggucgaguacaucaagaccgaggccaucgugugcguggagcugaccagccaggagcggcagugcucccucaucgaggccgggacccgcuucaaccugggccccgucacgaucacccugagcgagccccggaacauccagcagaagcucccgcccgagaucaucacccugcaccccaagaucgaggagggguucuucgaccugaugcacgugcagaaggugcucuccgcgagcaccgucugcaagcugcaguccugcacgcacggcauccccggcgaccugcagaucuaccacaucgggaaccuccugaagggcgaccgcgugaacgggcaccugauccacaagaucgagccgcacuucaacaccagcuggauguccugggacggcugcgaccucgacuacuacugcaacaugggggacuggcccagcugcaccuacaccggcgucacgcagcacaaccacgccgccuucgugaaccugcugaacaucgagaccgacuacaccaagaccuuccacuuccacuccaagcgggugacggcccacggcgacaccccccagcucgaccugaaggcgcgccccaccuacggggccggcgagaucaccguccugguggagguggccgacauggagcuccacacgaagaaggucgagaucagcgggcugaaguucgccucccugaccugcaccggcugcuacgccugcagcuccgggaucagcugcaaggugcggauccacguggacgagccggacgagcucaccguccacgugaaguccagcgaccccgacguggucgcggccagcacgucccugauggcccgcaagcuggaguucggcaccgacagcaccuucaaggccuucuccgccaugcccaagaccagccucugcuucuacaucguggagcgggaguacugcaaguccugcagcgaggacgacacgaagaagugcguggacaccaagcuggagcagccccaguccauccugaucgagcacaagggcaccaucaucgggaagcagaacgacaccugcacggcgaaggccagcugcuggcucgaguccgucaagagcuucuucuacggccugaagaacaugcugggguccguguucggcagcuucuucguggggauccuccuguuccugaccccguucguccugcucgugcuguucuucauguucggcuggaagauccuguucugcuucaagugcugccgccggacccgcggccucuucaaguaccgccaccugaaggacgacgaggagaccggguaccggcgcaucaucgagcggcugaacuccaagaagggcaagaaccgccuccuggacggggagcggcuggccgaccgcaagaucgccgagcucuucagcacgaagacccacaucggcuga

SEQ ID NO: 12038 - RNA, 5052 nt, Artificial Sequence
  derived and/or modified CDS sequence (opt1) from CCHFV(47-ST-2013)__KR814861.1__GP
augcacacccugcuggccugcuucauccuguaccugcagcucagcggccucggcggggcccacgggcaguccaacgcgaccgagcacaacgggaccaacaccaccaccgugcccgggaccagccaguccccgaagccgcccgccagcaccacccugccccacacccccgaguccagcaccgugaagcucaccacccccaccuccgagaccgagggcagcggcgagaccacgccgccgcccaacaccacccaggggcugcccccgcccggcaccacccccgagcgcuccgccaccaccgccaccagcaccuccagcaccgacaacaugaacuccacgacccagaugaccgggaacacccccacgcccaccgugaacaugagccccuccagcuccccgagcaugcccuccaccagccagggcauccacuaccccgugcggagccugcucuccguccccagccccaagaccgccacgacccccacccccgugucccccggggagaugagccccgagaccuccagccagcacuccgcgacgagccgcauccccacccuguacaccgccacccagguguccaccgagaacacgaaccggagcacgccccgccaguccaagagcuccguccagcccgccacccagagccccaucacgccgcccgcccagacgauccugcucauguccgcggccccgaaggccauccaggacaugcaccccagccccaccaaccgguccaagcgcaaccuggagguggagaucauccugacccucagccagggccugaagaaguacuacggcaagauccugaagcuccugcaccugacccucgaggaggacacggaggggcugcuggaguggugcaagcggaaccucggcuccaacugcgacgacgacuucuuccagaagcgcaucgaggaguucuucaucaccggggagggcuacuucaacgaggugcugcaguucaagacccugagcacccucagccccacggagccgucccacguccggcugcccaccgccgagcccuucaagagcuacuacgccaagggcuuccugucccucgacagcggguacuucuccgcgaagugcuacccccgcagcuccaccagcggccugcagcugaucaacgugacccagcacccggcccggaucgccgagacgcccgggcccaagaccaccucccucaagaccaucaacugcaucaaccugcgcgccagcguguucaaggagcaccgggaggucgagaucaacgugcugcucccccagaucgccgugaaccuguccaacugccacgucgugaucaacagccacgugugcgacuacccgcuggacacggacggccccguccgccucccccggauccaccacgaggggaccuucauccccggcaccuacaagaucgugaucgacaagaagaacaagcugaacgaccgcugcucccuggugaccaacugcgucaucaagggccgggaggugcgcaaggggcagagcgugcuccggcaguacaagacggagaucaagaucggcaaggcguccaccgggagccgcaagcugcuguccgaggagccgggcgacgacugcaucagccggacccagcuccugaagaccgagacggccgagauccacgacgacaacuacgggggccccggcgacaagaucaccaucugcaacgggagcaccaucgucgaccagcgccugggcuccgagcucgggugcuacaccaucaaccgcgucaaguccuucaagcugugcaagaacuccgccacgggcaagaccugcgagaucgacagcacccccgucaagugccggcagggguucugccugaagaucacccaggagggccgcggccacgugaagcugucccgggggagcgaggugguccucgacgccugcgacuccagcugcgagaucaugauccccaagggcacgggggacauccugguggacugcuccggcggccagcagcacuuccugaaggacaaccucaucgaccuggggugcccgcacaucccccugcucggcaagauggccaucuacaucugccgcaugagcaaccacccccggaccaccauggcguuccuguucugguucuccuucggguacgugaucacgugcaucuucugcaaggcccuguucuacagccucaucaucaucggcacccuggggaagaagaucaagcaguaccgcgagcugaagccccagacgugcaccaucugcgagaccgccccggucaacgccaucgacgccgagaugcacgaccucaacugcuccuacaacaucugccccuacugcgcgagccggcugaccuccgacggccuggcccgccacgugacgcagugccccaagcggaaggagaagguggaggagaccgagcucuaccugaaccuggagcgcaucccguggaucguccggaagcuccuccaggugagcgaguccaccggcguggcccugaagcgcagcuccuggcucaucguccugcuggugcuccugaccgugagccugagccccguccaguccgcccccguggggcacggcaagacgaucgagaccuaccagacccgggagggguucaccagcaucugccucuucaugcugggcuccauccuguucaucgugagcugccucgucaaggggcugguggacuccgugagcgacuccuucuuccccggccugagcgucugccgcacgugcuccaucggcagcaucaacggguucgagaucgagucccacaagugcuacugcagccucuucugcugcccguacugccggcacugcuccgcggaccgcgagauccaccagcugcaccugagcaucugcaagaagcggaagaccggcuccaacgugaugcucgccgugugcaagcgcaugugcuucaaggccaccaucgaggccagccggcgcgcccuguucauccgcuccaucaucaacaccacguucgugaccugcauccugacccucgcgaucugcguggugagcaccuccgccgucgagauggaggaccugcccgccgggacgugggagcgggaggaggaccugaccaacuucugccaccaggagugccaggugaccgagaccgagugccucugccccuacgaggcccuggugcugcgcaagccccucuuccuggacagcaucgucaagggcaugaagaaccugcucaacagcacgucccuggagaccagccuguccaucgaggccccguggggcgcgaucaacgugcagagcaccuucaagcccaccguguccacggccaacaucgcccucagcugguccagcgucgagcaccggggcaacaagauccuggugaccggccgcuccgagagcaucaugaagcuggaggagcggaccgggguguccugggaccucggcgucgaggacgccagcgaguccaagcugcugaccgugagcaucauggaccucucccagauguacagccccguguucgaguaccuguccggggaccgccaggucgaggaguggcccaaggccacgugcaccggcgagugcccggagcggugcgggugcaccagcagcacgugccugcacaaggaguggccccacagccgcaacuggcggugcaaccccaccuggugcuggggcgugggcaccgggugcacgugcugcggcguggacgucaaggaccucuucaccgaccacauguucaucaaguggaagguggaguacaucaagaccgaggcgaucgugugcgucgagcugacgagccaggagcgccagugcucccugaucgaggccgggacccgguucaaccucggccccgugaccaucacccugagcgagccgcgcaacauccagcagaagcugccgcccgagaucaucacgcuccaccccaagaucgaggagggcuucuucgaccugaugcacgugcagaagguccuguccgccagcaccgugugcaagcuccaguccugcacccacgggaucccgggcgaccugcagaucuaccacaucgggaaccugcucaagggcgaccgggugaacgggcaccugauccacaagaucgagccccacuucaacaccagcuggauguccugggacggcugcgaccuggacuacuacugcaacaugggcgacuggcccagcugcacguacaccggggucacccagcacaaccacgccgcguucgugaaccuccugaacaucgagaccgacuacacgaagaccuuccacuuccacuccaagcgcgucaccgcccacggcgacacgccccagcuggaccucaaggcccggccgacguacggggccggcgagaucaccgugcugguggaggucgccgacauggagcugcacaccaagaagguggaggugagcgggcucaaguucgcgucccuggccugcaccggcugcuacgccugcagcuccggcaucagcugcaagguccgcauccacguggacgagcccgacgagcugacggugcacgucaaguccagcgaccccgacgugguggccgccuccaccagccucauggcgcggaagcuggaguucgggaccgacuccaccuucaaggccuucagcgccaugcccaagacgagccugugcuucuacaucgucgagcgcgaguacugcaaguccugcagcgaggacgacaccaagaagugcguggacaccaagcucgagcagccgcaguccauccugaucgagcacaagggcaccaucaucgggaagcagaacgacacgugcaccgccaaggccagcugcuggcuggaguccgucaagagcuucuucuacggccucaagaacaugcugggguccgucuucggcaacuucuucgugggcauccugcuguuccuggcgcccuucgugcugcugguccucuucuucauguucggguggaagauccuguucugcuucaagugcugccggcgcacccggggccuguucaaguaccgccaccucaaggacgacgaggagaccggguaccgccggaucaucgagcgccugaacagcaagaagggcaagaaccggcugcucgacggcgagcgccuggccgaccggaagaucgccgagcuguucuccacgaagacccacaucggguga

SEQ ID NO: 12039 - RNA, 5052 nt, Artificial Sequence
  derived and/or modified CDS sequence (opt1) from CCHFV(1-CR/HU-2015)__KU161584.1__GP
augcacacccugcucgugugcuucauccuguaccugcagcuccugggccucggcggggcccacgagcagagcaacgccaccgaccacaaccgcaccaacaccaucaccgcgcccagcaccagccagaacccgaagccgcccgccuccacgacgccgccccacacccccgagagcuccaccaucaagcucaucaccagcaccggggaggccgagggguccggggagaccaccccgccccugaacaccacccagggccccuucccgcccgagaccaccagcgagcaccccgccuccaccgccaccaacaccagcuccaccaacagcaugaacuccaccacccagaugaccgacaacacccugacgagcaccguguccaccagccucuccaucagcccguccacccccagcacgagccagggcauccacuaccccgugcggucccugcugagcguguccagccccaagaccgcggccacccccacccccauguccacgcgcgagaugagcuccgagaccagcucccagcacagcgccaugucccggacccccaccuuccacacggccacccaggucagcaccgagaacgcgaaccgcuccacgccccgccagagcgaguccagcgcccagcccgccacccagucccccaugacgagccccgcccaguccaucuuccucgugagcgccgcgcccaccaccauccagaacauccacccgagccccaccaaccgcuccaagcggaaccuggagauggagaucauccugacgcucccccaggggcugaagaaguacuacggcaagauccugaagcuccugcaccugacccucgaggaggacaccgaggggcugcuggaguggugcaagcgcaaccucggcagcaacugcgacgacgaguucuuccagaagcggaucgaggaguucuucaucaccggggagggcuacuucaacgaggugcugcaguucaagacgcuguccacccucagccccaccgagcccucccacgcccggccgcccaccgccgagccguucaagagcuacuucgccaagggcuuccuguccaucgacagcggguacuucuccgccaagugcuacccccggagcuccacgagcggccugcagcucaucaacaucacccagcaccccgcgcgcaucgccgagacccccgggccgaagaccacgucccugaagaccaucaacugcaucaaccugcgggccagcgucuucaaggagcaccgcgagguggagaucaacgugcuccugccccagaucgccgucaaccuguccaacugccacguggugaucaacagccacgucugcgacuacucccucgacaccgacggccccgugcggcugccccgcaucuaccacgagggcaccuucaucccggggacguacaagaucgugaucgacaagaagaacaagcugaacgaccggugcacccucgucaccaacugcgugaucaagggccgcgaggugcggaaggggcagagcguccugcgccaguacaagaccgagaucaagaucggcaaggccagcacggggucccggaagcugcucagcgaggagcccggcgacgacugcaucucccgcacccagcugcugcgcaccgagaccgcggagauccacgacgacaacuacggcgggcccggcgacaagaucacgaucugcaacgggagcaccaucguggaccagcggcucggcuccgagcuggggugcuacaccaucaaccgcgucaagagcuucaagcugugcgagaacuccgccaccggcaagacgugcgagaucgacagcacccccgucaagugccggcagggcuucugccucaagaucacccaggaggggcgcggccacgugaagcugucccgggggagcgaggugguccuggacgccugcgacuccagcugcgaggugaugauccccaagggcaccggggacauccuggucgacugcuccggcggccagcagcacuuccucaaggacaaccugaucgaccuggggugcccccacaucccccuccugggcaagauggccaucuacaucugccgcaugagcaaccacccccggacgaccauggccuuccuguucugguucuccuucggguacgugaucacgugcaucuucugcaaggcccuguucuacagccugaucaucaucggcacccugggcaagaagaucaagcaguaccgcgagcucaagccgcagaccugcacgaucugcgagaccgcccccgugaacgccaucgacgccgagaugcacgaccugaacugcuccuacaacaucugccccuacugcgcgagccggcugaccuccgacgggcucgcccgccacgucacccagugccccaagcggaaggagaagguggaggagacggagcuguaccugaaccucgagcgcaucccguggaucgugcggaagcugcugcaggucagcgagagcaccggcguggcccucaagcgcuccagcuggcugaucgugcugcucguccugcugaccgugucccucagccccgugcaguccgcccccgucgggcacggcaagaccaucgagacguaccagacccgggagggguucaccagcaucugccuguucaugcugggcuccauccucuucaucgugagcugccuggugaagggccuggucgacuccgugagcgacuccuucuuccccgggcucagcgugugccggaccugcuccaucggcagcaucaacggguucgagaucgagucccacaagugcuacugcagccuguucugcugcccguacugccggcacugcuccgccgaccgcgagauccaccagcugcaccucagcaucugcaagaagcggaagacgggcuccaacgucaugcuggcggugugcaagcgcaugugcuuccgcgccaccauggaggccagccggcgcgcccugcucauccggagcaucaucaacaccaccuucgugaucugcauccugacgcugaccaucugcgucguguccaccagcgccguggagauggagaaccuccccgcggggaccugggagcgcgaggaggaccugacgaacuucugccaccaggagugccaggucaccgagaccgagugccugugccccuacgaggcccucgugcugcggaagccgcuguuccucgacuccaucgugaagggcaugaagaaccugcugaacagcaccucccucgagacgagccuguccaucgaggcccccuggggcgccaucaacguccagagcaccuucaagcccaccguguccaccgccaacaucgcgcugagcugguccagcguggagcaccgcgggaacaagauccucgucacgggccgguccgagagcaucaugaagcuggaggagcgcaccgggguguccugggaccugggcguggaggacgccagcgaguccaagcuccugaccgucagcaucauggaccugucccagauguacagccccguguucgaguaccucagcggggaccgccagguggaggaguggccgaaggcgaccugcacgggcgacugccccgagcgcugcggcugcaccuccuccacgugccugcacaaggaguggccccacucccggaacuggcgcugcaaccccaccuggugcuggggcgugggcaccgggugcacgugcugcggcguggacgugaaggaccuguucaccgaccacauguucgucaaguggaagguggaguacaucaagaccgaggccaucgugugcgucgagcucaccagccaggagcggcagugcucccugaucgaggcggggacgcgcuucaaccugggcccggugaccaucacccucagcgagccccggaacauccagcagaagcugccgcccgagaucaucacccugcacccgaagaucgaggagggcuucuucgaccucaugcacgugcagaagguccuguccgccagcacggugugcaagcugcaguccugcacccacgggauccccggcgaccuccagguguaccacaucgggaaccugcugaagggcgaccgcgucaacggccaccucauccacaagaucgagccccacuucaacaccagcuggauguccugggacgggugcgaccuggacuacuacugcaacaugggcgacuggcccagcugcaccuacacgggggugacccagcacaaccacgccgccuucgugaaccugcucaacaucgagaccgacuacaccaagacguuccacuuccacuccaagcgggucaccgcccacggcgacaccccgcagcuggaccugaaggcgcgccccaccuacggggccggcgagaucacggugcucgucgagguggccgacauggagcugcacaccaagaagguggagaucagcggccugaaguucgccucccucgccugcaccgggugcuacgcgugcagcuccggcaucagcugcaagguccggauccacguggacgagcccgacgagcugaccgugcacgucaaguccagcgaccccgacgugguggccgccagcacgucccugauggcccgcaagcucgaguucgggaccgacagcaccuucaaggccuucuccgcgaugccgaagaccagccugugcuucuacaucgucgagcgggaguacugcaaguccugcagcgaggacgacacgaagaagugcguggacaccaagcuggagcagccccaguccauccucaucgagcacaagggcaccaucaucgggaagcagaacgacacgugcacggccaaggccagcugcuggcuggaguccgucaagagcuucuucuacggccugaagaacaugcucggcuccgucuucgggaacuucuucaucggcauccugcuguuccucgcccccuucgugcugcuggugcuguucuucauguucggguggaagauccucuucugcuucaagugcugccgccgcacccggggccuguucaaguaccgccaccugaaggacgacgaggagaccggguaccggcgcaucaucgagcggcucaacaacaagaagggcaagaaccgccugcuggacggcgagcggcucgcggaccgcaagaucgccgagcuguucagcaccaagacgcacaucggguga

SEQ ID NO: 12040 - RNA, 5049 nt, Artificial Sequence
  derived and/or modified CDS sequence (opt1) from CCHFV(3820-ST-2007)__KR814868.1__GP
augcacacccugcucgugugcuucauccuguaccugcagcucagcggccuggggggcgcccacgggcaguccaacgccaccgagcacaacggcacgaacaccaccaccguccccgggacgagccaguccccgaagccccccgcgagcaccacccugccccacaccccggaguccagcacggugaagcucaccacccccaccuccgagacggagggcagcggcgagaccaccccccccaacaccacgcaggggcugccgcugcccggcaccacccccgagcgcuccgccaccacggccaccagcaccuccagcaccgacaacaugaacuccacgacccaggugaccgacaacacccccacgagcaccgucuccaucagcccguccagcuccagcagcaugcccuccaccagccaggggauccaccaccccgugcggucccuccugagcguguccagccccaagaccgucacgaccccgacccccaugucccccggcgagaugagccccgagaccuccagccagcacuccgccaugagccgcgugccgacgcuguacaccgccacccagaucuccaccgagaacaccgaccggagcacgccccgccaguccgagagcuccgugcagcccgcgacccagagccccaucaccuccccggcccagaccauccuccugaugagcgccgcccccaaggcgauccaggacaugcaccccagccccacgaaccgguccaagcgcaaccuggaggucgagaucauccucacccugagccaggggcugaagaaguacuacggcaagauccucaagcugcugcaccucacccuggaggaggacaccgagggccugcucgaguggugcaagcggaaccugggguccaacugcgacgacgacuucuuccagaagcgcaucgaggaguucuucaucacgggcgagggguacuucaacgaggugcugcaguucaagacccucagcacccuguccccgaccgagcccagccacgugcggcugcccacggccgagccguucaaguccuacuucgccaagggcuuccucagcaucgacuccggcuacuucagcgccaagugcuacccccgcuccagcaccuccgggcugcagcugaucaacgucacccagcaccccgcccggaucgcggagacccccggcccgaagacgaccagccucaagaccaucaacugcaucaaccugcgcgccuccguguucaaggagcaccgggagguggagaucaacguccugcucccccagaucgccgugaaccugagcaacugccacguggucaucaacucccacgugugcgacuacagccuggacaccgacgggcccgugcgccucccccggauccaccacgagggcacguucaucccggggaccuacaagaucgucaucgaccgcaagaacaagcugaacgaccggugcagccuggugaccaacugcgugaucaagggccgcgagguccggaagggccaguccgugcuccgccaguacaagaccgagaucaagaucgggaagacgagcaccggcucccggaagcugcugagcgaggagcccggggacgacugcaucucccgcacccagcuccugaagaccgagacggccgagauccacgacgacaacuacggcagccccggggacaagaucaccaucugcaacggcuccaccaucgucgaccagcgccugggcagcgagcucgggugcuacaccaucaaccgggugaaguccuucaagcugugcgagaacagcgccacgggcaagaccugcgagaucgacuccacccccgugaagugccgccagggguucugccugaagaucacccaggagggccgggggcacgucaagcugagccgcggcuccgagguggugcucgacgcgugcgacagcuccugcgagaucaugaucccgaagggcacgggggacauccuggucgacugcagcggcgggcagcagcacuuccugaaggacaaccucaucgaccugggcugcccccacaucccccugcucggcaagauggccaucuacaucugccggauguccaaccacccccgcaccaccauggccuuccuguucugguucagcuucggguacgugaucaccugcaucuucugcaaggcccuguucuacucccucaucaucaucggcacccuggggaagaagaucaagcaguaccgggagcugaagccgcagacgugcaccaucugcgagaccgcccccgugaacgcgaucgacgccgagaugcacgaccucaacugcagcuacaacaucugccccuacugcgccagccgccugaccuccgacggccuggcccggcacgucacgcagugccccaagcgcaaggagaagguggaggagaccgagcucuaccugaaccuggagcggaucccguggaucgugcgcaagcuccugcaggucagcgaguccaccgggguggcccugaagcggagcuccuggcucaucgugcugcugguccuccuggcggugagccugucccccgugcagagcgcccccgucggccacggcaagaccaucgagacguaccagacccgcgagggguucaccuccaucugccucuucaugcugggcagcauccuguucaucguguccugccucgugaaggggcuggucgacagcguguccgacagcuucuuccccggccuguccgugugcaagaccugcagcaucggguccaucaacggcuucgagaucgagagccacaagugcuacugcucccucuucugcugcccguacugccggcacugcagcgccgaccgcgagauccaccagcugcaccugagcaucugcaagaagcggaagacgggcuccaacgucaugcucgccgugugcaagcgcaugugcuucaaggcgaccaucgaggccagccggcgcgcccugcugauccgcuccaucaucaacaccaccuucgugaugugcauccucacgcuggccaucugcgucgugagcaccuccgccguggagauggaggaccugcccgcggggaccugggagcgggaggaggaccucaccaacuucugccaccaggagugccaggucacggagaccgagugccugugccccuacgaggcccuggugcuccgcaagccgcuguuccuggacagcaucgugaagggcaugaagaaccuccugaacuccaccagccuggagaccucccucagcaucgaggcccccuggggggccaucaacguccaguccacguucaagcccaccgugagcaccgccaacaucgcgcuguccuggagcuccguggagcaccggggcaacaagauccuggucaccgggcgcagcgaguccaucaugaagcucgaggagcggacgggcgugagcugggaccugggcguggaggacgccuccgagagcaagcugcucaccgucagcaucauggaccugucccagauguacagccccguguucgaguaccuguccggggaccgccagguggaggaguggccgaaggccaccugcaccggcgacugccccgagcggugcgggugcacgagcuccaccugccuccacaaggaguggccccacagccgcaacuggcggugcaaccccaccuggugcuggggcgucgggaccggcugcacgugcugcggcguggacgugaaggaccuguucaccgaccacauguucaucaaguggaaggucgaguacaucaagaccgaggccaucgugugcguggagcugaccucccaggagcgccagugcagccucaucgaggccgggacccgguucaaccugggcccggucacgaucacccuguccgagccccgcaacauccagcagaagcucccccccgagaucaucacccugcacccgaagaucgaggagggguucuucgaccugaugcacgugcagaaggugcucagcgcguccaccgucugcaagcugcagagcugcacgcacggcauccccggcgaccugcagaucuaccacaucgggaaccuccugaagggcgaccgggugaacgggcaccugauccacaagaucgagccccacuucaacaccuccuggaugagcugggacggcugcgaccucgacuacuacugcaacaugggggacuggcccuccugcaccuacaccggcgucacgcagcacaaccacgccgccuucgugaaccugcugaacaucgagaccgacuacaccaagaccuuccacuuccacagcaagcgcgugacggcccacggcgacaccccgcagcucgaccugaaggcgcggcccaccuacggggccggcgagaucaccguccugguggagguggccgacauggagcuccacacgaagaaggucgagaucuccgggcugaaguucgccagccugaccugcaccggcugcuacgccugcuccagcgggaucagcugcaaggugcgcauccacguggacgagcccgacgagcucaccguccacgugaaguccagcgaccccgacguggucgcggccuccacgagccugauggcccggaagcuggaguucggcaccgacuccaccuucaaggccuucagcgccaugccgaagaccucccucugcuucuacaucguggagcgcgaguacugcaagagcugcuccgaggacgacacgaagaagugcguggacaccaagcuggagcagccccagagcauccugaucgagcacaagggcaccaucaucgggaagcagaacgacaccugcacggcgaaggccuccugcuggcucgagagcgucaaguccuucuucuacggccugaagaacaugcuggggagcguguucggcuccuucuucguggggauccuccuguuccuggcccccuucguccugcucgugcuguucuucauguucggcuggaagauccuguucugcuucaagugcugccggcgcacccggggccucuucaaguaccgccaccugaaggacgacgaggagaccggguaccgccggaucaucgagcgccugaacagcaagaagggcaagaaccggcuccuggacggggagcgccuggccgaccggaagaucgccgagcucuucuccaccaagacgcacaucggcuga

SEQ ID NO: 12041 - RNA, 5052 nt, Artificial Sequence
  derived and/or modified CDS sequence (opt1) from CCHFV(Ast199)__KX056051.1__GP
augcacacccugcuggugugcuucauccuguaccugcagcucuccggccucggcggggcccacguccaguccaacgccaccgagcacaacgggaccaacaccaccaccgugcccgggaccagccaguccccgaagccgcccgcgagcaccacccugccccacacccccgaguccagcaccgugaagcucaccacccccaccuccgagaccgaggggagcggcgagaccacgccgccgcccaacaccacccagggccugcccccgcccgggaccacccccgagcggcccgccaccacggccaccaccaccuccagcacggacaacaugaacuccaccacccaggucaccgacaacacgcccaccagcaccguguccaucagccccuccagcaacccguccaugcccagcaccucccagggcauccacuaccccgugcggagccugcucagcgucuccagccccaagacggugaccacccccacccccaugucccccggggagaugagccccgagacguccagccagcacuccgccaugagccgcaucccgacccuguacaccgccgcccagguguccaccgagaacaccaaccggagcacgccccgccaguccgagagcuccgcccagcccgccacccagagccccaccaccuucccggcccagacgaucccccugauguccgcggcccccaaggccauccaggacaugcacccgagccccaccaaccgguccaagcgcaaccucgaggucgagaucauccugacccugagccagggccucaagaaguacuacgggaagauccugaagcugcuccaccugacccuggaggaggacacggagggccuccuggaguggugcaagcggaaccugggcuccaacugcgacgacgacuucuuccagaagcgcaucgaggaguucuucaucaccggggagggcuacuucaacgaggugcuccaguucaagacccccagcacccugagccccacggagccgucccacgugcggcugcccaccgccgagcccuucaagagcuacuucgccaagggguuccucuccaucgacagcggcuacuucuccgcgaagugcuacccccgcagcuccaccagcggccugcagcugaucaacgucacccagcacccggcccggaucgccgagacgcccgggcccaagaccaccucccucaagaccaucaacugcaucaaccugcgcgccagcguguucaaggagcaccgggagguggagaucaacguccugcucccccagaucgccgugaaccuguccaacugccacguggucaucaacagccacgugugcgacuacucccuggacacggacggcccggugcgccucccccggauccaccacgaggggaccuucauccccggcaccuacaagaucgucaucgacaagaagaacaagcugaacgaccgcugcagccuggugaccaacugcgugaucaaggggcgggagguccgcaagggccaguccgugcuccggcaguacaagacggagaucaagaucggcaaggcgagcaccgggucccgcaagcugcugagcgaggagcccggcgacgacugcaucagccggacccagcuccugaagaccgagacggccgagauccacgacgacaacuacgggggcccgggggacaagaucaccaucugcaacggcuccaccaucgucgaccagcgccugggcagcgagcucgggugcuacaccaucaaccgcgugaaguccuucaagcugugcgagaacagcgccacgggcaagaccugcgagaucgacuccacccccgugaagugccggcagggguucugccugaagaucacccaggagggccgcgggcacgucaagcucagccggggcuccgagguggugcuggacgccugcgacagcuccugcgagaucaugauccccaagggcacgggggacauccuggucgacugcagcggcgggcagcagcacuuccugaaggacaaccucaucgaccugggcugcccccacaucccgcugcucggcaagauggccaucuacaucugccgcauguccaaccacccccggaccaccauggcguuccuguucugguucagcuucggguacgugaucacgugcaucuucugcaaggcccuguucuacucccucaucaucaucggcacccuggggaagaagaucaagcaguaccgcgagcugaagccccagacgugcaccaucugcgagaccgcccccgugaacgccaucgacgccgagaugcacgaccucaacugcagcuacaacaucugcccguacugcgcgucccggcugaccagcgacggccuggcccgccacgucacgcagugccccaagcggaaggagaagguggaggagaccgagcucuaccugaaccuggagcgcauccccuggaucgugcggaagcuccugcaggucuccgagagcaccgggguggcccugaagcgcugcuccuggcucaucgugcugcugguccuccugaccgugagccugagcccggugcaguccgcccccgucggccacggcaagacgaucgagaccuaccagacccgggagggguucaccaacaucugccucuucaugcugggcagcauccuguucaucguguccugccucgugaaggggcuggucgacagcguguccgacagcuucuuccccggccuguccgugugcaagacgugcagcaucggguccaucaacggcuucgagaucgagagccacaagugcuacugcucccucuucugcugccccuacugccgccacugcagcgcggaccgggagauccaccagcugcaccugggcaucugcaagaagcgcaagaccggguccaacgucaugcucgccgugugcaagcggaugugcuucaaggccaccaucgaggccagccgccgggcccugcugauccgcuccaucaucaacaccacguucgugaucugcauccucacccuggcgaucugcgucgugagcaccuccgccguggagauggagaaccugccggccggcaccugggagcgcgaggaggaccucacgaacuucugccaccaggagugccaggucaccgagaccgagugccugugccccuacgaggcccuggugcuccggaagccccuguuccuggacagcaucgugaaggggaugaagaaccuccugaacuccaccagccuggagacgagccucuccaucgaggcccccuggggcgcgaucaacguccagagcaccuucaagccgaccguguccaccgccaacaucgcccugagcugguccagcguggagcaccgcgggaacaagauccuggucacgggccgguccgagagcaucaugaagcucgaggagcgcaccggcguguccugggaccuggggguggaggacgccagcgaguccaagcugcucaccgucagcaucauggaccugucccagauguacagccccguguucgaguaccuguccggcgaccgccagguggaggaguggcccaaggcgaccugcacgggggacugccccgagcgcugcggcugcaccagcagcacgugccuccacaaggaguggccgcacagccggaacuggcgcugcaaccccaccuggugcuggggcgucggcaccggcugcacgugcugcgggguggacgugaaggaccuguucaccgaccacauguucaucaaguggaaggucgaguacaucaagaccgaggcgaucgugugcguggagcugaccucccaggagcggcagugcagccucaucgaggccggcacgcgcuucaaccuggggcccgucaccaucacccugagcgagccccggaacauccagcagaagcucccgcccgagaucaucacccugcaccccaagaucgaggagggcuucuucgaccugaugcacgugcagaaggugcucuccgccagcacggucugcaagcugcaguccugcacccacggcauccccggggaccugcagaucuaccacaucggcaaccuccugaagggggaccgccugaacggccaccucauccacaagaucgagccgcacuucaacaccagcuggauguccugggacgggugcgaccuggacuacuacugcaacaugggcgacuggcccagcugcaccuacacgggcgugacccagcacaaccacgccgcguucgucaaccugcucaacaucgagaccgacuacaccaagacguuccacuuccacuccaagcgggugaccgcccacggggacacgccccagcuggaccugaaggcccgccccaccuacggcgccggggagaucacggugcucgucgagguggccgacauggagcugcacaccaagaagguggaggucagcggccugaaguucgcgucccucgccugcaccgggugcuacgccugcagcuccggcaucagcugcaaggugcggauccacguggacgagccggacgagcugaccguccacgugaaguccagcgaccccgacguggucgccgccuccacgagccugauggcgcgcaagcucgaguucggcaccgacuccaccuucaaggccuucagcgccaugcccaagaccucccugugcuucuacaucguggagcgggaguacugcaagagcugcagcgaggacgacacgaagaagugcguggacaccaagcuggagcagccccaguccauccucaucgagcacaaggggaccaucaucggcaagcagaacgacacgugcacggccaaggccagcugcuggcuggaguccgucaagagcuucuucuacgggcugaagaacaugcucggcuccguguucgggaacuucuucgugggcauccugcuguuccucgcgccguucguccugcuggugcuguucuucaucuucggcuggaagauccucuucugcuucaagugcugccgccggacccgcgggcuguucaaguaccggcaccugaaggacgacgaggagaccggcuaccgcaagaucaucgagcgccucaacagcaagaaggggaagaaccggcugcuggacggcgagcgccucgccgaccggaagaucgccgagcuguucuccaccaagacgcacaucggcuga

SEQ ID NO: 12042 - RNA, 5052 nt, Artificial Sequence
  derived and/or modified CDS sequence (opt1) from CCHFV(Turkey200310849)__DQ211636.1__GP
augcacacccugcucgugugcuucauccuguaccugcagcuccugugccugggcggggcccacggccagcucaacaccacggagcacaacgggaccaacaacaccaccgcccccggcgcgagccaguccccgaagccccccaugagcacgacccccccgcacgcccccgaguccagcaccaucaagcccaccacgcccaucuccgaggccgaggggagcggcgagaccaccuccaccccgaacacgacccagggccugagcucccccgagaccaccagcgagcgccccgccacgaccgccaucuccaccagcuccaccgacagcacgaaccccaccacccagaugaccgacaacacgccgacccugaccgucuccaccagccccuccagcucccccagcacgcccagcaccccgcaggggaucuaccaccccgcgcggucccuccugagcguguccagccccaagaccgugaccacgcccaccccgaccucccccggcgagaugagcuccgagaccagcucccagcacagcgccaugucccgcauccccacgccccacaccgccacccgggucagcaccgagaacaccaaccacuccacgccgcgccagagcgaguccagcgcccagcagaccacccccucccccaugaccagccccgcgcaguccauccugcucaugagcgccgccccgacggccgugcaggacauccaccccagccccaccaaccgguccaagcgcaaccuggagaccgagaucauccugacccucagccaggggcugaagaaguacuacggcaagauccugaagcuccugcaccugacgcucgaggaggacaccgaggggcugcuggaguggugcaagcggaaccucggcuccaacugcgacgacgacuucuuccagaagcgcaucgaggaguucuucaugaccggcgagggguacuucaacgaggugcugcaguucaagacccugagcacgcucuccccgaccgagcccagccacgcccggcugcccaccgcggagcccuucaaguccuacuucgccaagggcuuccugagcaucgacuccggguacuucagcgccaagugcuacccgcgcuccagcgccuccggccuccagcugaucaacgucacccagcaccccgcccggaucgcggagacgcccggccccaagaccaccagccugaagaccaucaacugcaucaaccuccgcgccuccguguucaaggagcaccgggagaucgagaucaacgugcugcugccgcagaucgccgucaaccucagcaacugccacguggugaucaacucccacgucugcgacuacagccuggacacggacgggcccgugcgccugccccggaucuaccacgagggcaccuucauccccgggaccuacaagaucgugaucgacaagaagaacaagcucaacgaccgcugcacccuggucacgaacugcgugaucaagggccgggaggugcgcaaggggcagagcguccugcggcaguacaagaccgagaucaagaucggcaaggccuccaccggcuuccgcaagcuccugagcgaggagccgggggacgacugcaucucccggacccagcugcuccgcacggagaccgccgagauccacgacgacaacuacggcgggcccggcgacaagaucaccaucugcaacgggagcaccaucguggaccagcgccugggcuccgagcugggcugcuacacgaucaaccgggugaagagcuucaagcucugcgagaacuccgcgaccgggaagaccugcgaggucgacagcacccccgugaagugccgccagggcuucugccugaagaucacgcaggaggggcggggccacgugaagcugucccgcgggagcgaggucgugcuggacgccugcgacuccagcugcgaggucaugauccccaagggcaccggcgacauccucguggacugcuccgggggccagcagcacuuccugaaggacaaccugaucgaccucgggugcccgcacaucccccugcugggcaagauggccaucuacaucugccggaugagcaaccacccccgcaccaccauggccuuccucuucugguucuccuucggcuacgugaucaccugcaucagcugcaaggcccuguucuacucccugaucaucaucgggacgcucggcaagaagaucaagcaguaccgggagcugaagccccagaccugcaccaucugcgagaccgcgccggucaacgccaucgacgccgagaugcacgaccugaacugcagcuacaacaucugccccuacugcgccucccgccucacgagcgacgggcuggcgcggcacgugacccagugccccaagcgcaaggagaagguggaggagaccgagcuguaccucaaccuggagcggauccccuggaucguccgcaagcugcuccaggugagcgaguccaccggcguggcccugaagcggagcuccuggcugaucguccuccuggugcugcucacggugagccuguccccgguccagagcgcccccguggggcacggcaagaccaucgagaucuaccagacccgcgagggcuucgccuccaucugccuguucaugcucgggagcauccuguucaucguguccugccuggucaagggccucguggacagcguguccgacagcuucuuccccgggcuguccgucugcaagaccugcagcaucggcuccgugaacggguucgagaucgagagccacaagugcuacugcucccuguucugcugcccguacugccggcacugcagcgccgaccgcgagauccaccagcuccaccuguccaucugcaagaagcggaagacgggcagcaacgugaugcuggcggucugcaagcgcaugugcuuccgggccaccaucgaggccagccgccgcgcccuccugauccgguccaucaucaacaccaccuucgugaucugcauccugacgcucaccaucugcguggucagcaccuccgccguggagauggagaaccugcccgcgggcaccugggagcgcgaggaggaccugacgaacuucugccaccaggagugccaggugaccgagaccgagugccucugccccuacgaggcccugguccugcggaagccccucuuccuggacagcaucgugaaggggaugaagaaccugcucaacuccaccagccuggagacgucccugagcaucgaggccccguggggcgccaucaacgugcaguccaccuucaagcccgccgucagcaccgcgaacaucgcccucuccuggagcuccguggagcaccgcgggaacaagauccuggugaccggccggagcgaguccaucaugaagcuggaggagcgcacgggggucagcugggaccucggcguggaggacgccuccgagagcaagcugcugaccguguccaucauggaccucagccagauguacagccccgucuucgaguaccuguccggcgaccggcagguggaggaguggcccaaggccaccugcaccggggacugcccggagcgcugcggcugcacgagcuccaccugccugcacaaggaguggccccacagccggaacuggcgcugcaaccccaccuggugcuggggggugggcaccgggugcacgugcugcggcgucgacgugaaggaccucuucaccgaccacauguucgugaaguggaaggucgaguacaucaagaccgaggcgaucgugugcguggagcugaccucccaggagcggcagugcagccugaucgaggccggcacccgcuucaaccucgggcccgucacgaucacccuguccgagccgcggaacauccagcagaagcugccccccgagaucaucacccuccaccccaagaucgaggagggcuucuucgaccugaugcacgugcagaaggugcugagcgccuccaccgucugcaagcuccagagcugcacgcacgggaucccgggcgaccugcagguguaccacaucggcaaccugcucaagggggaccgcgugaacggccaccugauccacaagaucgagucccacuucaacaccagcuggauguccugggacgggugcgaccuggacuacuacugcaacaugggcgacuggcccagcugcaccuacaccggggucacgcagcacaaccacgccgccuucgugaaccuccugaacaucgagaccgacuacaccaagaccuuccacuuccacuccaagcgggucacggcgcacggcgacaccccccagcuggaccucaaggcccgccccaccuacggcgccggggagaucaccgugcugguggaggucgccgacauggagcugcacacgaagaagguggagaucagcggccucaaguucgccucccuggcgugcaccgggugcuacgccugcagcuccggcaucagcugcaaggugcggauccacgucgacgagccggacgagcugaccgugcacgugaagagcuccgaccccgacgucguggccgccagcaccucccucauggcccgcaagcuggaguucgggacggacagcaccuucaaggcguucuccgccaugcccaagaccagccugugcuucuacaucguggagcgggaguacugcaaguccugcagcgaggacgacacccagaagugcgucgacacgcgccucgagcagccccaguccauccugaucgagcacaagggcaccaucaucggcaagcagaacgacaccugcaccgccaaggccagcugcuggcuggaguccgugaagagcuucuucuacgggcucaagaacaugcugggcuccguguucgggaaccuguucaucggcauccuccuguuccuggcgccguucguccugcucgugcuguucuucauguucggguggaagauccuguucugcuucaagugcugccggcgcacgcgcggccucuucaaguaccggcaccugaaggacgacgaggagaccggcuaccgccggaucaucgagcgccugaacagcaagaaggggaagaaccggcuccuggacggcgaccgccuggccgaccggaagaucgccgagcucuucuccaccaagacccacaucggguga

SEQ ID NO: 12043 - RNA, 5052 nt, Artificial Sequence
  derived and/or modified CDS sequence (opt1) from CCHFV(5170-R-2011)__KR814873.1__GP
augcacacccugcucgugugcuucauccuguaccugcagcucagcggccuggggggcgcccacgggcaguccaacgagaccgagcacaacggcacgaacaccaccaccguccccgggacgagccaguccccgaagccccccgccagcaccacccugcagcacacccccgaguccagcacggugaagcucaccaccccgaccuccgagacggagggcagcggcgagaccacccccccccccaacaccacgcaggggcugccgccccccggcaccacccccgagcgcuccgcgaccacggccaccagcaccuccagcaccgacaacaugaacuccacgacccaggugaccgacaacaccccgacgagcaccgucuccaucagccccuccagcucccccagcaugcccagcaccucccaggggauccacuacccgauccggagccugcucuccgugagcucccccaagaccgugacgacccccacccccaucagcccgggcgagaugucccccgagaccagcucccagcacagcgccaugucccgcauccccacgcuguacaccgccacccaggucagcaccgagaacaccaaccgguccacgccccgccagagcgaguccagcgugcagccggccacccagucccccaucaccagccccgcgcagaccauccugcucauguccgccgcccccaaggccauccaggacaugcacccgagccccacgaaccggagcaagcgcaaccuggagguggagaucauccugacccucucccaggggcugaagaaguacuacggcaagauccugaagcuccugcaccugacccucgaggaggacaccgagggccugcuggaguggugcaagcggaaccucgggagcaacugcgacgacgacuucuuccagaagcgcaucgaggaguucuucaucacgggcgagggguacuucaacgagguccugcaguucaagacccuguccacccucagccccaccgagcugucccacgugcggcugccgacggcggagcccuucaagagcuacuucgccaagggcuuccucuccaucgacagcggcuacuucuccgccaagugcuacccccgcagcuccaccagcgggcugcagcugaucaacgugacccagcaccccgcccggaucgccgagaccccgggccccaagacgaccucccucaagaccaucaacugcaucaaccugcgcgcgagcgucuucaaggagcaccgggagguggagaucaacgugcugcucccccagaucgccgucaaccuguccaacugccacguggugaucaacagccacgucugcgacuacucccuggacaccgacgggcccgugcgccucccgcggauccaccacgagggcacguucauccccgggaccuacaagaucgugaucgacaagaagaacaagcugaacgaccgcugcagccuggucaccaacugcgugaucaagggccgggaggugcgcaagggccagagcguccuccggcaguacaagaccgagaucaagaucgggaaggccuccacgggcagccgcaagcugcuguccgaggagcccggggacgacugcaucagccggacccagcuccugaagaccgagaccgccgagauccacgacgacaacuacggcgggcccggcgacaagaucacgaucugcaacggcuccaccaucguggaccagcgccuggggagcgagcucggcugcuacaccaucaaccgcgucaaguccuucaagcugugcgagaacagcgccaccgggaagacgugcgagaucgacuccaccccggugaagugccggcagggcuucugccugaagaucacccaggaggggcgcggccacgugaagcugagccggggcuccgaggucgugcucgacgugugcgacagcuccugcgagaucaugauccccaaggggaccggcgacauccuggucgacugcagcgggggccagcagcacuuccugaaggacaaccucaucgaccugggcugcccccacaucccccugcucgggaagauggcgaucuacaucugccgcauguccaaccacccgcggacgaccauggccuuccuguucugguucagcuucggcuacgugaucaccugcaucuucugcaaggcccuguucuacucccucaucaucaucgggacccugggcaagaagaucaagcaguaccgcgagcugaagccccagaccugcacgaucugcgagaccgcccccgugaacgccaucgacgcggagaugcacgaccucaacugcagcuacaacaucugccccuacugcgccucccggcugaccagcgaggggcuggcccgccacgucacccagugcccgaagcggaaggagaagguggaggagacggagcucuaccugaaccuggagcgcauccccuggaucgugcggaagcuccugcaggucagcgaguccaccggcguggcccugaagcgcagcuccuggcucaucgugcugcugguccuccugaccgugagccugucccccgugcagagcgcccccgucggccacgggaagaccaucgagacguaccagacccgggagggcuucaccuccaucugccucuucaugcuggggagcauccuguucaucguguccugccucgugaagggccuggucgacagcguguccgacagcuucuucccggggcuguccgugugcaagaccugcagcaucggcuccaucaacggcuucgagaucgagagccacaagugcuacugcucccucuucugcugccccuacugccgccacugcagcgcggaccgggagauccaccagcugcaccuguccaucugcaagaagcgcaagacggggagcaacgucaugcucgccgugugcaagcggaugugcuucaaggccaccaucgaggccagccgccgggcgcugcugauccgcuccaucaucaacaccaccuucgugaucugcauccucacgcuggccaucugcgucgugagcaccuccgccguggagauggaggaccugcccgccggcaccugggagcgcgaggaggaccucaccaacuucugccaccaggagugccaggucacggagaccgagugccugugcccguacgaggcccuggugcuccggaagccccuguuccuggacagcaucgugaaggggaugaagaaccuccugaacuccaccagccuggagaccucccucagcaucgaggcgcccuggggcgccaucaacguccaguccacguucaagcccaccgugagcaccgccaacaucgcccuguccuggagcuccguggagcaccgcgggaacaagauccuggucaccggccggagcgaguccaucaugaagcucgaggagcgcacgggcgugagcugggaccuggggguggaggacgccuccgagagcaagcugcucaccgucuccaucauggaccugagccagauguacagcccgguguucgaguaccuguccggcgaccggcagguggaggaguggcccaaggcgaccugcaccggggacugccccgagcgcugcggcugcacgagcuccaccugccuccacaaggaguggccccacagccggaacuggcgcugcaacccgaccuggugcuggggggucggcaccggcugcacgugcugcgggguggacgugaaggaccuguucaccgaccacauguucaucaaguggaaggucgaguacaucaagaccgaggccaucgugugcguggagcugaccucccaggagcggcagugcagccucaucgaggccggcacccgcuucaaccuggggcccgucacgaucacccuguccgagccccggaacauccagcagaagcuccccccggagaucaucacccugcaccccaagaucgaggagggcuucuucgaccugaugcacgugcagaaggugcucagcgccuccaccgucugcaagcugcagagcugcacgcacggcauccccggggaccugcagaucuaccacaucggcaaccuccugaagggggaccgcgugaacggccaccugauccacaagaucgagccccacuucaacaccuccuggaugagcugggacgggugcgaccucgacuacuacugcaacaugggcgacuggccguccugcaccuacaccggcgucacgcagcacaaccacgccgcguucgugaaccugcugaacaucgagaccgacuacaccaagaccuuccacuuccacagcaagcgggugacggcccacggggacaccccccagcucgaccugaaggcccgccccaccuacggcgccggggagaucaccguccugguggagguggcggacauggagcuccacacgaagaaggucgagaucuccggccugaaguucgccagccugaccugcaccgggugcuacgccugcuccagcggcaucuccugcaaggugcggauccacguggacgagcccgacgagcucaccguccacgugaagagcagcgacccggacguggucgccgccuccacgagccugauggcgcgcaagcuggaguucggcaccgacuccaccuucaaggccuucagcgccaugcccaagaccucccucugcuucuacaucguggagcgggaguacugcaagagcugcuccgaggacgacacgaagaagugcguggacaccaagcuggagcagccccagagcauccugaucgagcacaaggggaccaucaucggcaagcagaacgacaccugcacggccaaggccuccugcuggcucgagagcgucaaguccuucuucuacgggcugaagaacaugcugggcagcguguucggguccuucuucgugggcauccuccuguuccuggcgcccuucguccugcucgugcuguucuucauguucggcuggaagauccuguucugcuucaagugcugccgccggacccgcgggcucuucaaguaccggcaccugaaggacgacgaggagaccggcuaccgccgcaucaucgagcggcugaacagcaagaaggggaagaaccgccuccuggacggcgagcggcuggccgaccgcaagaucgccgagcucuucuccaccaagacgcacaucggcuga

SEQ ID NO: 12044 - RNA, 5055 nt, Artificial Sequence
  derived and/or modified CDS sequence (opt1) from CCHFV(SCT ex Afghanistan)__KC344856.1__GP
auguacacccugcucgugugcgccauccugugcccccagccguggagccuggagggcacccacgucccccucaacgggacgaagcacaacggcaccgggaucaccgccgcgcccggcgggucccagggccccaccagcccggccuccacggccgugagccugacccccgaccccuucaccaccgagcccacggccuccgccguggagcuggagagcuccggcgaggggcacaccagccucuccgucaccacccagggccugacgagcccggagaccacccccgggcugcccaccgugacggacaccggcguguccagcaccuccaucuucgggaucggcauccgcgucgcgggcgacacccccacgagcaccacccacaccgggcucccguccagccccuccaugcccagcacggcccagggcccccaccacgccgugcgggggcugcuguccgugagcagcacccgcccgggcgaggccuccaccaucaccguccccggcgaggcggggacggaggccaacagcuccagcuccgccaucagcaagaagcccgcccccuccccgaccgccgaggcgaucaccgaggccaacaacagcuccaacccccggcagcccgagcucagcacccagcccgccaucccgggccuggugacguccagcgcccagcccauccugcuccaguccgccaccagcaccgcggcccaggacaucuaccccucccccaccaaccgcagcaagcggaaccuggagauggagaucauccugacgcucucccaggggcugaagaaguacuacggcaagauccugcgcauccucgaccugacccuggaggaggacaccgaggggcuccuggaguggugcaagcggaaccugggccugaccugcaacgacaacuucuuccaggagcgcaucgaggaguucuuccugaccggcgaggggcacuucaacgaggugcugcaguucaagacgccgagcacccucucccccaccgagcccacccacacgcggaccccgaccgucaagcccuucaagagcuacuucgcccgcggcuuccugagcaucgacuccggguacuucagcgccaagugcuacuccaagaccagcaacuccggccugcagcucaucaacaucacgcagcaccccgcccggaucgcggacacccccgggccgaagaucaccaaccugaaggccaucaacugcaucaaccugaaggccagcguguucaaggagcaccgcgagaucgagaucaacgugcuccugccccaggucgccgugaaccuguccaacugccacgugcucaucaagagccacgucugcgacuacucccuggacaucgacggcgccgugcggcugccccacgugcaccacaagggcaccuucauccccgggacguacaagaucgucaucgacaagcgcaacaagcagaacgaccggugcacccucgugaccaacugcgugaucaagggcaaggagauccgcaaggggcagagcgcgcugcggcaguaccgcaccgagauccggaucggcaaggccuccgccgggagccgccggcugcucuccgaggagagcggcgacgacugcaucucccgcacgcagcugcugcgcaccgagaccgccgagguccacaacgacaacuacggcgggccgggcgacaagaucaccaucugcaacgggagcacgaucguggaccagcggcucggcuccgagcugggcugcuacaccaucaaccgcgucaagagcuucaagcugugcgagaacagcgcgaccgggaaguccugcaagaucgacagcacccccgugaagugccggcagggcuucugccugaagaucacgcaggaggggcgcggccacgugaagcucucccgggggagcgaggucgugcuggacgccugcgacuccagcugcgagaucaugauccccaagggcaccggcgacauccugguggacugcuccgggggccagcagcacuuccucaaggacaaccugaucgaccuggggugccccaacaucccgcuccugggcaagauggccaucuacaucugccgcaugagcaaccaccccaagaccaccauggccuuccuguucugguucuccuucggguacgucaucacgugcaucuucugcaaggugaucuucuaccuccugaucguggucggcacccugggcaagaaguucaagcaguaccgggagcucaagccccagaccugcaccaucugcgagacgacccccaccaacgccaucgacgcggagaugcacgaccugaacugcagcuacaacaucugcccguacugcgccucccgccugaccagcgacgggcucgcccggcacgugacgcagugccccaagcgcaaggagaagguggaggagaccgagcuguaccugaaccucgagcggauccccuggaucguccgcaagcugcuccagguguccgagagcaccggcguggcccucaagcgguccagcuggcugaucguccugcucgugcugcugaccgugucccucagccccguccaguccgccccgaucgggcacggcaagaccaucgagacguaccagacccgcgagggguacaucagcgugugccuguucgugcugggcggcauccucuucgucgugagcugccugaucaaggggcugguggacuccgucggcaacagcuucuuccccgggcucuccaucugcaagaccugcagcaucggcuccgugaacggguucgagaucgagagccacaagugcuacugcucccugcugugcugccccuacugccggcacugcagcaccgaccgcgagauccaccagcuccaccuguccaucugcaagaagcggcgcacgggcggcaacgugaugcuggcggucugcaagcggaugugcuuccgcgccaccauggaggugagcaacaagguccucuucauccgcaacaucaucaacaccaccuucgugaucugcauccugauccuggccgugugcguggucuccacgagcgccguggagauggagucccuccccgccgggaccugggagcgggaggaggaccugaccaacuucugccaccaggagugccaggugaccgagacggagugccugugcccguacgaggcgcucguccugcgcaagccccuguuccucaacagcaucgugaagggcaugaagaaccugcugaacuccaccaaccucgagaccagccuguccaucgaggcccccuggggcgccaucaacgugcagagcaccuucaagccgacggucuccaccgccaacaucgcgcugagcuggagcuccguggagcaccgggggaacaagauccucgugagcggccgcuccgagagcaucaugaagcuggaggagcggaccgggaucuccugggaccugggcgucgaggacgccagcgaguccaagagccucaccguguccgugauggaccugagccagauguacucccccgucuucgaguaccugagcggggaccgccagguggaggaguggcccaaggccacgugcaccggcgacugccccgagcggugcgggugcaccuccagcacgugccuccacaaggaguggccgcacucccgcaacuggcggugcaaccccaccuggugcuggggcgugggcaccgggugcacgugcugcggccuggacgucaaggaccuguucaccgacuacauguucgugaaguggaagguggaguacaucaagaccgaggccaucgucugcguggagcucaccagccaggagcgccagugcucccugaucgaggccgggacccgguucaaccugggccccgucaccaucacgcucagcgagccccgcaacauccagcagaagcugccgcccgagaucaucacccugcacccccggaucgaggagggguucuucgaccucaugcacgugcagaaggugcuguccgcgagcaccgucugcaagcugcagagcugcacccacggcgugcccggcgaccuccagguguaccacaucgggaaccugcugaagggcgacaagcucaacgggcacaugauccacaagaucgagccgcacuucaacacguccuggaugagcugggacggcugcgaccuggacuacuacugcaacaugggggacuggcccuccugcaccuacaccggcgucacccagcacaaccacgccgccuucgugaaccugcucaacaucgagaccgacuacacgaagaacuuccacuuccacagcaagcgcgugaccgcccacggcgacacgccccagcuggaccugaaggcccggcccaccuacggggcgggcgagaucaccguccucguggagguggccgacauggagcugcacaccaagaagaucgacaucuccgggcugaaguucgccagccugaccugcgccggcugcuacgccugcuccagcggcaucuccugcaagguccgcauccacguggacgagccggacgagcucaccgugcacgucaagagcgaggaccccgacaucguggcggccuccacgagccugaucgcccggaagcucgagcuggggaccgacuccaccuucaaggccuucagcgcgaugcccaagaccucccugugcuucuacaucguggagcgcgaguacugcaagagcugcuccaaggaggacacgcagaagugcgucaacaccaagcucgagcacccccagggcauccugaucgagcacaaggggaccaucaucggcaagcagaacgacacgugcaccgccaaggccgggugcuggcuggagagcgugaaguccuucuucuacggccucaagaacaugcugagcggcaucuucgggaacguguucaucggcaucuuccuguuccuggccccguucguccuccugauccuguucuucauguucggguggcggcuccuguucugcuucaagugcugccgccggacccgcggccuguucaaguaccgccaccucaaggaggacgaggagagcggguaccggcgcaucaucgagcggcugaacaacaagaagggcaagaacaagcugcucgacggcgagcgccuggccgaccggcgcaucgcggagcuguucuccaccaagacccacaucggguga

SEQ ID NO: 12045 - RNA, 5055 nt, Artificial Sequence
  derived and/or modified CDS sequence (opt1) from CCHFV(SPU 44/08)__KJ682805.1__GP
auguacacgccccugcucugcgccauccugugccugcagcucuggagccuggagggcaucuacgggcuguccaacaacacccagcacaacgacaccagcaccaucaaggugccggaggagucccagaagaccagccuccccgccaacaccgcgucccccaucacgagcgacccgccgcccaccacccccaccgccuccgccagcggccccgagggguccggcgacacgagcaccuccccgcccgucaccacccaggggcccacgcccccggagaccacccccgagccccacaccacgaucgacaucgacaagagcuccaccgccaucgccgacaucagcacccagaccgugaagaacauccccacgccgaccgcgcacaccucccugcccagcacccuguccgcccccacgaugccccaggaggcccaccacaccgcccgcggccuccugagcgugaccuccaccaagccgggcgaggcgagcacgcccaccagccccggggaggccuccaccgaggccagcagcccccagccgaccauccgggagacgcccuccccgccgcccaccacccagacccccacggagaucaacaaccccaacaccucccgccagcccaugcccagcacccagcccgccgcccccuccagcgucacccaccccgcgcagcccacccccucccagagcgacgugcccacggccgcccaggacauccacccgucccccaccaaccggagcaagcgcaaccuggagauggagaucauccucacccugucccagggccugaagaaguacuacgggaaggugcucaagcugcuggaccucacccuggaggaggacacggagggccugcucgaguggugcaagcggaaccuggggcugaccugcgacgacaacuucuuccagaagcgcaucgaggaguucuuccucaccggcgagggccacuucaacgagguccugcaguucaagacccccagcacgcugucccccaccgagccggcccggguggagagccccaccguggagcccuucaaguccuacuucgccaagggguuccuccugauggacagcggcuacuucuccgcgaagugcuaccccaagagcagcaacuccgggcugcagcucaucaacgucacccagcaccugauccgcaucacggacaccccgggccccaagaucaccaaccugaagaccaucaacugcaucaaccucaaggcccugguguucaaggagcaccgggagaucgagaucaacgugcugcucccccaggucgccgugaaccugagcaacugccacgugcugaucaagucccacgucugcgacuacagcaucgacaucgacggccccgugcgccucccgcggauccaccacgaggggacguucauccccggcaccuacaagaucgugaucgacaagaagaacaagcagaacgaccgcugcacccuggucaccaacugcgugaucaaggggcgggagauccgcaagggccaguccgugcugcggcaguaccgcacggagaucaagaucgggaaggccagcuccggcagccggcgccuccuguccgaggagagcaacgacgacugccugucccggacccagcuccugcgcaccgagaacgccgagauccacagcgacaacuacggcgggcccggcgacaagaucaccaucugcaacggguccacgaucgucgaccagcggcugggcagcgagcucgggugcuacaccaucaaccgcgugaaguccuucaagcugugcgagaacagcgcgaccggcaaguccugcgagaucgacagcacccccgugcgcugccggcagggcuucugccugaagaucacgcaggaggggcgcggccacgucaagcugagccggggguccgaggugguccucgacgccugcgacagcuccugcgagaucaugaucccgaagggcaccggggacauccugguggacugcagcggcggccagcagcacuuccugaaggacaaccucguggaccuggggugccccaacaucccccugcucggcaagauggccaucuacaucugccgcauguccaaccacccgaagaccaccauggccuuccuguucugguucagcuucggguacgucaucacgugcauccugugcaaggccaucuucuaccuccugaucguggugggcacccugggcaagaaguucaagcaguaccgggagcucaagccccagaccugcaccaucugcgagacgaaccccgucaacgcgaucgacgccgagaugcacgaccugaacugcuccuacaacaucugccccuacugcgccagccgccugaccuccgacgggcucgcccggcacgugaugcagugcccgaagcgcaaggagaagaucgaggagaccgagcuguaccugaaccucgagcggauccccugggugguccgcaagcugcuccaggugagcgaguccaccggcguggcgcucaagcggagcuccuggcuggucauccugcucgugcugcugaccgugagccucucccccguccagagcgcccccaucucccacggggagacgguggagguguaccagacccgcgagggcuacaccagcaucugccuguucguccugggguccauccucuuccuggugagcugccugaugcggggccucguggacagcgucuccaacagcuucuucccgggccuguccaucugcaagaccugcagcaucggguccaucaacggcuucgagaucgagagccacaagugcuacugcucccuguucugcugccccuacugccgccacugcagcgccgacaucgagauccacaagcuccaccuguccaucugcaagaagcggaagacggggagcaacgugaugcuggccgugugcaagcgcaugugcuuccgggccaccgucgagguguccaacaaggcgcuccugauccgcaacaucaucaacaccaccuucguggucugcauccugauccucgccgugugcguggucagcacguccgccguggagauggagaaccugcccgccggcaccugggagaaggaggaggaccugaccaacuucugccaccaggagugccaggugaccgagacggagugccucugccccuacgaggcccugguccugcggaagccccucuuccuggacagcaucgugaaggggaugaagaaccugcucaacuccaccagccuggagaccucccugagcaucgaggcgccguggggcgccaucaacgugcaguccaccuucaagcccacggucagcgccgccaacaucgcccucagcugguccagcguggagcaccgcggcaacaagauccugguguccgggcgcagcgaguccaucaugaagcuggaggagcggaccggcaucagcugggaccucggggucgaggacgcguccgagagcaagcugcugaccguguccgugauggaccucagccagauguacucccccgucuucgaguaccugagcggcgaccgccagguggaggaguggccgaaggcgaccugcacgggggacugccccgagcggugcggcugcaccuccuccacgugccugcacaaggaguggccccacagccgcaacuggcggugcaaccccaccuggugcuggggcguggggaccggcugcacgugcugcgggcucgacgucaaggaccuguucaccgacuacauguucgugaaguggaagguggacuacaucaagaccgaggccaucgucugcguggagcugaccagccaggagcgccagugcucccucaucgaggccggcacccgguucaaccuggggccggugaccaucacccugagcgagccccgcaacauccagcagaagcucccgcccgagaucgucacgcugcacccccggaucgaggagggcuucuucgaccugaugcacauccagaaggugcucuccgccagcaccgucugcaagcugcagagcugcacccacggcgugcccggggaccugcagaucuaccacaucggcaaccuccugaagggggacaaggugaacggccaccugauccacaagaucgagccccacuucaacaccuccuggaugagcugggacggcugcgaccucgacuacuacugcaacaugggggacuggcccuccugcagcuacacgggcgucacccagcacaaccacgccgccuucgugaacaugcugaacaucgagaccgacuacaccaagaacuuccacuuccacuccaagcgcgugaccgcccacggggacacgccgcagcuggaccucaaggcccggcccaccuacggcgcgggggagaucaccguccugguggagguggccgacauggagcugcacaccaagaagaucgagaucagcggccucaaguucgccucccugacgugcaccggcugcuacgccugcagcuccgggaucagcugcaagguccgcauccacguggacgagcccgacgagcugaccgugcacgucaaguccgaggacccggacaucguggccgcgagcuccagccucauggcccggaagcuggaguucggcaccgacuccacguucaaggccuucagcgccaugcccaagaccucccugugcuucuacaucguggagcgcgaguacugcaagagcugcuccaaggaggacacccagaagugcgucaacaccaagcucgagcagccccagagcauccugaucgagcacaaggggacgaucaucggcaagcagaacgacacgugcaccgccaaggcgagcugcuggcuggaguccaucaagagcuucuucuacgggcucaagaacaugcuguccggcaucuucggcaacguguucaucgggaucuuccuguuccuggcccccuucaucaugcucauccuguucuucauguucggcuggcggauccuguucugcuucaagugcugccgccggacccgcggccucuucaaguaccggcaccugaaggacgacgaggagaucggguaccgcaagaucaucgagcggcugaacaacaagaaggggaagaacaagcuccuggacggcgagcgccuggccgaccgcaagaucgccgagcuguucagcaccaagacccacaucggcuga

SEQ ID NO: 12046 - RNA, 5052 nt, Artificial Sequence
  derived and/or modified CDS sequence (opt1) from CCHFV(K323_27)__KX013472.1__GP
augcacacccugcucgugugcuucauccuguaccugcagcucagcggccucgggggcgcccacgggcaguccaacgccaccgagcacaacggcacgaacaccaccaccguccccgggacgagccaguccccgaagccgcccgcgagcaccacccugccccacacccccgaguccagcacggugaagcucaccacccccaccuccgagacggagggcagcggcgagaccaccccgccgcccaacaccacgcaggggcugccccugcccggcaccacccccgagcgcuccgccaccacggccaccagcaccuccagcaccgacaacaugaacuccacgacccaggugaccgacaacacccccacgagcaccgucuccaucagccccuccagcucccccagcaugcccagcaccucccaggggauccaccacccggugcggagccuccuguccgugagcucccccaagaccgucacgacccccacccccaugagcccgggcgagaugucccccgagaccagcucccagcacagcgccaugucccgcauccccacgcuguacaccgccacccaggugagcaccgagaacaccgaccgguccacgccccgccagagcgaguccagcgugcagccggcgacccagucccccaucaccagccccgcccagaccauccuccugauguccgccgcccccaaggcgauccaggacaugcacccgagccccacgaaccggagcaagcgcaaccuggaggucgagaucauccucacccugucccaggggcugaagaaguacuacggcaagauccucaagcugcugcaccucacccuggaggaggacaccgagggccugcucgaguggugcaagcggaaccuggggagcaacugcgacgacgacuucuuccagaagcgcaucgaggaguucuucaucacgggcgagggguacuucaacgaggugcugcaguucaagacccucuccacccugagccccaccgaguccagccacgugcggcugccgacggccgagcccuucaaguccuacuucgccaagggcuuccucagcaucgacuccggcuacuucagcgccaagugcuacccccgcuccagcaccuccgggcugcagcugaucaacgucacccagcaccccgcccggaucgcggagaccccgggccccaagacgaccagccucaagaccaucaacugcaucaaccugcgcgccuccguguucaaggagcaccgggagguggagaucaacguccugcucccccagaucgccgugaaccugagcaacugccacguggucaucuccagccacgugugcgacuacagccuggacaccgacgggcccgugcgccucccgcggauccaccacgagggcacguucauccccgggaccuacaagaucgucaucgaccgcaaggacaagcugaacgaccggugcucccuggugaccaacugcgugaucaagggccgcgagguccggaagggccagagcgugcuccgccaguacaagaccgagaucaagaucgggaaggccuccacgggcagccggaagcugcuguccgaggagcccggggacgacugcaucagccgcacccagcuccugaagaccgagaccgccgagauccacgacgacaacuacggcgggcccggcgacaagaucacgaucugcaacggcuccaccaucgucgaccagcgccuggggagcgagcucggcugcuacaccaucaaccgggugaaguccuucaagcugugcgagaacagcgcgaccgggaagacgugcgagaucgacuccaccccggugaagugccgccagggcuucugccugaagaucacccaggaggggcggggccacgucaagcugagccgcggcuccgagguggugcucgacgccugcgacagcuccugcgagaucaugauccccaaggggaccggcgacauccuggucgacugcagcgggggccagcagcacuuccugaaggacaaccucaucgaccugggcugcccccacaucccccugcucgggaagauggccaucuacaucugccggauguccaaccacccgcgcacgaccauggccuuccuguucugguucagcuucggcuacgugaucacgugcaucuucugcaaggcccuguucuaccuccugaucaucaucgggacccugggcaagaagaucaagcaguaccgggagcucaagccccagaccugcaccaucugcgagaccgcgcccgugaacgccaucgacgccgagaugcacgaccugaacugcuccuacaacaucugccccuacugcgccagccgccugaccagcgacgggcucgcccggcacgucacccagugcccgaagcgcaaggagaagguggaggagacggagcuguaccugaaccucgagcggauccccuggaucgugcgcaagcugcugcaggucuccgagagcaccggcguggcgcucaagcgguccagcuggcugaccgugcugcucguccugcugaccgugucccucagccccgugcaguccgcccccgucggccacgggaacacgaucgagaccuaccagacccgcgagggcuucaccagcaucugccuguucaugcugggguccauccucuucaucgugagcugccuggugaagggccuggucgacuccgugagcgacuccuucuucccggggcucagcgugugcaagacgugcuccaucggcagcaucaacggcuucgagaucgagucccacaagugcuacugcagccuguucugcugcccccacugccggcaccgcuccgccgaccgggagauccaccagcugcaccucagcaucugcaagaagcgcaagaccgggagcaacgucaugcuggccgugugcaagcggaugugccccaaggcgaccaucgaggccucccgccgcgcccugccgauccggagcaucaucaacaccacgcucgugaugugcauccugacccuggccaucugcgucguguccaccagcgccguggagauggaggaccuccccgcgggcaccugggagcgcgaggaggaccugacgaacuucugccaccaggagugccaggucaccgagaccgagugccugugccccuacgaggcccucgugcugcggaagccccuguuccucgacuccaucgccaaggggaugaagaaccugcugaacagcaccucccucgagacgagccuguccaucgaggccccguggggcgccaucaacgugcagagcaccuucaagcccaccgucuccaccgcgaacaucgcccugagcugguccagcguggagcaccgcgggaacaagauccucgugacgggccgguccgagagcaucaugaagcuggaggagcgcaccggcgucuccugggaccuggggguggaggacgccagcgaguccaagcuccugaccgugagcaucauggaccugagccagauguacucccccgucuucgaguaccucagcggcgaccgccagguggaggaguggcccaaggcgaccugcacgggggacugcccggagcggugcggcugcaccuccagcacgugccugcacaaggaguggccccacucccggaacuggcgcugcaaccccaccuggugcuggggcguggggaccggcugcacgugcugcggggucgacgugaaggaccuguucaccgaccacauguucaucaaguggaagguggaguacaucaagaccgaggccaucgucugcguggagcucaccggccaggagcggcagugcagccugaucgaggccgggacccgcuucaaccugggccccgugaccaucacccucuccgagccgcggaacauccagcagaagcugccgcccgagaucaucacccugcaccccaagaucgaggagggcuucuucgaccucaugcacguccagaaggugcugagcgccuccacggugugcaagcugcagagcugcacccacgggauccccggcgaccuccagaucuaccacaucgggaaccugcugaagggcgaccgcgucaacgggcaccucauccacaagaucgagccccacuucaacaccuccuggaugagcugggacggcugcgaccuggacuacuacugcaacaugggcgacuggcccuccugcaccuacacgggggugacccagcacaaccacgccgccuucgucaaccugcucaacaucgagaccgacuacaccaagacguuccacuuccacagcaagcgggugaccgcgcacggcgacacgccccagcuggaccugaaggcccgcccgaccuacggggccggcgagaucaccgugcucgucgagguggccgacauggagcugcacaccaagaagguggagaucuccgggcugaaguucgccagccugaccugcaccggcugcuacgcgugcuccagcggcaucuccugcaagguccggauccacguggacgagcccgacgagcugacggugcacgucaagagcagcgaccccgacgugguggccgccuccaccagccugauggcccgcaagcucgaguucgggaccgacuccaccuucaaggccuucagcgcgaugcccaagacgucccugugcuucuacaucgucgagcgggaguacugcaagagcugcuccgaggacgacaccaagaagugcguggacaccaagcuggagcagccgcagagcauccucaucgagcacaagggcaccaucaucgggaagcagaacgacacgugcaccgccaaggccuccugcuggcuggagagcgugaaguccuucuucuacggccugaagaacaugcucgggagcgucuucggcuccuucuucgugggcauccugcuguuccuggcccccuucgugcuccugguccuguucuucauguucggguggaagauccucuucugcuucaagugcugccgccggacccgcggccuguucaaguaccgccaccugaacgacgacgaggagaccggguaccggcgcaucaucgagcggcucaacagcaagaagggcaagaaccgccugcuggacggcgagcggcucgccgaccgcaagaucgcggagcuguucuccacgaagacccacaucggguga

SEQ ID NO: 12047 - RNA, 5052 nt, Artificial Sequence
  derived and/or modified CDS sequence (opt1) from CCHFV(1231-CR/TI-2015)__KU161585.1__GP
augcacacccugcucgugugcuucauccuguaccugcagcuccugggccuggggggcgcccacgagcagagcaacgccaccgaccacaaccgcacgaacaccaucaccgcgcccuccaccagccagaacccgaagccccccgccuccacgacccccccgcacacccccgagagcuccaccaucaagcucaucacgagcaccggggaggccgagggcuccggggagaccacccccccccugaacacgacccagggcccguucccccccgagaccaccagcgagcaccccgccuccacggccaccaacaccagcuccaccaacagcaugaacuccacgacccagaugaccgacaagacccugacgagcaccgucuccaccagccucuccaucagcccguccacccccagcacgagccagggcauccacuaccccauccggucccugcugagcguguccagcccccgcaccgcggccaccccgacccccauguccacgcgggagaugagcuccgagaccaacagccagcacuccgccgugagccgcacccccaccuuccacacggccacccaggucuccaccgagaacgacaaccggagcaccccccgccaguccgagagcuccgcgcagccggccacccagagccccaugacgucccccgcccagagcauccuccugguguccgccgcccccaccaccauccagaacauccacccgagccccaccaaccggagcaagcgcaaccuggagauggagaucauccucacgcugccccaggggcugaagaaguacuacggcaagauccucaagcugcugcaccucacccuggaggaggacaccgaggggcugcucgaguggugcaagcggaaccugggcuccaacugcgacgacgaguucuuccagaagcgcaucgaggaguucuucaucaccggggagggcuacuucaacgaggugcugcaguucaagacgcucagcacccugucccccauggagccgagccacgcgcggccccccaccgccgagccguucaaguccuacuucgccaagggcuuccugagcaucgacuccggguacuucagcgccaagugcuacccccgcuccagcuccagcggccuccagcugaucaacaucacccagcaccccgcccggaucgcggagacgcccgggccgaagaccaccucccugaagaccaucaacugcaucaaccuccgcgccagcgucuucaaggagcaccgggagguggagaucaacgugcugcugccccagaucgccgucaaccucuccaacugccacguggugaucaacagccacgucugcgacuacucccuggacacggacggccccgugcgccugccccggaucuaccacgagggcaccuucaucccggggaccuacaagaucgugaucgacaagaagaacaagcucaacgaccgcugcacccuggucacgaacugcgugaccaagggccgggaggugcgcaaggggcagagcguccugcggcaguacaagaccgagaucaagaucggcaaggccagcaccgggucccgcaagcuccugagcgaggagcccggcgacgacugcaucucccgcacgcagcugcuccggaccgagaccgccgagauccacgacgacaacuacggcgggcccggcgacaagaucaccaucugcaacgggagcacgaucguggaccagcgccugggcuccgagcuggggugcuacaccaucaaccgggugaagagcuucaagcucugcgagaacuccgcgaccggcaagaccugcgagaucgacagcacgcccgucaagugccgccagggcuucugccugaagaucacccaggaggggcggggccacgugaagcugucccgcgggagcgaggugguccuggacgccugcgacuccagcugcgaggugaugaucccgaagggcaccggggacauccucgucgacugcuccggcggccagcagcacuuccugaaggacaaccugaucgaccucgggugcccccacaucccccugcugggcaagauggccaucuacaucugccggaugagcaaccacccccgcaccacgauggccuuccucuucugguucuccuucggguacgugaucaccugcaucuucugcaaggcccuguucuacagccugaucaucaucggcacccucggcaagaagaucaagcaguaccgggagcugaagccgcagaccugcaccaucugcgagacggcgcccgugaacgccaucgacgccgagaugcacgaccugaacugcuccuacaacaucugccccuacugcgccagccgccucaccuccgacgggcuggcgcggcacgucacccagugccccaagcgcaaggagaagguggaggagaccgagcuguaccucaaccuggagcggaucccguggaucgugcgcaagcugcuccaggucagcgagagcacgggcguggcccugaagcgguccagcuggcugaucgugcuccugguccugcucaccgugucccugagccccgugcaguccgcccccgucgggcacggcaagaccaucgagaccuaccagacgcgcgagggguucaccagcaucugccuguucaugcucggcuccauccuguucaucgugagcugccuggugaagggccucgucgaguccgugagcgacuccuucuuccccgggcugagcgugugccggaccugcuccaucggcagcaucaacggguucgagaucgagucccacaagugcuacugcagccuguucugcugcccguacugccgccacugcuccgccgaccgggagauccaccagcuccaccugagcaucugcaagaagcgcaagaccggcuccaacgucaugcuggccgugugcaagcgcaugugcuuccgggcgacgauggaggccagccgccgggcccuccugauccgcagcaucaucaacaccaccuucgugaucugcauccugacccucacgaucugcgucguguccaccagcgccguggagauggagaaccugcccgccgggaccugggagcgggaggaggaccugaccaacuucugccaccaggagugccaggucacggagaccgagugccucugccccuacgaggcgcuggugcugcgcaagccgcucuuccuggacuccaucgugaagggcaugaagaaccugcucaacagcaccucccuggagaccagccuguccaucgaggcccccuggggcgccaucaacguccagagcacguucaagcccaccguguccaccgccaacaucgcccucagcugguccagcguggagcaccgggggaacaagauccuggucaccggccgcuccgagagcaucaugaagcuggaggagcggacggggguguccugggaccucggcguggaggacgcgagcgaguccaagcugcugaccgucagcaucauggaccucucccagauguacagccccguguucgaguaccugagcggggaccgccagguggaggaguggccgaaggccaccugcaccggcgacugccccgagcggugcggcugcacguccagcaccugccugcacaaggaguggccccacucccgcaacuggcggugcaaccccaccuggugcuggggggucggcaccgggugcacgugcugcggcguggacgugaaggaccucuucaccgaccacauguucgucaaguggaagguggaguacaucaagaccgaggccaucgugugcgucgagcugaccagccaggagcgccagugcucccugaucgaggccgggacccgguucaaccucggcccggugacgaucacccugagcgagccccgcaacauccagcagaagcugccccccgagaucaucacccuccacccgaagaucgaggagggcuucuucgaccugaugcacgugcagaagguccuguccgcgagcaccgugugcaagcuccaguccugcacgcacgggauccccggcgaccugcagguguaccacaucgggaaccugcucaagggcgaccgggucaacggccaccugauccacaagaucgagccccacuucaacaccagcuggauguccugggacgggugcgaccuggacuacuacugcaacaugggcgacuggcccagcugcaccuacaccggggugacgcagcacaaccacgccgccuucgugaaccuccugaacaucgagaccgacuacaccaagaccuuccacuuccacuccaagcgcgucacggcccacggcgacaccccgcagcuggaccucaaggcccggcccaccuacggggcgggcgagaucaccgugcuggucgagguggccgacauggagcugcacacgaagaagguggagaucagcggccucaaguucgccucccuggccugcaccgggugcuacgccugcagcuccggcaucagcugcaagguccgcauccacguggacgagcccgacgagcugaccgugcacgucaaguccagcgaccccgacgugguggcggccagcaccucccucauggcccggaagcuggaguucgggacggacagcaccuucaaggccuucuccgccaugccgaagaccagccugugcuucuacaucgucgagcgcgaguacugcaaguccugcagcgaggacgacaccaagaagugcguggacacgaagcucgagcagccccaguccauccugaucgagcacaagggcaccaucaucgggaagcagaacgacaccugcaccgcgaaggccagcugcuggcuggaguccgugaagagcuucuucuacggccucaagaacaugcugggcuccgucuucgggaacuucuucaucggcauccugcucuuccuggcccccuucgugcugcuggugcucuucuucauguucggguggaagauccuguucugcuucaagugcugccgccggacgcgcggccuguucaaguaccggcaccucaaggacgacgaggagaccggguaccgccggaucaucgagcgccugaacaacaagaagggcaagaaccggcugcucgacggcgagcgccuggccgaccggaagaucgcggagcuguucagcaccaagacccacaucggguga

SEQ ID NO: 12048 - RNA, 5052 nt, Artificial Sequence
  derived and/or modified CDS sequence (opt1) from CCHFV(K229_194)__KX013463.1__GP
augcacacccuccucgugugcuucauccuguaccugcagcucagcggccucggcggggcccacgggcagagcaacgccaccgagcacaacgggaccaacaccaccaccguccccgggaccagccaguccccgaagccgcccgcgagcaccacccugccccacacccccgaguccagcaccgugaagcucaccacccccaccuccgagaccgagggcagcggcgagaccacgccgccgcccaacaccacccaggggcugcccccgcccggcaccacccccgagcgccccgccaccacggccaccuccaccagcuccaccgacaacaugaacagcacgacccaggugaccgacaacacccccaucuccacggucagcaucucccccagcuccagcccguccaugcccagcaccagccaggggauccacuaccccgugcggucccugcucagcguguccagccccaagaccgucaccacgcccacccccaugucccccggcgagaugagccccgagaccuccagccagcacuccgccaugagccgcaucccgacccuguacacggccacccagguguccaccgagaacaccaaccggagcacgccccggcaguccgagagcuccgcccagcccgccacgcagagccccaccaccuccccgacccagacgauccugcucaugagcgccgcccccaaggcgauccaggacaugcaccccuccccgaccaaccggagcaagcgcaaccuggagguggagaucauccugacccucagccaggggcugaagaaguacuacggcaagauccugaagcuccugcaccugacccucgaggaggacacggagggccugcuggaguggugcaagcggaaccucggguccaacugcgacgacgacuucuuccagaagcgcaucgaggaguucuucaucaccggcgagggguacuucaacgagguccugcaguucaagacccugaacacccucagccccacggagcccucccacgugcggcugcccaccgccgagccguucaagagcuacuucgccaagggcuuccuguccguggacagcggcuacuucuccgccaagugcuacccccgcagcuccaccagcgggcuccagcugaucaacgucacccagcaccccgcccggaucgcggagacgcccggcccgaagaccaccucccugaagaccaucaacugcaucaaccuccgcgccagcguguucaaggagcaccgggagguggagaucaacguccugcugccccagaucgccgugaaccucuccaacugccacguggucaucaacagccacgugugcgacuacucccuggacacggacgggcccgugcgccugccccggauccaccacgagggcaccuucaucccggggaccuacaagaucgucaucgacaagaagaacaagcucaacgaccgcugcagccuggugaccaacugcgugaucaagggccgggagguccgcaagggccaguccgugcugcggcaguacaagacggagaucaagaucgggaaggccagcaccggcagccgcaagcuccuguccgaggagcccggggacgacugcaucagccggacccagcugcucaagaccgagacggccgagauccacgacgacaacuacggcgggcccggcgacaagaucaccaucugcaacggcuccaccaucgucgaccagcgccuggggagcgagcugggcugcuacaccaucaaccgcgugaaguccuucaagcucugcgagaacagcgcgacggggaagaccugcgagaucgacuccacccccgugaagugccggcagggcuucugccugaagaucacccaggaggggcgcggccacgucaagcugagccggggcuccgagguggugcuggacgccugcgacagcuccugcgagaucaugaucccgaaggggacgggcgacauccucgucgacugcagcgggggccagcagcacuuccugaagggcaaccugaucgaccucgggugcccccacaucccccugcugggcaagauggccaucuacaucugccgcauguccaaccacccccggaccaccauggccuuccucuucugguucagcuucggguacgugaucacgugcaucuucugcaaggcccuguucuacucccugaucaucaucggcacccucgggaagaagaucaagcaguaccgcgagcugaagccgcagacgugcaccaucugcgagaccgcgcccgugaacgccaucgacgccgagaugcacgaccugaacugcagcuacaacaucugccccuacugcgccucccggcucaccagcgacggccuggcccgccacgucacgcagugccccaagcggaaggagaagguggaggagaccgagcuguaccucaaccuggagcgcaucccguggaucgugcggaagcugcuccaggucuccgagagcaccggcguggcgcugaagcgcagcuccuggcugaucgugcuccugguccugcucaccgugagccugucccccgugcagagcgcccccgucgggcacggcaagacgaucgagaccuaccagacccgggagggguucaccaacaucugccuguucaugcucggcuccauccuguucaucgugagcugccuggugaaggggcucgucgacuccgugagcgacuccuucuucccgggccugagcgugugcaagacgugcuccaucggcagcaucaacggguucgagaucgagucccacaagugcuacugcagccuguucugcugccccuacugccgccacugcuccgccgaccgggagauccaccagcuccaccugggcaucugcaagaagcgcaagaccgggagcaacgucaugcuggccgugugcaagcggaugugcuucaaggcgaccaucgaggccucccgccgggcccuccugauccgcagcaucaucaacaccacguucgugaucugcauccugacccucgccaucugcgucguguccaccagcgccguggagauggagaaccugcccgcgggcaccugggagcgcgaggaggaccugacgagcuucugccaccaggagugccaggucaccgagaccgagugccucugccccuacgaggcccuggugcugcggaagccccuguuccuggacuccaucgugaaggggaagaagaaccugcucaacagcaccucccuggagacgagccuguccaucgaggcccccuggggcgccaucaacguccagagcaccuucaagcccaccguguccaccgccaacaucgcgcucagcugguccagcguggagcaccgcggcaacaagauccuggucacggggcgguccgagagcaucaugaagcuggaggagcgcaccggcguguccugggaccucgggguggaggacgccagcgaguccaagcugcugaccgucagcaucauggaccucucccagauguacagccccguguucgaguaccuguccggcgaccgccagguggaggaguggccgaaggcgaccugcacgggggacugccccgagcgcugcggcugcaccagcuccacgugccugcacaaggaguggccccacucccggaacuggcgcugcaaccccaccuggugcuggggcgucgggaccggcugcacgugcugcgggguggacgugaaggaccucuucaccgaccacauguucaucaaguggaaggucgaguacaucaagaccgaggccaucgugugcguggagcugaccagccaggagcggcagugcucccugaucgaggccggcacgcgcuucaaccucggcccggucaccaucacccugagcgagccccggaacauccagcagaagcugccgcccgagaucaucacccuccacccgaagaucgaggagggguucuucgaccugaugcacgugcagaaggugcuguccgcgagcacggucugcaagcuccaguccugcacccacggcauccccggggaccugcagaucuaccacaucggcaaccugcucaagggggaccgccugaacggccaccugauccacaagaucgagccccacuucaacaccagcuggauguccugggacggcugcgaccucgacuacuacugcaacaugggggacuggcccagcugcaccuacacgggcgugacccagcacaaccacgccgccuucgucaaccugcugaacaucgagaccgacuacaccaagacguuccacuuccacuccaagcgggugaccgcccacggggacaccccgcagcucgaccugaaggcgcgccccaccuacggcgccggggagaucacggugcuggucgagguggccgacauggagcuccacaccaagaagguggagaucagcggccugaaguucgccucccuggccugcaccggcugcuacagcugcuccagcgggaucuccugcaagguccggauccacguggacgagcccgacgagcucaccgugcacgucaagagcuccgaccccgacgugguggcggccagcacgagccugauggcccgcaagcuggaguucggcaccgacuccaccuucaaggccuucagcgccaugccgaagaccucccucugcuucuacaucgucgagcgggaguacugcaagagcugcuccgaggacgacacgaagaagugcguggacaccaagcuggagcagccccagagcauccugaucgagcacaaggggaccaucaucggcaagcagaacgacacgugcacggcgaaggccuccugcuggcucgagagcgugaaguccuucuucuacgggcugaagaacaugcugggcagcgucuucggcaacuucuucguggggauccuccuguuccuggcccccuucgugcugcucguccuguucuucauguucggcuggaagauccuguucugcuucaagugcugccgccggacccgcggccucuucaaguaccggcaccugaaggacgacgaggagaccggcuaccgcaagaucaucgagcgccugaacuccaagaagggcaagaaccggcuccuggacggggagcgccuggccgaccggaagaucgccgagcuguucagcaccaagacgcacaucggcuga

SEQ ID NO: 12049 - RNA, 5052 nt, Artificial Sequence
  derived and/or modified CDS sequence (opt1) from CCHFV(K315_14)__KX013469.1__GP
augcacacccugcucgugugcuucauccuguaccugcagcucagcggccuggggggcgcccacgggcaguccaacgagaccgagcacaacggcacgaacaccaccaccguccccgggacgagccaguccccgaagccccccgccagcaccacccugcagcacacccccgaguccagcacggugaagcucaccaccccgaccuccgagacggagggcagcggcgagaccacccccccccccaacaccacgcaggggcugccgccccccggcaccacccccgagcgcuccgcgaccacggccaccagcaccuccagcaccgacaacaugaacuccacgacccaggugaccgacaacaccccgacgagcaccgucuccaucagccccuccagcucccccagcaugcccagcaccucccaggggauccacuacccgauccggagccugcucuccgugagcucccccaagaccgugacgacccccacccccaucagcccgggcgagaugucccccgagaccagcucccagcacagcgccaugucccgcauccccacgcuguacaccgccacccaggucagcaccgagaacaccaaccgguccacgccccgccagagcgaguccagcgugcagccggccacccagucccccaucaccagccccgcgcagaccauccugcucauguccgccgcccccaaggccauccaggacaugcacccgagccccacgaaccggagcaagcgcaaccuggagguggagaucauccugacccucucccaggggcugaagaaguacuacggcaagauccugaagcuccugcaccugacccucgaggaggacaccgagggccugcuggaguggugcaagcggaaccucgggagcaacugcgacgacgacuucuuccagaagcgcaucgaggaguucuucaucacgggcgagggguacuucaacgagguccugcaguucaagacccuguccacccucagccccaccgagccgucccacgugcggcugcccacggcggagcccuucaagagcuacuucgccaagggcuuccuguccaucgacagcggcuacuucuccgccaagugcuacccccgcagcuccaccagcgggcuccagcugaucaacgugacccagcacccggcccggaucgccgagacccccggccccaagacgaccucccugaagaccaucaacugcaucaaccuccgcgcgagcgucuucaaggagcaccgggagguggagaucaacgugcugcugccccagaucgccgucaaccucuccaacugccacguggugaucaacagccacgucugcgacuacucccuggacaccgacgggccggugcgccugccccggauccaccacgagggcacguucauccccgggaccuacaagaucgugaucgacaagaagaacaagcucaacgaccgcugcagccuggucaccaacugcgugaucaagggccgggaggugcgcaagggccagagcguccugcggcaguacaagaccgagauccgcaucgggaaggccuccacgggcagccggaagcuccuguccgaggagcccggggacgacugcaucagccgcacccagcugcucaagaccgagaccgccgagauccacgacgacaacuacggcgggccgggcgacaagaucacgaucugcaacggcuccaccguggucgaccagcgccuggggagcgagcugggcugcuacaccaucaaccgggugaaguccuucaagcucugcaagaacagcgccaccgggaagacgugcgagaucgacuccacccccgugaagugccgccagggcuucugccugaagaucacccaggaggggcggggccacgucaagcugagccgcggcuccgagguggugcuggacgucugcgacagcuccugcgagaucaugauccccaaggggaccggcgacauccucguggacugcagcgggggccagcagcacuuccugaaggacaaccugaucgaccucggcugcccccacaucccgcugcuggggaagauggcgaucuacaucugccggauguccaaccacccccgcacgaccauggccuuccucuucugguucagcuucggcuacgugaucaccugcaucuucugcaaggcccuguucuacucccugaucaucaucgggacccucggcaagaagaucaagcaguaccgggagcugaagccccagaccugcacgaucugcgagaccgcccccgucaacgccaucgacgcggagaugcacgaccugaacugcagcuacaacaucugcccguacugcgccucccgccucaccagcgaggggcuggcccggcacgugacccagugccccaagcgcaaggagaagguggaggagacggagcuguaccucaaccuggagcggauccccuggaucguccgcaagcugcuccaggugagcgaguccaccggcguggcccugaagcggagcuccuggcugaucguccuccuggugcugcucaccgugagccugucccccguccagagcgccccggugggccacgggaagaccaucgagacguaccagacccgcgagggcuucaccuccaucugccuguucaugcucgggagcauccuguucaucguguccugccuggucaagggccucguguacagcguguccgacagcuucuuccccgggcuguccgucugcaagaccugcagcaucggcuccaucaacggcuucgagaucgagagccacaagugcuacugcucccuguucugcugccccuacugccggcacugcagcgcggaccgcgagauccaccagcuccaccuguccaucugcaagaagcggaagacggggagcaacgugaugcuggccgugugcaagcgcaugugcuucaaggccaccaucgaggccagccggcgcgcgcuccugauccgcuccaucaucaacaccaccuucgucaucugcauccugacgcucgccaucugcguggugagcaccuccgccgucgagauggaggaccugccggccggcaccugggagcgggaggaggaccugaccaacuucugccaccaggagugccaggugacggagaccgagugccucugccccuacgaggcccuggugcugcgcaagccccucuuccuggacagcaucgucaaggggaugaagaagcugcucaacuccaccagccuggagaccucccugagcaucgaggcgcccuggggcgccaucaacgugcaguccacguucaagccgaccgugagcaccgccaacaucgcccucuccuggagcuccgucgagcaccgggggaacaagauccuggugaccggccgcagcgaguccaucaugaagcuggaggagcggacgggcgugagcugggaccucggggucgaggacgccuccgagagcaagcugcugaccguguccaucauggaccucagccagauguacagccccguguucgaguaccuguccggcgaccgccaggucgaggaguggcccaaggcgaccugcaccggggacugccccgagcggugcggcugcacgagcuccaccugccugcacaaggaguggccgcacagccgcaacuggcggugcaaccccaccuggugcuggggggugggcaccggcugcacgugcugcgggguggacgucaaggaccucuucaccgaccacauguucaucaaguggaagguggaguacaucaagaccgaggccaucgugugcgucgagcugaccucccaggagcgccagugcagccugaucgaggccggcacccgguucaaccucgggcccgugacgaucacccuguccgagccccgcaacauccagcagaagcugccgcccgagaucaucacccuccaccccaagaucgaggagggcuucuucgaccugaugcacgugcagaagguccugagcgccuccaccgugugcaagcuccagagcugcacgcacggcauccccggggaccugcagaucuaccacaucggcaaccugcucaagggggaccgggucaacggccaccugauccacaagaucgagccgcacuucaacaccuccuggaugagcugggacgggugcgaccuggacuacuacugcaacaugggcgacuggcccuccugcaccuacaccggcgugacgcagcacaaccacgccgcguucgugaaccuccugaacaucgagaccgacuacaccaagaccuuccacuuccacagcaagcgcgucacggcccacggggacaccccccagcuggaccucaaggcccggcccaccuacggcgccggggagaucaccgugcugguggaggucgcggacauggagcugcacacgaagaagguggagaucuccggccucaaguucgccagccugaccugcaccgggugcuacgccugcuccagcggcaucuccugcaaggugcgcauccacgucgacgagccggacgagcugaccgugcacgugaagagcagcgaccccgacgucguggccgccuccacgagccucauggcgcggaagcuggaguucggcaccgacuccaccuucaaggccuucagcgccaugcccaagaccucccugugcuucuacaucguggagcgcgaguacugcaagagcugcuccgaggacgacacgaagaagugcgucgacaccaagcucgagcagccccagagcauccugaucgagcacaaggggaccaucaucggcaagcagaacgacaccugcacggccaaggccuccugcuggcuggagagcgugaaguccuucuucuacgggcucaagaacaugcugggcagcguguucggguccuucuucgucggcauccugcucuuccuggcgccguucgugcugcuggugcucuucuucauguucggcuggaagauccuguucugcuucaagugcugccggcgcacccgggggcuguucaaguaccgccaccucaaggacgacgaggagaccggcuaccgccggaucaucgagcgccugaacagcaagaaggggaagaaccggcugcucgacggcgagcgccuggccgaccggaagaucgccgagcuguucuccaccaagacgcacaucggcuga

SEQ ID NO: 12050 - RNA, 5055 nt, Artificial Sequence
  derived and/or modified CDS sequence (opt1) from CCHFV(BA8402)__AF350449.1__GP
auguacacgccccugcucugcgccgugcugugccugcagcucuggagccuggagggcucccacgggcugagcaacaagacccagcacuccaacaccagcaccaccaaggccccggaggucucccaggagcucggccugcccgugagcaccguguccacgaucaccagcgagccgcccuccaucaccagcgcggucuccgugagcggguccgagggcagcggggacaccaacacguccccgagcgugaccacccagggccccacccugcccgagacgacccucgagccccugaccaccacggacaccgacgccuccagcaccgucgugguggacgucuccacccagacggugaaggacaccccgaucagcaccaccuacacgagccugcccuccacccccagcgagcccaccaccccgcagggcacgcaccacaccgcccgcgggcuccuguccgugaccagcaccaagcccgaggaggccagcccccaggccaaccccggcaagaucagcauggagacgaacgggccgcggcuggcgaucuccgagacccccagcuucucccccaccacccaggcccccacggagaacagcaacccgaucaccuccaagcagcucaugcugagcgcccagcccgucacccccaaccccaugaccuccccggugcagcccgcccugagccaguccgacaccagcacggcgauccaggacgugcaccccucccccaccggccgcagcaagcggaaccucgagauggagaucauccugacccugucccaggggcucaagaaguacuacggcaagauccugaagcugcucgaccugacccuggaggaggacacggagggccuccuggaguggugcaagcgcaaccuggggcucgucugcgacgacaacuucuuccagaagcggaucgaggaguucuuccugaccggcaaggggcacuucaacgaggugcugcaguucaagaccccgagcacccucagccccacgggccccgcccgcaccggcuccccgaccguggagcccuucaagagcuacuucgccaagggguuccuguccauggacagcggcuacuucuccgccaagugcuacccccgggccagcaacuccgggcugcagcucaucaacgucacccagcacagcacgcgcaucaccgacacccccggcccgaagaucaccaaccugaagacgaucaacugcaucaaccugaaggcguccguguucaaggagcaccgggagaucgagaucaacgugcuccugccccaggucgccgugaaccugagcuccugccacgugcucaucaagagccacgucugcgacuacucccuggacaucgacgggcccgugcgccugccccggauccaccacgagggcaccuucaucccgggcaccuacaagaucgucaucgacaagaagaacaagcagaacgaccgcugcacccucgugacgaacugcgugaucaaggggcgggagauccgcaagggccagagcguccugcggcaguaccgcaccgagaucaagaucgggaaggccuccagcggcucccggcgccugcucagcgaggagagcggggacgacugcaucucccggacccagcugcugcgcaccgagacggccgagauccacaacgacaacuacggcggccccggggacaagaucaccaucugcaacggcagcaccgugguggaccagcggcugggguccgagcucggcugcuacaccaucaaccgcgucaacagcuucaaccugugcgagaacacggccaccgggaaguccugcgagaucgacagcacccccgugaagugccgccagggcuucugccugaagaucacccaggagggccgggggcacgugaagcucucccgcggcagcgaggucgugcuggacgcgugcgaguccagcugcgagaucaugauccccaaggggacgggcgacauccugguggacugcuccggcgggcagcagcacuuccucaaggacaaccugaucgaccugggcugcccgaacaucccccuccuggggaagauggccaucuacaucugccggaugagcaaccaccccaagaccaccauggccuuccuguucugguucuccuucggcuacgucgugaccugcauccucugcaaggugaucuucuaccugcugaucgucguggggacgcucggcaagaaguucaagcaguaccgcgagcugaagccccagaccugcaccaucugcgagaccaccccggugaacgccaucgacgccgagaugcacgaccugaacugcagcuacaacaucugccccuacugcgcgucccggcccacgagcgacggccucgcccgccacgucaugcagugccccaagcggaaggagaagaucgaggagaccgcccuguaccugaaccucgagcgcaucccguggguggugcggaagcugcugcaggucuccgagagcaccgggguggcccucaagcgcuccagcuggcuggugguccugcucgugcugcugaccgugagccucucccccguccagagcgcccccaucggccacgggaagacgguggagaccuaccagacccgggagggcuacaccuccaucugccuguucgugcuggggagcauccucuucaucgucuccugccugaugaagggccugguggacagcgugggcaacuccuucuuccccgggcucagcaucugcaagacgugcuccaucggcagcgucaacggguucgagaucgagucccacaagugcuacugcagccuguucugcugcccguacugccgccacugcuccgcggaccgggagauccaccgccugcaccucagcaucugcaagaagcggaagaccggcuccaacgugaugcuggccgugugcaagcgcaugugcuuccgggccaccgucgaggugagcaacaaggcccugcucauccgcaacaucaucaacaccacguucgugcugugcauccugauccucgcggucugcgugguguccaccagcgccgucgagauggagucccugcccgccgggaccugggagcgggaggaggaccugaccaacuucugccaccaggagugccaggugacggagaccgagugccucugccccuacgaggcccuggugcugcgcaagccccucuucagcgacagcaucgucaagggcaugaagaaccugcugaacuccaccagccucgagaccucccugagcaucgaggcccccuggggcgcgaucaacgugcaguccacguucaagcccaccgugagcgccgccaacaucgcccuguccuggagcuccgucgagcaccgcgggaacaagauccucgugagcggccgguccgagagcaucaugaagcuggaggagcgcaccgggaucuccugggaccugggcguggaggacgccagcgaguccaagcuccugaccgucagcgugauggaccugucccagauguacagccccgucuucgaguaccucuccggggaccgccagguggaggaguggccgaaggcgacgugcaccggcgacugccccgagcggugcggcugcaccagcagcacgugccugcacaaggaguggccccacucccggaacuggcgcugcaaccccaccuggugcuggggcguggggaccgggugcacgugcugcggccuggacgucaaggaccucuucaccgacuacauguucaucaaguggaagguggaguacaucaagaccgaggccaucgugugcgucgagcugaccagccaggagcggcagugcacccugaucgaggccggcacccgcuucaaccucgggccggugacgaucacccuguccgagccccggaacauccagcagaagcugccgcccgagaucgugacccuccacccccgcaucgaggagggcuucuucgaccugaugcacguccagaaggugcugagcgccuccaccgugugcaagcuccagagcugcacccacgggguccccggcgaccuccagguguaccacaucgggaaccugcucaagggcgacaaggugaacggccaccugauccacaagaucgagccccacuucaacacguccuggaugagcugggacgggugcgaccugcacuacuacugcaacaugggcgacuggcccuccugcaccuacaccggggucacccagcacaaccacgccgcguucgugaacaugcucaacaucgagacggacuacaccaagaacuuccacuuccacagcaagcgggugaccgcccacggcgacaccccgcagcuggaccugaaggcccgccccacguacggggccggcgagaucaccguccucguggagguggcggacauggagcugcacaccaagaagaucgagaucuccggccugaaguucgccagccugaccugcacggggugcuacgccugcuccagcggcaucuccugcaagguccggauccacguggacgagcccgacgagcugaccgugcacgucaagagcgaggaccccgacaucguggccgccuccagcucccugauggcgcgcaagcucgaguucgggaccgacagcaccuucaaggccuucagcgccaugccgaagacgucccugugcuucuacaucguggagcgggaguacugcgagagcugcuccaaggaggacacccagaagugcgucaacaccaagcuggagcagccccagagcauccucaucgagcacaagggcaccaucaucgggaagcaguccaacacgugcaccgccaaggccagcugcuggcuggaguccgugaaguccuucuucuacggccugaagaacaugcuguccggcaucuucgggaacguguucaucggcgucuuccucuucuucgcgcccuucauccugcugauccucuucuucauguucggguggcgcauccuguucugcuucaagugcugccggcgcacccggggccuguucaaguaccgccaccucaaggacgacgaggagaccggcuaccggaagaucaucgagcgccugaacaacaagaaggggaagaacaagcugcucgacggcgagcgccuggccgaccggaagaucgccgagcuguucagcacgaagacccacaucggguga

SEQ ID NO: 12051 - RNA, 5055 nt, Artificial Sequence
  derived and/or modified CDS sequence (opt1) from CCHFV(UCCR4459)__KY484032.1__GP
auguacacgccccuccucugcgccgugcugugccugcagcucuggagccuggagggcucccacgggcugagcaacaagacccagcacuccaacaccagcaccaccaaggccccggaggucucccaggaguucggccuccccgugagcaccguguccacgaucaccagcgacccgcccuccaucaccagcgcggucuccgugagcggguccgagggcagcggggacaccaacacgucccccagcgugaccacccagggccugacccugcccgagacgacccucgagcugcugaccaccacggacaccgacgccuccagcaccgucgugguggacgucuccacccagacggugaaggacacccccaucagcaccacccacacgagccuccccuccaccccgagcgccaccaccacgccccagggcacccaccacaccgcccgcgggcugcuguccgugaccagcacgaagcccgagggcgccuccacccaggcgaaccccgagaagaucagcauggagaccaacuccccgcggcucgccaucagcgagacccccuccuucagccccacgacccaggcccccaccgagaacuccaacccgaucaccagcaagcagcugaucuucuccgcccagcccgucacccccaaccccgugacgccgcccgugcagcccgcgcugagccaguccgacaccagcaccgccauccaggacauccaccccuccccgaccagccgcuccaagcggaaccucgagauggagaucauccugacgcugagccaggggcucaagaaguacuacggcaagauccugaagcugcucgaccugacccuggaggaggacaccgaggggcuccuggaguggugcaagcgcaaccugggccucgucugcgacgacgacuucuuccagaagcggaucgaggaguucuuccugaccggcgaggggcacuucaacgaggugcugcaguucaagacgcccagcacccucucccccaccggccccgcccgcaccgggagcccgacgguggagcccuucaaguccuacuucgccaagggcuuccugagcauggacuccggcuacuucagcgccaagugcuacccccgggcguccaacagcgggcugcagcucaucaacgucacccagcacuccacccgcaucaccgacacgccgggccccaaggugaccaaccugaagaccaucaacugcaucaaccugaaggccagcguguucaaggagcaccgggagaucgagaucaacguccuccugccccagguggccgugaaccuguccagcugccacguccucaucaagucccacgugugcgacuacagccuggacaucgacgggcccguccgccugccgcggauccaccacgagggcaccuucauccccgggacguacaagcucgugaucgacaagaagaacaagcagaacgaccgcugcacccugaucaccaacugcgugaucaagggccgggagauccgcaagggccaguccguccugcggcaguaccgcaccgagaucaagaucgggaaggccagcuccggcagccggcgccuccugagcgaggaguccggggacgacugcaucagccggacgcagcugucccgcaccgagaccgccgagauccacagcgacaacuacggcgggcccggcgacaagaucaccaucugcaacggcuccacgaucguggaccagcggcuggggagcgagcucggcugcuacaccaucaaccgcgugaaguccuucaagcugugcgagaacagcgcgaccgggaaguccugcgagaucgacagcacccccaucaagugccgccagggcuucugccugaagaucacgcaggaggggcggggccacgucaagcucucccgcggcagcgagguggugcuggacgccugcgacuccagcugcgagaucaugaucccgaaggggaccggcgacauccuggucgacugcuccgggggccagcagcacuuccucaaggacaaccugaucgaccugggcugccccaacaucccccuccuggggaagauggccaucuacaucugccggaugagcaaccaccccaagaccaccauggccuuccuguucugguucuccuucggcuacgugaucacgugcauccucugcaaggugaucuucuaccugcugaucgucguggggacccucggcaagaaguucaagcaguaccgcgagcugaagccgcagaccugcaccaucugcgagaccacgcccgugaacgccaucgacgcggagaugcacgaccugaacugcagcuacaacaucugccccuacugcgccucccggcucaccagcgacgggcuggcccgccacgucaugcagugccccaagcggaaggagaagguggaggagaccgagcuguaccucaaccuggagcgcaucccgugggugguccggaagcugcuccaggugagcgaguccaccggcguggcccugaagcgcagcuccuggcuggucgugcuccuggugcugcucacggucagccugucccccgugcagagcgcccccaucggccacgggaagaccguggagaccuaccagacccgggagggcuacacguccaucugccuguucguccucgggagcauccuguucaucguguccugccugaugaagggccucguggacagcgucgggaacuccuucuuccccggccugagcaucugcaagaccugcuccaucggcagcaucaacggguucgagaucgagucccacaagugcuacugcagccuguucugcugcccguacugccgccacugcuccgcggaccgggagauccacaagcuccaccugagcaucugcaagaagcgcaagaccggcuccaacgugaugcuggccgugugcaagcggaugugcuuccgcgccaccgucgaggugagcaacaaggcccuccugauccggaacaucaucaacacgaccuucguggucugcauccugauccucgcggugugcguggucagcaccuccgccguggagauggagagccugcccgccgggaccugggagcgcgaggaggaccugacgaacuucugccaccaggagugccaggugaccgagaccgagugccucugccccuacgaggcccugguccugcggaagccccucuucuccgacagcaucgugaagggcaugaagaaccugcugaacuccaccagccucgagacgucccugagcaucgaggccccguggggcgcgaucaacgugcaguccaccuucaagcccaccgucagcgccgccaacaucgcccuguccuggagcuccguggagcaccgcgggaacaagauccucgugagcggccgcuccgagagcaucaugaagcuggaggagcggaccgggaucuccugggaccugggcgucgaggacgccagcgaguccaagcuccugacggugagcaucauggaccugagccagauguacucccccguguucgaguaccucagcggggaccgccaggucgaggaguggccgaaggcgaccugcaccggcgacugccccgagcggugcgggugcaccuccagcacgugccugcacaaggaguggccccacucccgcaacuggcggugcaaccccaccuggugcuggggcgugggcaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggcccggugacgaucacccugagcgagccccgcaacauccagcagaagcugccgcccgagaucgucacccuccacccccggaucgaggagggcuucuucgaccugaugcacgugaagaaggugcuguccgccagcaccgucugcaagcuccaguccugcacccacggggugcccggcgaccuccagguguaccacaucgggaaccugcucaagggcgacaaggucaacgggcaccugauccacaagaucgagccccacuucaacacgagcuggauguccugggacggcugcgaccuggacuacuacugcaacaugggcgacuggcccagcugcuccuacaccggggugacccagcacaaccacgccgcguucgugaacaugcucaacaucgagaccgacuacacgaagaucuuccacuuccacagcaagcgcgucaccgcccacggcgacaccccgcagcuggaccugaaggcccggcccaccuacggggccggcgagaucacggugcucguggaggucgcggacauggagcugcacaccaagaagaucgagaucuccgggcugaaguucgccagccugaccugcaccggcugcuacgccugcuccagcggcaucagcugcaaggugcgcauccacguggacgagcccgacgagcugacgguccacgugaaguccgaggaccccgacaucguggccgccagcuccagccugauggcgcggaagcucgaguucgggaccgacuccaccuucaaggccuucagcgccaugccgaagaccucccugugcuucuacaucgucgagcgcgaguacugcaagagcugcuccaaggaggacacgcagaagugcgugaacaccaagcuggagcagccccagagcauccucaucgagcacaagggcaccaucaucgggaagcagaacgacacgugcaccuccaaggccggcugcuggcuggagagcgugaaguccuucuucuacgggcugaagaacaugcugagcggcaucuucggcaacgucuucaucgggaucuuccucuuccuggcccccuucauccugcucauccuguucuucauguucggcuggcggauccuguucugcuucaagugcugccgccggacccgcggccucuucaaguaccggcaccugaaggacgacgaggagaccggguaccgcaagaucaucgagcggcugaacaacaagaagggcaagaacaagcuccuggacggggagcgccuggcggaccgcaagaucgccgagcuguucuccaccaagacgcacaucggcuga

SEQ ID NO: 12052 - RNA, 5052 nt, Artificial Sequence
  derived and/or modified CDS sequence (opt1) from CCHFV(Ast149)__KX056054.1__GP
augcacacccugcucgugugcuucauccuguaccugcagcucagcggccuggggggcgcccacgggcaguccaacgccaccgagcacaacggcacgaacaccaccaccgcgcccgggacgagccaguccccgaagccccccgccagcaccacccccccgcacacccccgaguccagcacggucaagcugaccacccccaccuccgagacggagggcagcggcgagaccacccccccgcccaacaccacgcaggggcucccccccccgggcaccacccccgagcgccccgccaccacggccaccuccaccagcuccaccgacaacaugaacagcacgacccaggugaccgacaacacccccacguccaccgugagcaccuccccgagcuccagccccuccaugcccagcaccagccaggggauccacuaccccguccggucccugcugagcguguccagcccgaagacggugaccacccccacccccaugucccccggcgagaugagcccggagacguccagccagcacuccgccaugagccgcauccccacccucuacaccgcggcccaggucuccaccgagaacgccaaccggagcaccccccgccaguccgagagcuccgcccagcccgcgacgcagagcccgaccaccuuccccgcccagaccauccugcugauguccgccgcccccaaggccauccaggacaugcacccgagccccacgaaccgguccaagcgcaaccucgagguggagaucauccugacccugagccaggggcucaagaaguacuacggcaagauccugaagcugcuccaccugacccuggaggaggacaccgagggccuccuggaguggugcaagcggaaccuggggagcaacugcgacgacgacuucuuccagaagcgcaucgaggaguucuucaucacgggcgagggguacuucaacgaggugcuccaguucaagacccuguccacccugagccccaccgagcccucccacguccggcucccgacggcggagcccuucaagagcuacuucgccaagggcuuccuguccaucgacagcggcuacuucuccgccaagugcuacccccgcagcuccaccagcgggcugcagcucaucaacgugacccagcaccccgcccggaucgccgagaccccgggccccaagacgaccucccugaagaccaucaacugcaucaaccugcgcgcgagcguguucaaggagcaccgggaggucgagaucaacgugcuccugccccagaucgccgugaaccuguccaacugccacgucgugaucuacagccacgugugcgacuacucccucgacaccgacgggcccguccgccugccgcggauccaccacgagggcacguucauccccgggaccuacaagaucgugaucgacaagaagaacaagcugaacgaccgcugcagccucgugaccaacugcgucaucaagggccgggaggugcgcaagggccaguccgugcugcggcaguacaagaccgagaucaagaucgggaaggccagcacgggcagccgcaagcugcucuccgaggagcccggggacgacugcaucagccggacccagcugcugaagaccgagaccgccgagauccacgacgacaacuacggcgggcccggcgacaagaucacgaucugcaacggcuccaccaucgucgaccagcgccucgggagcgagcugggcugcuacaccaucaaccgcgugaaguccuucaagcugugcgagaacagcgccaccgggaagacgugcgagaucgacuccaccccggucaagugccggcagggcuucugccucaagaucacccaggaggggcgcggccacgugaagcugagccggggcuccgaggugguccuggacgcgugcgacagcuccugcgagaucaugauccccaaggggaccggcgacauccugguggacugcagcgggggccagcagcacuuccucaaggacaaccugaucgaccugggcugcccccacaucccccuccuggggaagauggccaucuacaucugccgcauguccaaccacccgcggacgaccauggccuuccuguucugguucagcuucggcuacgugaucaccugcaucuucugcaaggcccucuucuacucccugaucaucaucgggacccugggcaagaagaucaagcaguaccgcgagcucaagccccagaccugcacgaucugcgagaccgcccccgucaacgcgaucgacgccgagaugcacgaccugaacugcagcuacaacaucugccccuacugcgccucccggcugaccagcgacgggcucgcccgccacgugacccagugcccgaagcggaaggagaagguggaggagacggagcuguaccugaaccucgagcgcauccccuggaucguccggaagcugcugcagguguccgagagcaccggcguggcgcucaagcgcagcuccuggcugaucguccugcucgugcugcugaccgugagccucucccccguccagagcgccccggugggccacgggaagaccaucgagacguaccagacccgggagggcuucaccaacaucugccuguucaugcugggguccauccucuucaucgugagcugccuggucaagggccugguggacuccgugagcgacuccuucuuccccgggcucagcgucugcaagaccugcuccaucggcagcaucaacggcuucgagaucgagucccacaagugcuacugcagccuguucugcugccccuacugccgccacugcuccgccgaccgggagauccaccagcugcaccucgggaucugcaagaagcgcaagacgggcagcaacgugaugcuggccgugugcaagcggaugugcuucaaggccaccaucgaggcgucccgccgggcccugcccauccgcagcaucaucaacaccaccuucgucaucugcauccucacgcuggccaucugcgugguguccaccagcgccgucgagauggagaaccugccggccgggaccugggagcgcgaggaggaccucaccaacuucugccaccaggagugccaggugacggagaccgagugccugugccccuacgaggcgcuggugcuccggaagccccuguuccuggacagcaucgucaagggcaugaagaaccuccugaacuccaccagccuggagaccucccucagcaucgaggcccccuggggggccaucaacgugcaguccacguucaagccgaccgugagcaccgccaacaucgcccuguccuggagcuccgucgagcaccgcggcaacaagauccuggugaccggccggagcgaguccaucaugaagcucgaggagcgcacgggggugagcugggaccugggcgucgaggacgcguccgagagcaagcugcucaccguguccaucauggaccugagccagauguacucccccguguucgaguaccugagcggggaccggcaggucgaggaguggcccaaggccaccugcaccggcgacugccccgagcgcugcgggugcacguccagcaccugccuccacaaggaguggccgcacagccggaacuggcgcugcaaccccaccuggugcuggggcgugggcaccgggugcacgugcugcggcguggacgucaaggaccuguucaccgaccacauguucaucaaguggaagguggaguacaucaagaccgaggccaucgugugcgucgagcugaccucccaggagcggcagugcagccucaucgaggccgggacccgcuucaaccugggccccgugacgaucacccuguccgagccccggaacauccagcagaagcucccgcccgagaucaucacccugcaccccaagaucgaggagggcuucuucgaccugaugcacgugcagaagguccucagcgcguccaccgugugcaagcugcagagcugcacgcacgggauccccggcgaccugcagaucuaccacaucgggaaccuccugaagggcgaccgccugaacgggcaccucauccacaagaucgagccgcacuucaacaccuccuggaugagcugggacggcugcgaccuggacuacuacugcaacaugggcgacuggcccuccugcaccuacaccggggugacgcagcacaaccacgccgccuucgucaaccugcucaacaucgagaccgacuacaccaagaccuuccacuuccacagcaagcgggugacggcccacggcgacaccccccagcuggaccugaaggcccgccccaccuacggggcgggcgagaucaccguccucguggagguggccgacauggagcugcacacgaagaaggucgagguguccgggcugaaguucgccagccucgccugcaccggcugcuacgccugcuccagcggcaucuccugcaaggugcggauccacgucgacgagccggacgagcugaccgugcacgugaagagcuccgaccccgacgucguggcggccagcaccucccugauggcccgcaagcucgaguucgggacggacagcaccuucaaggccuucagcgccaugcccaagaccucccugugcuucuacaucguggagcgggaguacugcaagagcugcuccgaggacgacaccaagaagugcgucgacacgaagcuggagcagccccagagcauccucaucgagcacaagggcaccaucaucgggaagcagaacgacaccugcaccgcgaaggccuccugcuggcuggagagcgugaaguccuucuucuacggccugaagaacaugcucgggagcguguucggcaacuucuucgucggcauccugcuguuccucgccccguucgugcugcuggcccuguucuucaucuucggguggaagauccucuucugcuucaagugcugccgccggacgcgcggccuguucaaguaccggcaccugaaggacgacgaggagaccggguaccgcaagaucaucgagcgccucaacuccaagaagggcaagaaccggcugcuggacggcgagcgccucgcggaccggaagaucgccgagcuguucagcaccaagacccacaucggguga

SEQ ID NO: 12053 - RNA, 5052 nt, Artificial Sequence
  derived and/or modified CDS sequence (opt1) from CCHFV(Ast137)__KX056057.1__GP
augcacacccuccucgugugcuucauccuguaccugcagcucagcggccucggcggggcccacgggcagagcaacgccaccgagcacaacgggaccaacaccaccaccguccccgggaccagccaguccccgaagccgcccgcgagcaccacccugccccacacccccgaguccagcaccgugaagcucaccacccccaccuccgagaccgagggcagcggcgagaccacgccgccgcccaacaccacccaggggcugcccccgcccggcaccacccccgagcgccccgccaccacggccaccuccaccagcuccaccgacaacaugaacagcacgacccaggugaccgacaacacccccacguccaccgucagcaucucccccagcuccagcccguccaugcccagcaccagccaggggauccacuaccccgugcggucccugcucagcguguccagccccaagaccgucacgacccccacccccaugucccccggcgagaugagccccgagaccuccagccagcacuccgccaugagccgcaucccgacgcuguacaccgccgcccagguguccaccgagaacaccaaccggagcacgccccggcaguccgagagcuccgcccagcccgccacgcagagccccaccaccuucccggcccagaccauccugcucauguccgcggcccccaaggccauccaggacaugcaccccagcccgacgaaccgguccaagcgcaaccuggagguggagaucauccugacccucagccaggggcugaagaaguacuacggcaagauccugaagcuccugcaccugacccucgaggaggacaccgagggccugcuggaguggugcaagcggaaccucgggagcaacugcgacgacgacuucuuccagaagcgcaucgaggaguucuucaucacgggcgagggguacuucaacgagguccugcaguucaagacccuguccacccucagccccaccgagcccucccacgugcggcugcccacggccgagccguucaagagcuacuucgccaagggcuuccuguccaucgacagcggcuacuucuccgcgaagugcuacccccgcagcuccaccagcgggcuccagcugaucaacgugacccagcaccccgcccggaucgccgagacccccggcccgaagacgaccucccugaagaccaucaacugcaucaaccuccgcgccagcgucuucaaggagcaccgggagguggagaucaacgugcugcugccccagaucgccgucaaccucuccaacugccacguggugaucaacagccacgucugcgacuacucccuggacaccgacgggcccgugcgccugccccggauccaccacgagggcacguucaucccggggaccuacaagaucgugaucgacaagaagaacaagcucaacgaccgcugcagccuggucaccaacugcgugaucaagggccgggaggugcgcaagggccaguccguccugcggcaguacaagaccgagaucaagaucgggaaggcgagcacgggcagccgcaagcuccuguccgaggagcccggggacgacugcaucagccggacccagcugcucaagaccgagaccgccgagauccacgacgacaacuacggcgggcccggcgacaagaucacgaucugcaacggcuccaccaucguggaccagcgccuggggagcgagcugggcugcuacaccaucaaccgcgucaaguccuucaagcucugcgagaacagcgccaccgggaagacgugcgagaucgacuccacccccgugaagugccggcagggcuucugccugaagaucacccaggaggggcgcggccacgugaagcugagccggggcuccgaggucgugcuggacgccugcgacagcuccugcgagaucaugaucccgaaggggaccggcgacauccucguggacugcagcgggggccagcagcacuuccugaaggacaaccugaucgaccucggcugcccccacaucccccugcuggggaagauggccauccacaucugccgcauguccaaccacccccggacgaccauggcguuccucuucugguucagcuucggcuacgucaucacgugcaucuucugcaaggcccuguucuacucccugaucaucaucgggacccucggcaagaagaucaagcaguaccgcgagcugaagccgcagaccugcacgaucugcgagaccgcccccgugaacgccaucgacgccgagaugcacgaccugaacugcagcuacaacaucugccccuacugcgcgucccggcucaccagcgacgggcuggcccgccacgugacccagugccccaagcggaaggagaaggucgaggagacggagcuguaccucaaccuggagcgcaucccguggaucgugcggaagcugcuccagguguccgagagcaccggcgucgcccugaagcgcagcuccuggcugaucgugcuccuggugcugcucaccgucagccugucccccgugcagagcgcccccgugggccacgggaagaccaucgagacguaccagacccgggagggcuucaccaacaucugccuguucaugcucggguccauccuguucaucgucagcuaccuggugaagggccucguggacuccgucagcgacuccuucuucccggggcugagcgugugcaagaccugcuccaucggcagcaucaacggcuucgagaucgagucccacaagugcuacugcagccuguucugcugccccuacugccgccacugcuccgcggaccgggagauccaccagcuccaccuggggaucugcaagaagcgcaagacgggcagcaacgugaugcuggccgucugcaagcggaugugcuucaaggccaccaucgaggccucccgccgggcccuccugauccgcagcaucaucaacaccaccuucgugaucugcauccugacgcucgcgaucugcguggucuccaccagcgccguggagauggagaaccugcccgccgggaccugggagcgcgaggaggaccugaccaacuucugccaccaggagugccaggugacggagaccgagugccucugccccuacgaggcccugguccugcggaagccccuguuccuggacagcaucgugaagggcaccaagaaccugcucaacuccaccagccuggagacgucccugagcaucgaggcccccuggggcgcgaucaacgugcaguccaccuucaagcccaccgucagcaccgccaacaucgcccucuccuggagcuccguggagcaccgcggcaacaagauccuggugacgggccggagcgaguccaucaugaagcuggaggagcgcaccggggucagcugggaccucggcguggaggacgccuccgagagcaagcugcugaccguguccaucauggaccucagccagauguacucccccgucuucgaguaccugagcggggaccgccagguggaggaguggccgaaggcgaccugcacgggcgacugccccgagcgcugcgggugcaccuccuccacgugccugcacaaggaguggccccacagccggaacuggcgcugcaaccccaccuggugcuggggcgugggcaccgggugcacgugcugcggcgucgacgugaaggaccucuucaccgaccacauguucaucaaguggaagguggaguacaucaagaccgaggcgaucgucugcguggagcugaccucccaggagcggcagugcagccugaucgaggccgggacgcgcuucaaccucggcccggugaccaucacccuguccgagccccggaacauccagcagaagcugccgcccgagaucaucacccuccacccgaagaucgaggagggcuucuucgaccugaugcacguccagaaggugcugagcgccuccacggugugcaagcuccagagcugcacccacgggauccccggcgaccugcagaucuaccacaucgggaaccugcucaagggcgaccgccugaacgggcaccugauccacaagaucgagccccacuucaacaccuccuggaugagcugggacggcugcgaccucgacuacuacugcaacaugggcgacuggcccuccugcaccuacacgggggucacccagcacaaccacgccgcguucgugaaccugcugaacaucgagaccgacuacaccaagacguuccacuuccacagcaagcgggucaccgcccacggcgacaccccgcagcucgaccugaaggcccgccccaccuacggggccggcgagaucacggugcugguggaggucgccgacauggagcuccacaccaagaagguggagguguccgggcugaaguucgcgagccuggccugcaccggcugcuacgccugcuccagcggcaucuccugcaagguccggauccacguggacgagcccgacgagcucaccgugcacgucaagagcuccgaccccgacgugguggccgccagcacgucccugauggcgcgcaagcuggaguucgggaccgacagcaccuucaaggccuucagcgccaugccgaagaccucccucugcuucuacaucgucgagcgggaguacugcaagagcugcuccgaggacgacacgaagaagugcguggacaccaagcuggagcagccccagagcauccugaucgagcacaagggcaccaucaucgggaagcagaacgacacgugcacggccaaggccuccugcuggcucgagagcgugaaguccuucuucuacggccugaagaacaugcuggggagcgucuucggcaacuucuucgugggcauccuccuguuccuggcgcccuucgugcugcucguccuguucuucaucuucggguggaagauccuguucugcuucaagugcugccgccggacccgcggccucuucaaguaccggcaccugaaggacgacgaggagaccggguaccgcaagaucaucgagcgccugaacuccaagaagggcaagaaccggcuccuggacggcgagcgccuggccgaccggaagaucgccgagcuguucagcaccaagacgcacaucggguga

SEQ ID NO: 12054 - RNA, 5055 nt, Artificial Sequence
  derived and/or modified CDS sequence (opt1) from CCHFV(C-68031)__DQ211629.1__GP
auguacacgccccugcucugcgccgugcugugccugcagcucuggagccuggagggcucccacgggcugagcaacaagacccagcacuccaacaccagcaccaccaaggccccggaggucucccaggaguucggccuccccgugagcaccguguccacgaucaccagcgacccgcccuccaucaccagcgcggucuccgugagcggguccgagggcagcggggacaccaacacgucccccagcgugaccacccagggccugacccugcccgagacgacccucgagcugcugaccaccacggacaccgacgccuccagcaccgucgugguggacgucuccacccagacggugaaggacacccccaucagcaccacccacacgagccuccccuccaccccgagcgcccccaccacgccccagggcacccaccacaccgcccgcgggcugcuguccgugaccagcaccaagcccgagggcgccuccacgcaggcgaacccggagaagaucagcauggagaccaacagcccccggcucgccaucuccgagacccccuccuucagccccaccacgcaggccccgaccgagaacuccaaccccaucaccagcaagcagcugauccuguccgcccagcccgucacccccaacccggugaccccgcccgugcagcccgcgcucagccaguccgacacgagcaccgccauccaggacauccaccccucccccaccagccgcuccaagcggaaccuggagauggagaucauccugacccucagccaggggcugaagaaguacuacggcaagauccugaagcuccuggaccugacgcucgaggaggacaccgaggggcugcuggaguggugcaagcgcaaccucggccuggucugcgacgacgacuucuuccagaagcggaucgaggaguucuuccugaccggcgaggggcacuucaacgaggugcuccaguucaagacccccagcacgcugucccccaccggcccggcccgcaccgggagccccaccguggagcccuucaaguccuacuucgccaagggcuuccugagcauggacuccggcuacuucagcgccaagugcuacccgcgggcguccaacagcgggcuccagcugaucaacgucacgcagcacuccacccgcaucaccgacacccccggccccaaggugacgaaccugaagaccaucaacugcaucaaccucaaggccagcguguucaaggagcaccgggagaucgagaucaacguccugcugccccagguggccgugaaccucuccagcugccacguccugaucaagucccacgugugcgacuacagccuggacaucgacgggccgguccgccucccccggauccaccacgagggcaccuucauccccgggaccuacaagcuggugaucgacaagaagaacaagcagaacgaccgcugcacgcugaucaccaacugcgugaucaagggccgggagauccgcaagggccaguccguccuccggcaguaccgcaccgagaucaagaucgggaaggccagcuccggcagccggcgccugcugagcgaggaguccggggacgacugcaucagccggacccagcugucccgcacggagaccgccgagauccacagcgacaacuacggcgggcccggcgacaagaucaccaucugcaacggcuccaccaucguggaccagcggcucgggagcgagcugggcugcuacacgaucaaccgcgugaaguccuucaagcugugcgagaacagcgcgaccgggaaguccugcgagaucgacagcaccccgaucaagugccgccagggcuucugccucaagaucacccaggaggggcggggccacgucaagcugucccgcggcagcgagguggugcuggacgccugcgacuccagcugcgagaucaugauccccaaggggacgggcgacauccucgucgacugcuccgggggccagcagcacuuccugaaggacaaccugaucgaccucggcugccccaacaucccccugcuggggaagauggccaucuacaucugccggaugagcaaccacccgaagaccaccauggccuuccucuucugguucuccuucggcuacgugaucacgugcauccugugcaaggugaucuucuaccugcucaucgucguggggacccugggcaagaaguucaagcaguaccgcgagcugaagccccagaccugcaccaucugcgagaccacccccgugaacgccaucgacgcggagaugcacgaccucaacugcagcuacaacaucugccccuacugcgccucccggcugacgagcgacgggcuggcccgccacgucaugcagugcccgaagcggaaggagaagguggaggagaccgagcucuaccugaaccuggagcgcauccccugggugguccggaagcuccuccaggugagcgaguccaccggcguggcccugaagcgcagcuccuggcucgucgugcugcuggugcuccugaccgucagccugucccccgugcagagcgcccccaucggccacgggaagacgguggagaccuaccagacccgggagggcuacaccuccaucugccucuucguccuggggagcauccuguucaucguguccugccucaugaagggccugguggacagcgucgggaacuccuucuucccgggccugagcaucugcaagacgugcuccaucggcagcaucaacggguucgagaccgagucccacaagugcuacugcagccucuucugcugccccuacugccgccacugcuccgcggaccgggagauccacaagcugcaccugagcaucugcaagaagcgcaagaccggcuccaacgugaugcucgccgugugcaagcggaugugcuuccgcgccaccgucgaggugagcaacaaggcccugcugauccggaacaucaucaacacgaccuucguggucugcauccucauccuggcggugugcguggucagcaccuccgccguggagauggagagccugcccgccgggaccugggagcgcgaggaggaccucacgaacuucugccaccaggagugccaggugaccgagaccgagugccugugccccuacgaggcccugguccuccggaagccgcuguucuccgacagcaucgugaagggcaugaagaaccugcucaacuccaccagccuggagacgucccugagcaucgaggcccccuggggcgcgaucaacgugcaguccaccuucaagcccaccgucagcgccgccaacaucgcccucuccuggagcuccguggagcaccgcgggaacaagauccuggugagcggccgcuccgagagcaucaugaagcuggaggagcggaccgggaucuccugggaccucggcgucgaggacgccagcgaguccaagcugcugacggugagcaucauggaccucagccagauguacuccccgguguucgaguaccugagcggggaccgccaggucgaggaguggcccaaggcgaccugcaccggcgacugccccgagcggugcgggugcaccuccagcacgugccugcacaaggaguggccccacucccgcaacuggcggugcaacccgaccuggugcuggggcgugggcaccgggugcacgugcugcggccucgacgucaaggaccuguucaccgacuacauguucgugaaguggaagguggaguacaucaagaccgaggccaucgucugcguggagcugaccagccaggagcgccagugcucccucaucgaggccgggacccgguucaaccugggccccgugacgaucacccugagcgagccccgcaacauccagcagaagcugcccccggagaucgucacccugcacccccggaucgaggagggcuucuucgaccugaugcacgugaagaaggugcucuccgccagcaccgucugcaagcugcaguccugcacccacggggugcccggcgaccuccagguguaccacaucgggaaccugcugaagggcgacaaggucaacgggcaccugauccacaagaucgagccccacuucaacacgagcuggauguccugggacggcugcgaccucgacuacuacugcaacaugggcgacuggccgagcugcuccuacaccggggugacccagcacaaccacgccgcguucgugaacaugcugaacaucgagaccgacuacacgaagaucuuccacuuccacagcaagcgcgucaccgcccacggcgacacgccccagcuggaccucaaggcccggcccaccuacggggccggcgagaucaccgugcugguggaggucgcggacauggagcugcacaccaagaagaucgagaucuccgggcucaaguucgccagccugaccugcaccggcugcuacgccugcuccagcggcaucagcugcaaggugcgcauccacguggacgagcccgacgagcugacgguccacgugaaguccgaggacccggacaucguggccgccagcuccagccucauggcgcggaagcuggaguucgggaccgacuccaccuucaaggccuucagcgccaugcccaagaccucccugugcuucuacaucgucgagcgcgaguacugcaagagcugcuccaaggaggacacgcagaagugcgugaacaccaagcucgagcagccccagagcauccugaucgagcacaagggcaccaucaucgggaagcagaacgacacgugcaccuccaaggccggcugcuggcuggagagcgugaaguccuucuucuacgggcugaagaacaugcucagcggcaucuucggcaacgucuucaucgggaucuuccuguuccuggcccccuucauccuccugauccuguucuucauguucggcuggcggauccucuucugcuucaagugcugccgccggacccgcgggcuguucaaguaccggcaccugaaggacgacgaggagaccggcuaccgcaagaucaucgagcggcucaacaacaagaagggcaagaacaagcugcuggacggggagcgccucgcggaccgcaagaucgccgagcuguucuccaccaagacgcacaucggcuga

SEQ ID NO: 12055 - RNA, 5052 nt, Artificial Sequence
  derived and/or modified CDS sequence (opt1) from CCHFV(K340_6)__KX013475.1__GP
augcacacccugcucgugugcuucauccuguaccugcagcucagcggccucgggggcgcccacguccaguccaacgccaccgagcacaacgggacgaacaccaccaccgcgcccggcacgagccaguccccgaagccgcccgccagcaccacccugccccacacccccgaguccagcacggugaagcccaccacccccaccuccgagacggaggggagcggcgagaccacgcccccgcccaacaccacccagggccugccgcccaccgggaccacccccgagcgcuccgccacgaccgccaccagcaccuccagcacggacaacaugaacuccaccacccaggugaccgacagcacgcccaccuccaccgucagcaccucccccagcuccagcagcuccaugcccagcacgucccagggcauccaccacccggugcggagccugcuguccgugagcucccccaagaccgucaccacccccacgcccaugagcccgggggagaugucccccgagaccagcucccagcacagcgccaugucccgcgugcccacccucuacaccgcgacccaggugagcacggagaacaccgaccgguccacgccccgccagagcgaguccagcguccagccggccacccagucccccaucaccagccccgcccagaccauccugcugaugagcgccgcgcccaaggccauccaggacaugcacccgucccccaccaaccggagcaagcgcaaccucgagguggagaucauccugacccugucccagggccucaagaaguacuacgggaagauccugaagcugcuccaccugacgcuggaggaggacaccgagggccuccuggaguggugcaagcggaaccugggcagcaacugcgacgacgacuucuuccagaagcgcaucgaggaguucuucaucaccggggagggcuacuucaacgaggugcuccaguucaagacccuguccacgcugagccccaccgagccgucccacguccggcuccccaccgccgagcccuucaagagcuacuucgccaagggguuccuguccaucgacagcggcuacuucuccgccaagugcuacccccgcagcuccaccagcggccugcagcucaucaacgugacgcagcacccggcgcggaucgccgagacccccgggcccaagaccaccucccugaagacgaucaacugcaucaaccugcgcgccagcguguucaaggagcaccgggaggucgagaucaacgugcuccugccccagaucgccgugaaccuguccaacugccacgucgugaucaacagccacgugugcgacuacagccucgacaccgacggcccgguccgccugccccggauccaccacgaggggaccuucauccccggcaccuacaagaucgugaucgaccgcaagaacaagcugaacgaccggugcucccucgugacgaacugcgucaucaaggggcgcgaggugcggaagggccagagcguccugcgccaguacaagaccgagaucaagaucggcaaggccuccaccgggagccggaagcugcucuccgaggagcccggcgacgacugcaucagccgcacccagcugcugaagacggagaccgcggagauccacgacgacaacuacgggggcccgggggacaagaucaccaucugcaacggcuccaccaucguggaccagcgccucggcagcgagcuggggugcuacacgaucaaccgggugaaguccuucaagcugugcgagaacagcaccaccggcaagaccugcgagaucgacuccacgcccgucaagugccgccagggguucugccucaagaucacccaggagggccgggggcacgugaagcugagccgcggcuccgaggugguccuggacgccugcgacagcuccugcgagaucaugauccccaagggcaccggggacauccugguggacugcagcggcgggcagcagcacuuccucaaggacaaccugaucgaccugggcugcccccacaucccgccccucggcaagauggccaucuacaucugccggauguccaaccacccccgcaccaccauggccuuccuguucugguucagcuucggguacgugaucacgugcaucuucugcaaggcccuguucuacucccucaucaucaucggcacccuggggaagaagaucaagcaguaccgggagcugaagccccagaccugcaccaucugcgagacggcgccggucaacgccaucgacgccgagaugcacgaccucaacugcagcuacaacaucugccccuacugcgccagccgccugaccuccgacggccuggcccggcacgugacccagugccccaagcgcaaggagaagguggaggagaccgagcucuaccugaaccuggagcggauccccuggaucguccgcaagcuccuccaggugagcgaguccacggggguggcgcugaagcggagcuccuggcugaucguccugcuggugcuccugaccgugagccuguccccgguccagagcgcccccgugggccacggcaagaccaucgagaccuaccagacgcgcgagggguucaccuccaucugccucuucaugcugggcagcauccuguucaucguguccugccucgucaaggggcugguggacagcguguccgacagcuucuuccccggccuguccgucugcaagaccugcagcaucggguccaucaacggcuucgagaucgagagccacaagugcuacugcucccucuucugcugcccguacugccggcacugcagcgccgaccgcgagauccaccagcugcaccugagcaucugcaagaagcggaagaccggcuccaacgugaugcucgccgugugcaagcgcaugugcuucaaggcgacgaucgaggccagccggcgcgcccugcugauccgcuccaucaucaacaccaccuucgucaugugcauccucacccuggccaucugcguggugagcacguccgccgucgagauggaggaccugcccgcggggaccugggagcgggaggaggaccucaccaacuucugccaccaggagugccaggugaccgagacggagugccugugccccuacgaggcccuggugcuccgcaagccccugagccuggacuccaucgucaagggcaugaagaaccuccugaacagcaccucccuggagaccagccucuccaucgaggccccguggggcgccaucaacgugcagagcaccuucaagcccacgguguccaccgccaacaucgcgcugagcugguccagcgucgagcaccgggggaacaagauccuggugaccgggcgcuccgagagcaucaugaagcucgaggagcggaccggcguguccugggaccugggcgucgaggacgccagcgagagcaagcugcucacgguguccaucauggaccugagccagauguacucccccguguucgaguaccugagcggggaccgccaggucgaggaguggcccaaggcgaccugcaccggcgacugcccggagcggugcgggugcaccuccagcacgugccuccacaaggaguggccccacucccgcaacuggcggugcaaccccaccuggugcuggggcguggggaccggcugcacgugcugcggcguggacgucaaggaccuguucaccgaccacauguucaucaaguggaagguggaguacaucaagaccgaggccaucgugugcgucgagcugaccagccaggagcgccagugcucccucaucgaggccgggacccgguucaaccugggccccgugaccaucacgcugagcgagccgcgcaacauccagcagaagcucccgcccgagaucaucacccugcaccccaagaucgaggagggguucuucgaccugaugcacgugcagaagguccucuccgccagcaccgugugcaagcugcaguccugcacccacggcauccccggcgaccugcagaucuaccacaucgggaaccuccugaagggcgaccgggucaacgggcaccugauccacaagaucgagccccacuucaacacgagcuggauguccugggacggcugcgaccucgacuacuacugcaacaugggggacuggcccagcugcaccuacaccggcgugacccagcacaaccacgccgccuucgugaaccugcugaacaucgagacggacuacaccaagaccuuccacuuccacuccaagcgcgucaccgcccacggcgacacgccccagcucgaccugaaggcgcggccgaccuacggggccggcgagaucaccgugcugguggaggucaccgacauggagcuccacacgaagaagguggagaucagcgggcugaaguucgccucccugaccugcaccggcugcuacgccugcagcagcgggaucuccugcaaggugcgcauccacgucgacgagcccgacgagcucaccgugcacgucaagagcuccgaccccgacgugguggccgcgagcacgucccugauggcccggaagcuggaguucggcaccgacagcaccuucaaggccuucuccgccaugcccaagaccagccucugcuucuacaucguggagcgcgaguacugcaaguccugcagcgaggacgacacgaagaagugcgucgacaccaagcuggagcagccgcaguccauccugaucgagcacaagggcaccaucaucgggaagcagaacgacacgugcaccgccaaggcgagcugcuggcucgaguccgucaagagcuucuucuacggccugaagaacaugcugggguccguguucggcagcuucuucguggggauccuccuguuccuggcccccuucgugcuccuggugcuguucuucauguucggcuggaagauccuguucugcuucaagugcugccggcgcacccggggccucuucaaguaccgccacuucaaggacgacgaggagaccggguaccgccggaucaucgagcgccugaacuccaagaagggcaagaaccggcugcucgacggggagcgccuggccgaccggaagaucgccgagcuguucagcaccaagacgcacaucggcuga

SEQ ID NO: 12056 - RNA, 5055 nt, Artificial Sequence
  derived and/or modified CDS sequence (opt1) from CCHFV(Hy13)__AY900145.1__GP
auguacacgccccugcucugcgccgugcugugccugcagcucuggagccuggagggcucccacgggcugagcaacaagacccagcacuccaacaccagcaccaccaaggccccggaggugucccaggaguucggccuccccgugagcaccguguccacgaucaccagcgacccgcccuccaucaccagcgcggucuccgugagcggguccgagggcagcggggacaccaacacgucccccagcgugaccacccagggccugacccugcccgagacgacccucgagcugcugaccaccacggacaccgacgccuccagcaccgucgugguggacgucuccacccagacggugaaggacacccccaucagcaccacccacacgagccuccccuccaccccgagcgccaccaccacgccccagggcacccaccacaccgcccgcgggcugcuguccgugaccagcacgaagcccgagggcgccuccacccaggcgaaccccgagaagaucagcauggagaccaacuccccgcggcucgccaucagcgagacccccuccuucagccccacgacccaggcccccaccgagaacuccaacccgaucaccagcaagcagcugaucuucuccgcccagcccgucacccccaaccccgugacgccgcccgugcagcccgcgcugagccaguccgacaccagcaccgccauccaggacauccaccccuccccgaccagccgcuccaagcggaaccucgagauggagaucauccugacgcugagccaggggcucaagaaguacuacggcaagauccugaagcugcucgaccugacccuggaggaggacaccgaggggcuccuggaguggugcaagcgcaaccugggccucgucugcgacgccgacuucuuccagaagcggaucgaggaguucuuccugaccggcgaggggcacuucaacgaggugcugcaguucaagacgcccagcacccucucccccaccggccccgcccgcaccgggagcccgacgguggagcccuucaaguccuacuucgccaagggcuuccugagcauggacuccggcuacuucagcgcgaagugcuacccccgggccuccaacagcgggcugcagcucaucaacgucacccagcacuccacccgcaucaccgacacgccgggccccaaggugaccaaccugaagaccaucaacugcaucaaccugaaggccagcguguucaaggagcaccgggagaucgagaucaacguccuccugccccagguggccgugaaccuguccagcugccacguccucaucaagucccacgugugcgacuacagccuggacaucgacgggcccguccgccugccgcggauccaccacgagggcaccuucauccccgggacguacaagcucgugaucgacaagaagaacaagcagaacgaccgcugcacccugaucaccaacugcgugaucaagggccgggagauccgcaagggccaguccguccugcggcaguaccgcaccgagaucaagaucgggaaggccagcuccggcagccggcgccuccugagcgaggaguccggggacgacugcaucagccggacgcagcugucccgcaccgagaccgcggagauccacagcgacaacuacggcgggcccggcgacaagaucaccaucugcaacggcuccacgaucguggaccagcggcuggggagcgagcucggcugcuacaccaucaaccgcgugaaguccuucaagcugugcgagaacagcgccaccgggaaguccugcgagaucgacagcacccccaucaagugccgccagggcuucugccugaagaucacgcaggaggggcggggccacgucaagcucucccgcggcagcgagguggugcuggacgccugcgacuccagcugcgagaucaugaucccgaaggggaccggcgacauccuggucgacugcuccgggggccagcagcacuuccucaaggacaaccugaucgaccugggcugccccaacaucccccuccuggggaagauggccaucuacaucugccggaugagcaaccaccccaagaccaccauggccuuccuguucugguucuccuucggcuacgugaucacgugcauccucugcaaggugaucuucuaccugcugaucgucguggggacccucggcaagaaguucaagcaguaccgcgagcugaagccgcagaccugcaccaucugcgagaccacgcccgugaacgcgaucgacgccgagaugcacgaccugaacugcagcuacaacaucugccccuacugcgccucccggcucaccagcgacgggcuggcccgccacgucaugcagugccccaagcggaaggagaagguggaggagaccgagcuguaccucaaccuggagcgcaucccgugggugguccggaagcugcuccaggugagcgaguccaccggcguggcccugaagcgcagcuccuggcuggucgugcuccuggugcugcucacggucagccugucccccgugcagagcgcgcccaucggccacgggaagaccguggagaccuaccagacccgggagggcuacacguccaucugccuguucguccucgggagcauccuguucaucguguccugccugaugaagggccucguggacagcgucgggaacuccuucuuccccggcagcuccaucugcaagaccugcagcaucggcuccaucaacggguucgagaucgagagccacaagugcuacugcucccuguucugcugcccguacugccgccacugcagcgccgaccgggagauccacaagcugcaccucuccaucugcaagaagcgcaagaccggcagcaacgugaugcuggccgugugcaagcggaugugcuuccgcgccaccgucgaggugagcaacaaggcgcugcucauccggaacaucaucaacacgaccuucguggucugcauccugauccuggccgugugcguggucuccaccagcgccguggagauggagucccuccccgccgggaccugggagcgcgaggaggaccugacgaacuucugccaccaggagugccaggccaccgagaccgagugccugugccccuacgaggcgcucgugcugcggaagccccuguucagcgacuccaucgucaagggcaugaagaaccuccugaacagcaccucccuggagacgagccucuccaucgaggccccguggggcgccaucaacgugcagagcaccuucaagcccaccguguccgccgccaacaucgcgcugagcugguccagcgucgagcaccgcgggaacaagauccugguguccggccgcagcgaguccaucaugaagcucgaggagcggaccgggaucagcugggaccugggcguggaggacgccuccgagagcaagcugcucacggucagcaucauggaccugucccagauguacagccccguguucgaguaccuguccggggaccgccagguggaggaguggccgaaggcgaccugcaccggcgacugccccgagcggugcgggugcaccagcuccacgugccuccacaaggaguggccccacagccgcaacuggcggugcaaccccaccuggugcuggggcgucggcaccgggugcacgugcugcggccuggacgugaaggaccuguucaccgaccacauguucgucaaguggaagguggaguacaucaagaccgaggccaucgugugcgucgagcucaccucccaggagcgccagugcagccugaucgaggccgggacccgguucaaccugggcccggugacgaucacccucuccgagccccgcaacauccagcagaagcugccgcccgagaucgugacccugcacccccggaucgaggagggcuucuucgaccucaugcacgucaagaaggugcugagcgccuccaccgugugcaagcugcagagcugcacccacgggguccccggcgaccuccagguguaccacaucgggaaccugcugaagggcgacaaggugaacgggcaccucauccacaagaucgagccccacuucaacacguccuggaugagcugggacggcugcgaccuggacuacuacugcaacaugggcgacuggcccuccugcagcuacaccggggucacccagcacaaccacgccgccuucgugaacaugcugaacaucgagaccgacuacacgaagaucuuccacuuccacuccaagcgcgugaccgcccacggcgacaccccgcagcucgaccugaaggcgcggcccaccuacggggccggcgagaucacgguccugguggagguggccgacauggagcuccacaccaagaagaucgagaucagcgggcugaaguucgccucccugaccugcaccggcugcuacgccugcagcagcggcaucuccugcaagguccgcauccacguggacgagcccgacgagcucacggugcacgucaagagcgaggaccccgacaucguggcggccuccagcucccugauggcccggaagcuggaguucgggaccgacagcaccuucaaggccuucuccgccaugccgaagaccagccucugcuucuacaucguggagcgcgaguacugcaaguccugcagcaaggaggacacgcagaagugcgucaacaccaagcuggagcagccccaguccauccugaucgagcacaagggcaccaucaucgggaagcagaacgacacgugcaccagcaaggcgggcugcuggcucgaguccgucaagagcuucuucuacgggcugaagaacaugcuguccggcaucuucggcaacguguucaucgggaucuuccuguuccucgcccccuucauccugcugauccucuucuucauguucggcuggcggauccuguucugcuucaagugcugccgccggacccgcgggcuguucaaguaccggcaccucaaggacgacgaggagaccggcuaccgcaagaucaucgagcggcugaacaacaagaagggcaagaacaagcugcucgacggggagcgccuggccgaccgcaagaucgccgagcuguucagcaccaagacgcacaucggcuga

SEQ ID NO: 12057 - RNA, 5052 nt, Artificial Sequence
  derived and/or modified CDS sequence (opt1) from CCHFV(4574-ST-2008)__KR814870.1__GP
augcacacccugcucgugugcuucauccuguaccugcagcuccugggccccgggggcgcccacgggcagccgaacgccaccgagcacaaccgcacgaacaccaccaccgcgcccagcacgucccagagccccaagcccccggucuccaccgccccgccccacgcccuggagagccccaccaucaaguccaccacgcccaccagcgagaccgagggcuccggggagaccacgagcccgcccaacaccacccagggccccucccuccccgagaccacgcccaagcggcccgccaccaccgccaccagcacgcccuccaccgacaacaccaacagcaccacgcacgugaccgacaacaacccgaccuccaccaucagcacgucccccagcuccagccccuccacccccagcaccccgcgcggcauccaccaccccgcgcggaaccugcugagcguguccagccccaagaccgccacgacccccaccccgaccucccccggggagaucagcuccgagacgagcucccuccacagcgccaugucccgcaccagcacccuguacaccgccacccaggcguccacggagaacgccaaccacagcgcgccccggcaguccgagagccccgcccagccgaccaccaccucccugaugacgagccccgcccaguccauccucgucaugagcgccgcccccaccgccauccagaacauccacccgucccccaccaaccgcagcaagcggaaccuggagauggagaucauccugacccucagccagggccugaagaaguacuacgggaagauccugaagcuccugcaccugacgcucgaggaggacaccgagggccugcuggaguggugcaagcgcaaccucggguccaacugcgaggacgacuucuuccagaagcggaucgaggaguucuucaugaccggcgagggcuacuucaacgaggugcugcaguucaagacccugagcacgcucucccccaccgagcccagccacgcccgcccgcccaccguggagcccuucaaguccuacuucgccaagggguuccugagcaucgacuccggcuacuucagcgcgaagugcuacccccgguccagcaccuccgggcugcagcucaucaacgucacgcagcacccggcccgcaucgccgagacccccggccccaagaccaccagccugaagacgaucaacugcaucaaccugcgggccuccguguucaaggagcaccgcgagaucgagaucaacgugcuccugccccagaucgccgucaaccugagcaacugccacguggugaucaacucccacgucugcgacuacagccucgacaccgacggcccggugcggcugccccacaucuaccacgaggggaccuucauccccggcaccuacaagaucgugaucgacaagaagaacaagcugaacgaccgcugcacgcucgucaccaacugcgugaucaaggggcgggaggugcgcaagggccaguccguccugcggcaguacaagaccgagaucaagaucgggaaggugagcaccggcagccgcaagcugcucuccgaggagagcggcgacgacugcaucucccggacgcagcugcugcgcaccgagaccgcggagauccacgacgacaacuacgggggccccggggacaagaucaccaucugcaacggcagcacgaucguggaccagcgccucggguccgagcugggcugcuacaccaucaaccgggucaagagcuucaagcugugcgagaacuccgccaccggcaagaccugcgagaucgacagcacgccggugaagugccgccagggguucugccucaagaucacccaggagggccgggggcacgugaagcugucccgcggcagcgaggucgugcuggacgccugcgacuccagcugcgaggucaugauccccaaggggaccggcgacauccugguggacugcuccggcgggcagcagcacuuccucaaggacaaccugaucgaccugggcugcccccacaucccccuccuggggaagauggccaucuacaucugccggaugagcaaccacccgcgcaccaccauggccuuccuguucugguucuccuucggcuacgugaucacgugccucuucugcaaggcgcuguucuacagccugaucaucaucggcacccucgggaagaagaucaagcaguaccgggagcugcgcccccagaccugcaccaucugcgagacggcccccgucaacgccaucgacgccgagaugcacgaccugaacugcuccuacaacaucugccccuacugcgcgagccggcucaccuccgacggccuggcccgccacgugccgcagugccccaagcggaaggagaagguggaggagaccgagcuguaccucaaccuggagcgcauccccuggaucguccggaagcugcuccaggugagcgagagcaccgggguggcccugaagcgcuccagcuggcugaucguccuccuggugcugcucacggugucccugagcccgguccaguccgcccccgugggccacgggaagaccaucgagaccuaccagacccgggagggcuucacgagcaucugccuguucaugcucggcuccauccuguuccuggugagcugccucgucaaggggcugguggacuccgugagcgacuccuucuuccccggccugagcgucugcaagaccugcuccaucgggagcaucaacggcuucgagaucgagucccacaagugcuacugcagccuccugugcugccccuacugccgccacugcuccgccgaccgggagauccaccagcugcaccucagcaucugcaagaagcgcaagaccggguccaacgugaugcuggcggugugcaagcggaugugcuuccgcgccaccaucgaggccagccgccgggcccugcucauccgcagcaucaucaacacgaccuucgucaucugcauccugacccugaccaucugcgugguguccacgagcgccgucgagauggagaaccucccguccggcaccugggagaaggaggaggaccugaccaacuucugccaccaggagugccaggugaccgagacggagugccugugccccuacgaggcgcucgugcugcggaagccccuguuccucgacagcaucgucaagggcaugaagaaccugcugaacuccaccagccucgagaccucccugagcaucgaggcccccuggggcgccaucaacgugcaguccaccuucaagccgacggugagcaccgccaacaucgcccuguccuggagcuccgucgagcaccgcgggaacaagauccucgugaccgggcggagcgaguccaucaugaagcuggaggagcgcaccggcgugagcugggaccugggggucgaggacgcguccgagagcaagcuccugacgguguccaucauggaccugagccagauguacagccccguguucgaguaccucuccggcgaccggcaggucgaggaguggcccaaggcgaccugcaccggcgacugccccgagcgcugcgggugcaccagcuccacgugccugcacaaggaguggccgcacagccggaacuggcgcugcaaccccaccuggugcuggggcguggggaccggcugcacgugcugcgggguggacgucaaggaccuguucaccgaccacauguucgugaaguggaagguggaguacaucaagaccgaggccaucgucugcguggagcucaccucccaggagcggcagugcagccugaucgaggccggcacccgcuucaaccugggccccgugaccaucacgcucuccgagccccggaacauccagcagaagcugccgcccgagaucaucacccugcaccccaaggucgaggagggguucuucgaccucaugcacgugcagaaggugcugagcgccuccaccgucugcaagcugcagagcugcacccacggcauccccggggaccuccagguguaccacaucggcaaccugcugaagggcgaccgcgugaacgggcaccucauccacaagaucgagccgcacuucaacacguccuggaugagcugggacggcugcgaccuggacuacuacugcaacaugggggacuggcccuccugcaccuacaccggcgucacccagcacaaccacgccgccuucgugaaccugcucaacaucgagacggacuacaccaagaccuuccacuuccacagcaagcgggucaccgcccacggggacacgccccagcuggaccugaaggcccgccccaccuacggcgcgggcgagaucaccgugcucguggaggucgccgacauggagcugcacaccaagaagguggagaucuccgggcugaaguucgccagccucgccugcacgggcugcuacgccugcuccagcgggaucuccugcaaggugcggauccacgucgacgagccggacgagcugaccgugcacgucaagagcagcgaccccgacgugguggcggccuccaccagccugauggcccgcaagcucgaguucggcaccgacuccacguucaaggccuucagcgccaugcccaagaccucccugugcuucuacaucguggagcgggaguacugcaagagcugcuccgaggaggacacccagaagugcgucgacaccaagcuggagcagccccagagcauccucaucgagcacaaggggacgaucaucggcaagcagaacgacacgugcaccgcgaaggccuccugcuggcuggagagcgugaaguccuucuucuacggccugaagaacaugcucgggagcguguucggcaacuucuucaucgggauccugcuguuccuggccccguucguccuccuggugcuguucuucauguucggcuggaagauccucuucugcuucaagugcugccgccgggcccgcgggcugcugaaguaccgccaccucaaggacgacgaggagaccggcuaccggaagaucaucgagcgccugaacaacaagaagggcaagaaccggcugcucgacggggagcgccuggcggaccggaagaucgccgagcuguucuccaccaagacccacaucggcuga

SEQ ID NO: 12058 - RNA, 5052 nt, Artificial Sequence
  derived and/or modified CDS sequence (opt1) from CCHFV(75-ST-2010)__KR814864.1__GP
augcacacccugcucgugugcuucauccuguaccugcagcuccugggccccgggggcgcccacgggcagccgaacgccaccgagcacaaccgcacgaacaccaccaccgcgcccagcacgucccagagccccaagcccccggucuccaccgccccgccccacgcccuggagagccccaccaucaaguccaccacgcccaccagcgagaccgagggcuccggggagaccacgcccccgcccaacaccacccagggccccagccuccccgagaccacgcccgagcggcccgccaccaccgccaccuccacgccgagcaccgacaacaccaacuccaccacgcacgugaccgacaacaaccccaccagcaccaucuccacgagccccuccagcucccccagcaccccguccacgccccgcggcauccaccaccccgcgcggaaccugcugagcgugagcucccccaagaccgccaccaccccgacccccaccagccccggggagaucuccagcgagacguccagccuccacuccgccaugagccgcaccuccacccuguacaccgccacccaggcgagcacggagaacgccaaccacuccgcgccccggcagagcgaguccccggcccagcccaccaccaccagccugaugacgucccccgcccagagcauccucgucauguccgccgccccgaccgccauccagaacauccaccccagccccaccaaccgcuccaagcggaaccuggagauggagaucauccugacccucagccagggccugaagaaguacuacgggaagauccugaagcuccugcaccugacgcucgaggaggacaccgagggccugcuggaguggugcaagcgcaaccucgggagcaacugcgacgacgacuucuuccagaagcggaucgaggaguucuucaugaccggcgagggcuacuucaacgaggugcugcaguucaagacccuguccacgcucagccccaccgagccgucccacgcccgcccgcccaccguggagcccuucaagagcuacuucgccaagggguuccuguccaucgacagcggcuacuucuccgcgaagugcuacccccggagcuccaccagcgggcugcagcucaucaacgucacgcagcaccccgcccgcaucgccgagacccccggccccaagaccaccucccugaagacgaucaacugcaucaaccugcgggccagcguguucaaggagcaccgcgagaucgagaucaacgugcuccugccgcagaucgccgucaaccuguccaacugccacguggugaucaacagccacgucugcgacuacucccucgacaccgacggccccgugcggcugccccacaucuaccacgaggggaccuucauccccggcaccuacaagaucgugaucgacaagaagaacaagcugaacgaccgcugcacgcucgucaccaacugcgugaucaaggggcgggaggugcgcaagggccagagcguccugcggcaguacaagaccgagaucaagaucgggaagguguccaccggcagccgcaagcugcucagcgaggaguccggcgacgacugcaucagccggacgcagcugcugcgcaccgagaccgcggagauccacgacgacaacuacgggggcccgggggacaagaucaccaucugcaacggcuccacgaucguggaccagcgccucgggagcgagcugggcugcuacaccaucaaccgggucaaguccuucaagcugugcgagaacagcgccaccggcaagaccugcgagaucgacuccacgcccgugaagugccgccagggguucugccucaagaucacccaggagggccgggggcacgugaagcugagccgcggcuccgaggucgugcuggacgccugcgacagcuccugcgaggucaugauccccaaggggaccggcgacauccugguggacugcagcggcgggcagcagcacuuccucaaggacaaccugaucgaccugggcugcccccacaucccgcuccuggggaagauggccaucuacaucugccggauguccaaccacccccgcaccaccauggccuuccuguucugguucagcuucggcuacgugaucacgugccucuucugcaaggcgcuguucuacucccugaucaucaucggcacccucgggaagaagaucaagcaguaccgggagcugcgcccccagaccugcaccaucugcgagacggcccccgucaacgccaucgacgccgagaugcacgaccugaacugcagcuacaacaucugcccguacugcgcgucccggcucaccagcgacggccuggcccgccacgugccccagugccccaagcggaaggagaagguggaggagaccgagcuguaccucaaccuggagcgcaucccguggaucguccggaagcugcuccagguguccgagagcaccgggguggcccugaagcgcagcuccuggcugaucguccuccuggugcugcucacggugagccugucccccguccagagcgcccccgugggccacgggaagaccaucgagaccuaccagacccgggagggcuucacguccaucugccuguucaugcucggcagcauccuguuccugguguccugccucgucaaggggcugguggacagcguguccgacagcuucuuccccggccuguccgucugcaagaccugcagcaucggguccaucaacggcuucgagaucgagagccacaagugcuacugcucccuccugugcugcccguacugccgccacugcagcgccgaccgggagauccaccagcugcaccucuccaucugcaagaagcgcaagaccgggagcaacgugaugcuggcggugugcaagcggaugugcuuccgcgccaccaucgaggccucccgccgggcccugcucauccgcagcaucaucaacacgaccuucgucaucugcauccugacccugaccaucugcguggugagcacguccgccgucgagauggagaaccuccccagcggcaccugggagaaggaggaggaccugaccaacuucugccaccaggagugccaggugaccgagacggagugccugugccccuacgaggcgcucgugcugcggaagccccuguuccucgacuccaucgucaagggcaugaagaaccugcugaacagcaccucccucgagaccagccuguccaucgaggccccguggggcgccaucaacgugcagagcaccuucaagcccacgguguccaccgccaacaucgcccugagcugguccagcgucgagcaccgcgggaacaagauccucgugaccgggcgguccgagagcaucaugaagcuggaggagcgcaccggcguguccugggaccugggggucgaggacgcgagcgaguccaagcuccugacggugagcaucauggaccugucccagauguacagccccguguucgaguaccucagcggcgaccggcaggucgaggaguggcccaaggcgaccugcaccggcgacugcccggagcgcugcgggugcaccuccagcacgugccugcacaaggaguggccccacucccggaacuggcgcugcaaccccaccuggugcuggggcguggggaccggcugcacgugcugcgggguggacgucaaggaccuguucaccgaccacauguucgugaaguggaagguggaguacaucaagaccgaggccaucgucugcguggagcucaccagccaggagcggcagugcucccugaucgaggccggcacccgcuucaaccugggccccgugaccaucacgcucagcgagccgcggaacauccagcagaagcugccgcccgagaucaucacccugcaccccaaggucgaggagggguucuucgaccucaugcacgugcagaaggugcuguccgccagcaccgucugcaagcugcaguccugcacccacggcauccccggggaccuccagguguaccacaucggcaaccugcugaagggcgaccgcgugaacgggcaccucauccacaagaucgagccccacuucaacacgagcuggauguccugggacggcugcgaccuggacuacuacugcaacaugggggacuggcccagcugcaccuacaccggcgucacccagcacaaccacgccgccuucgugaaccugcucaacaucgagacggacuacaccaagaccuuccacuuccacuccaagcgggucaccgcccacggggacacgccccagcuggaccugaaggcccgcccgaccuacggcgcgggcgagaucaccgugcucguggaggucgccgacauggagcugcacaccaagaagguggagaucagcgggcugaaguucgccucccucgccugcacgggcugcuacgccugcagcuccgggaucagcugcaaggugcggauccacgucgacgagcccgacgagcugaccgugcacgugaaguccagcgaccccgacgucguggcggccagcaccucccugauggcccgcaagcucgaguucggcaccgacagcacguucaaggccuucuccgccaugcccaagaccagccugugcuucuacaucguggagcgggaguacugcaaguccugcagcgaggaggacacccagaagugcgucgacaccaagcuggagcagccgcaguccauccucaucgagcacaaggggacgaucaucggcaagcagaacgacacgugcaccgcgaaggccagcugcuggcuggaguccgucaagagcuucuucuacggccugaagaacaugcucggguccguguucggcaacuucuucaucgggauccugcuguuccuggcccccuucgugcuccuggugcuguucuucauguucggcuggaagauccucuucugcuucaagugcugccgccgggcccgcgggcugcugaaguaccgccaccucaaggacgacgaggagaccggcuaccggaagaucaucgagcgccugaacaacaagaagggcaagaaccggcugcucgacggggagcgccuggcggaccggaagaucgccgagcuguucagcaccaagacccacaucggcuga

SEQ ID NO: 12059 - RNA, 5052 nt, Artificial Sequence
  derived and/or modified CDS sequence (opt1) from CCHFV(37-R-2013)__KR814858.1__GP
augcacacccugcucgugugcuucauccuguaccugcagcuccugggccucgggggcgcccaccgccagagcaacgccaccgagcacaacgggacgaacaccaccaccgcgcccuccacgagccaguccccgaagccgcccgucagcaccgcgccgccccacgcccccgagaccuccaccaucaagcccacgacccccgccagcgagaccgagggcuccggggagaccacgcccccgcccaacaccacccagggccccagcccgcccgaggccacccccgagcggcccgccacgaccgugaccuccacccccagcacggacaacaccaacuccaccacccacgccacggacaacaaccccaccagcaccaucuccaccagccccuccagcucccccagcacgccguccacgccccagggcauccaccaccccgcccgcaaccuccugagcgugagcucccccaagaccgccaccaccccgacccccaccagccccggggacaucuccagcgagaccuccagccugcacuccgcgaugagccggacgcccacccuccacaccgccacccaggccuccaccgagaacgccaaccacagcgccccgcgccaguccgagagcuccgcgcagcagacgaccaccagccccaugaccucccccgcccagccgauccuggucaugagcgccgcccccacggccauccagaacauccaccccucccccaccaaccggagcaagcgcaaccuggagauggagaucauccucacccugucccagggccugaagaaguacuacgggaagauccucaagcugcugcaccucacccuggaggaggacacggagggccugcucgaguggugcaagcggaaccuggggagcaacugcgacgacgacuucuuccagaagcgcaucgaggaguucuucaugaccggcgagggcuacuucaacgaggugcugcaguucaagacccucagcacccuguccccgacggagcccagccacgcgcggccgcccaccguggagcccuucaaguccuacuucgccaagggguuccugagcaucgacuccggcuacuucagcgccaagugcuacccccgccucaccaccuccgggcugcagcugaucaacgucacgcagcaccccgcccggaucgccgagacccccggcccgaagaccaccagccucaagacgaucaacugcaucaaccugcgcgcguccguguucaaggagcaccgggagaucgagaucaacgugcugcucccccagaucgccgucaaccugagcaacugccacguggugaucaacucccacgucugcgacuacagccuggacaccgacggccccgugcgccucccccacaucuaccacgaggggaccuucaucccgggcaccuacaagaucgugaucgacaagaagaacaagcugaacgaccggugcacgcuggucaccaacugcgugaucaaggggcgcgaggugcggaagggccaguccguccuccgccaguacaagaccgagaucaagaucgggaaggccagcaccggcucccggaagcugcugagcgaggagcccggcgacgacugcaucucccgcacgcagcuccugcggaccgagaccgccgagauccacgacgacaacuacgggggccccggggacaagaucaccaucugcaacggcagcacgaucguggaccagcgccuggggagcgagcucggcugcuacaccaucaaccgcgugaaguccuucaagcugugcgagaacagcgccaccggcaagaccugcgagaucgacuccacgcccgucaagugccggcagggguucugccugaagaucacccaggagggccgcgggcacgugaagcucagccggggcuccgaggugguccuggacgcgugcgacaccagcugcgaggugaugaucccgaaggggaccggcgacauccuggucgacugcuccggcgggcagcagcacuuccugaaggacaaccucaucgaccugggcugcccccacaucccccugcucgggaagauggccaucuacaucugccgcaugagcaaccacccccggaccacgauggccuuccuguucugguucuccuucggcuacgugaucacgugcaucuucugcaaggcccuguucuacagccucaucaucaucggcacccuggggaagaagaucaagcaguaccgcgagcugaagccgcagaccugcaccaucugcgagaccgcgcccgugaacgccaucgacgccgagaugcacgaccucaacugcuccuacaacaucugccccuacugcgccagccggcugaccuccgacggccuggcccgccacgucccgcagugccccaagcggaaggagaagguggaggagaccgagcucuaccugaaccuggagcgcauccccuggaucgugcggaagcuccugcaggucagcgaguccacggggguggcgcugaagcgcagcuccuggcucaucgugcugcugguccuccugaccgugagccugucccccgugcagagcgccccggucggccacgggaagaccaucgagaccuaccagacgcgggagggcuucaccagcgugugccucuucaugcugggcuccauccuguuccucgugagcugccuggucaaggggcugguggacuccgugagcgacuccuucuuccccggccucagcgucugcaagaccugcuccaucgggagcaucaacggcuucgagaucgagucccacaagugcuacugcagccuguucugcugccccuacugccgccacugcuccgccgaccgggagauccaccagcugcaccucagcaucugcaagaagcgcaagaugggguccaacgugaugcuggccgugugcaagcggaugugcuuccgcgccaccaucgaggcgagccggcgcgcccugcucauccgcuccaucaucaacacgaccuucgucaucugcauccugacccugaccaucugcguggugagcacguccgccgucgagauggagaaccuccccagcggcaccugggagcgggaggaggaccugaccaacuucugccaccaggagugccaggugaccgagacggagugccugugcccguacgaggcccucgugcugcgcaagccccuguuccucgacuccaucgucaagggcaugaagaaccugcugaacagcaccagccucgagaccucccugagcaucgaggcccccuggggcgcgaucaacgugcaguccaccuucaagcccacggugagcaccgccaacaucgcccuguccuggagcuccgucgagcaccgggggaacaagauccucgugaccgggcgcagcgaguccaucaugaagcuggaggagcggaccggcgugagcugggaccugggggucgacgacgccuccgagagcaagcuccugacgguguccaucauggaccugagccagauguacuccccgguguucgaguaccucagcggcgaccgccaggucgaggaguggcccaaggcgaccugcaccggcgacugccccgagcggugcgggugcaccuccagcacgugccugcacaaggaguggccccacucccgcaacuggcggugcaacccgaccuggugcuggggcguggggaccggcugcacgugcugcgggguggacgucaaggaccuguucaccgaccacauguucgugaaguggaagguggaguacaucaagaccgaggccaucgucugcguggagcucaccagccaggagcgccagugcagccugaucgaggccggcacccgguucaaccugggccccgugaccaucacgcucuccgagccccgcaacauccagcagaagcugcccccggagaucaucacccugcaccccaaggucgaggagggguucuucgaccucaugcacgugcagaaggugcugagcgccuccaccgucugcaagcugcagagcugcacccacggcauccccggggaccuccagguguaccacaucggcaaccugcugaagggcgaccgggugaacgggcaccucauccacaagaucgagccccacuucaacacguccuggaugagcugggacggcugcgaccuggacuacuacugcaacaugggggacuggccguccugcaccuacaccggcgucacccagcacaaccacgccgcguucgugaaccugcucaacaucgagacggacuacaccaagaccuuccacuuccacagcaagcgcgucaccgcccacggggacacgccccagcuggaccugaaggcccggcccaccuacggcgccggcgagaucaccgugcucguggaggucgccgacauggagcugcacaccaagaagguggagaucuccgggcugaaguucgcgagccucgccugcacgggcugcuacgccugcuccagcgggaucuccugcaaggugcgcauccacgucgacgagcccgacgagcugaccgugcacgucaagagcaacgacccggacgugguggccgccuccaccagccugauggcgcggaagcucgaguucggcaccgacuccacguucaaggccuucagcgccaugcccaagaccucccugugcuucuacaucguggagcgcgaguacugcaagagcugcagcgaggaggacacccagaagugcgucgacaccaagcuggagcagccccaguccauccucaucgagcacaaggggacgaucaucggcaagcagaacgugaccugcaccgccaaggcgagcugcuggcuggaguccgucaagagcuucuucuacggccugaagaacaugcucggguccguguucggcaacuucuucaucgggauccugcuguuccucgccccguucgugcugcuggugcuguucuucauguucggcuggaagauccucuucugcuucaagugcugccggcgcacccgggggcugcugaaguaccgccuccugaaggacgacgaggagacgggcuaccgccggaucaucgagcgccugaacaacaagaagggcaagaaccggcuccuggacggggagcgccuggccgaccggaagaucgccgagcuguucagcaccaagacccacaucggcuga

SEQ ID NO: 12060 - RNA, 5052 nt, Artificial Sequence
  derived and/or modified CDS sequence (opt1) from CCHFV(Kashmanov)__DQ211631.1__GP
augcacacccugcuggugugcuucauccuguaccugcagcugcugggccucggcggggcccacgggcaguccaacgccaccgagcacaacgggaccaacaccaccaccgcccccuccaccagccaguccccgaagccccucgucagcaccgccccgccccacgcccuggaguccagcaccaucaagcccaccacccccgccuccgagaccgaggggagcggcgagaccacgccgccgcccaacaccacccagggccccagcccgcccgagaccacccccgagcgccccgccaccaccgccaccagcacccccuccaccgacaacaccaacagcaccacccacgugacggacaacaaccccaccuccaccaucagcaccuccccgagcuccagccccuccacgcccagcacgccccaggggauccaccacccggcccggaaccugcucagcguguccagccccaagaccgccaccacgcccacccccaccuccccgggcgagaucagcuccgaggccagcucccugcacagcgcgaugucccgcaccagcacgcuguacaccgccacccaggucuccaccgagaacgccaaccacagcgcgccccggcaguccgagagcuccgcccagcccaccacgaccagccccaugaccuccccggcgcagagcauccucgugauguccgccgcccccaucgccauccagaacauccaccccagcccgaccaaccgcagcaagcggaaccuggagauggagaucauccugacgcucucccaggggcugaagaaguacuacggcaagauccugaagcuccugcaccugacccucgaggaggacaccgaggggcugcuggaguggugcaagcgcaaccucggcagcaacugcgacgacgacuucuuccagaagcggaucgaggaguucuucaugaccggcgagggguacuucaacgaggugcugcaguucaagacgcuguccacccucagccccaccgagcccucccacgccggcccgcccaccgucgagcccuucaagagcuacuucgcgaagggguuccuguccaucgacagcggcuacuucuccgccaagugcuacccccgcagcuccacgagcggccugcagcucaucaacgugacccagcaccccgcccggaucgccgagacccccgggcccaagaccacgucccugaagaccaucaacugcaucaaccugcgcgccagcguguucaaggagcaccgggagaucgagaucaacguccuccugccccagaucgcggugaaccuguccaacugccacguggucaucaacagccacgugugcgacuacucccucgacaccgacggccccgugcgccugccgcacaucuaccacgaggggaccuucauccccggcacguacaagaucgucaucgacaagaagaacaagcugaacgaccggugcacccucgugaccaacugcgugaucaaggggcgcgagguccggaagggccagagcgugcugcgccaguacaagaccgagaucaagaucggcaaggccagcacggggucccggaagcugcucagcgaggagcccggcgacgacugcaucucccgcacccagcugcugcggaccgagaccgccgagauccacgacgacaacuacgggggccccggggacaagaucacgaucugcaacggcagcaccaucguggaccagcgccucggcuccgagcuggggugcuacaccaucaaccgggucaagagcuucaagcugugcgagaacuccgccaccggcaagacgugcgagaucgacagcaccccggugaagugccgccagggguucugccucaagaucacccaggagggccgcgggcacgugaagcugucccggggcagcgaggucgugcuggacgccugcgacuccagcugcgaggucaugauccccaagggcaccggggacauccugguggacugcuccggcgggcagcagcacuuccucaaggacaaccugaucgaccugggcugcccccacaucccccuccugggcaagauggcgaucuacaucugccgcaugagcaaccacccgcggacgaccauggccuuccuguucugguucuccuucggguacgugaucacgugcaucuucugcaaggcccucuucuacagccugaucaucaucggcacccuggggaagaagaucaagcaguaccgcgagcucaagccccagaccugcacgaucugcgagaccgcccccgucaacgcgaucgacgccgagaugcacgaccugaacugcuccuacaacaucugccccuacugcgccagccggcugaccuccgacggccucgcccgccacgugccgcagugccccaagcggaaggagaagguggaggagaccgagcuguaccugaaccucgagcgcauccccuggaucguccggaagcugcuccaggugagcgagagcacggggguggcccucaagcgcuccagcuggcugaucguccugcucgugcugcugaccgugucccucagcccgguccaguccgcgcccgugggccacggcaagaccaucgagaccuaccagacgcgggagggguucaccagcaucugccuguucaugcugggcuccauccucuuccuggugagcugccuggucaaggggcucguggacuccgugagcgacuccuucuuccccggccugagcgucugcaagaccugcaccaucggguccaucaacggcuucgagaucgagagccacaagugcuacugcucccuguucugcugccccuacugccgccacugcagcgccgaccgggagauccaccagcuccaccuguccaucugcaagaagcgcaagacgggcagcaacgugaugcuggccgugugcaagcggaugugcuuccgcgccaccaucgaggccucccggcgcgcgcuccugauccggagcaucaucaacaccaccuucgucaucugcauccugacgcucaccaucugcguggugagcaccuccgccgucgagauggagaaccugccgagcgggaccugggagcgcgaggaggaccugacgaacuucugccaccaggagugccaggugaccgagaccgagugccucugccccuacgaggcccuggugcugcgcaagccccucuuccuggacuccaucgucaagggcaugaagaacagccugaacuccaccagccucgagacgucccugagcaucgaggcccccuggggcgccaucaacgugcaguccaccuucaagccgaccgugagcaccgcgaacaucgcccuguccuggagcuccgucgagcaccggggcaacaagauccucgugacggggcgcagcgaguccaucaugaagcuggaggagcggaccggcgugagcugggaccugggcgucgaggacgccuccgagagcaagcuccugaccguguccaucauggaccugagccagauguacagccccguguucgaguaccucuccggggaccgccaggucgaggaguggcccaaggcgaccugcacgggcgacugccccgagcggugcgggugcaccagcagcacgugccugcacaaggaguggccgcacagccgcaacuggcggugcaaccccaccuggugcuggggcguggggaccggcugcacgugcugcggcguggacgucaaggaccuguucaccgaccacauguucgugaaguggaagguggaguacaucaagaccgaggcgaucgucugcguggagcucaccucccaggagcgccagugcagccugaucgaggccgggacgcgguucaaccugggccccgugaccaucacccucuccgagccccgcaacauccagcagaagcugccgcccgagaucaucacccugcaccccaaggucgaggagggguucuucgaccucaugcacgugcagaaggugcugagcgccuccacggucugcaagcugcagagcugcacccacggcauccccggcgaccuccagguguaccacaucgggaaccugcugaagggcgaccggaucaacgggcaccucauccacaagaucgagccgcacuucaacaccuccuggaugagcugggacggcugcgaccuggacuacuacugcaacaugggggacuggcccuccugcaccuacacgggcgugacccagcacaaccacgccgccuucgucaaccugcucaacaucgagaccgacuacaccaagacguuccacuuccacagcaagcgcgugaccgcgcacggcgacacgccccagcuggaccugaaggcccggcccaccuacggggccggcgagaucacgguccucguggagguggccgacauggagcugcacaccaagaaggucgagaucuccgggcugaaguucgccagccucgcgugcaccggcugcuacgccugcuccagcgggaucuccugcaaggugcgcauccacguggacgagccggacgagcugaccguccacgugaaguccagcgaccccgacguggucgccgccuccacgagccugauggcccggaagcucgaguucggcaccgacuccaccuucaaggcguucagcgccaugcccaagaccucccugugcuucuacaucguggagcgcgaguacugcaagagcugcuccgaggaggacacgcagaagugcguggacaccaagcuggagcagccccagagcauccucaucgagcacaagggcaccaucaucgggaagcagaacgacacgugcacggccaaggccuccugcuggcuggagagcgucaaguccuucuucuacggccugaagaacaugcucgggagcguguucggcaacuucuucaucgggauccugcuguuccucgcgccguucgugcugcugguccuguucuucauguucggcuggaagauccucuucugcuucaagugcugccggcgcacccggggccugcugaaguaccgccaccucaaggacgacgaggagaccggguaccggcgcaucaucgagcgccugaacaacaagaagggcaagaaccggcugcucgacggggagcgccuggccgaccggaagaucgccgagcuguucuccaccaagacgcacaucggcuga

SEQ ID NO: 12061 - RNA, 5052 nt, Artificial Sequence
  derived and/or modified CDS sequence (opt1) from CCHFV(Haskovo-V46/13)__KR092379.1__GP
augcacacccugcuggugugcuucauccuguaccugcagcuccugggccucggcggggcccacgggcaguccaacaccaccgagcacaacgggaccaacaacaccaccgcccccgggaccucccagagcccgaagccccacauguccaccaccccgccccacgcgcccgagagcuccaccaucaagcccaccacccccaccagcgagaccgagggcuccggcgagaccacgccgcccagcaacaccacccaggggcccagcccgcccgagaccaccagcgagcggcccgccaccaccgccaucuccacgagcuccaccgacaacaugaaccccaccagccagaugaccgacaacacgcccaccuccaccgucagcaucucccccagcuccagccccagcacccccuccacgccccagggcaugcaccaccccgcccggagccuccuguccgugagcuccccgaagaccgccaccacccccacgcccaccagccccguggaggucggguccgagaccagcucccagcacagcgcgauguccagcaccccgacgccccacaccgccacccagguguccaccgagaacaccaaccacagcacgccccgccaguccgagcccagcgcccagcagaccaccccgucccccaugcccagcccggcccaguccacccugcucaugagcgcggcccccacggccgugcagaacacccaccccagccccaccaaccgguccaagcgcaaccuggagauggagaucauccugacccucagccagggccugaagaaguacuacgggaagauccugaagcuccugcaccugacgcucgaggaggacaccgagggccugcuggaguggugcaagcggaaccucggcuccaacugcgacgacgacuucuuccagaagcgcaucgaggaguucuucaugaccggggagggcuacuucaacgagguccugcaguucaagacccugagcacgcucuccccgauggagcccagccacgccgagcugcccaccgccgagcccuucaaguccuacuucgcgaagggguuccugagcaucgacuccggcuacuucagcgccaagugcuacccgcgguccagcaccuccggccuccagcugaucaacgugacccagcaccccgcccgcaucgccgagacgcccgggcccaagaccaccagccugaaggccaucaacugcaucaaccuccgggcguccguguucaaggagcaccgcgagaucgagaucaacguccugcugccgcagaucgccgugaaccucagcaacugccacguggucaucaacucccacgugugcgacuacagccuggacaccgacggccccgugcggcugccccacaucuaccacgaggggacguucauccccggcaccuacaagaucgucaucgacaagaagaacaagcucaacgaccgcugcacccuggugaccaacugcgugaucaaggggcgggagguccgcaagggccagagcgugcugcggcaguacaagacggagaucaagaucggcaaggccuccaccgggagccgcaagcuccuguccgaggagcugggcgacgacugcaucagccggacccagcuccugcgcaccgagacggccgagauccacgacgacaacuacgggggcccgggggacaagaucaccaucugcaacggcuccaccaucguggaccagcggcugggcagcgagcucgggugcuacaccaucaaccgcggcaaguccuucaagcugugcgagaacagcgccacggggaagaccugcgagaucgacuccacccccgucaagugccggcagggcuucugccugaagaucacccaggaggggcgcggccacgugaagcucagccgcggcuccgaggugguccuggacgcgugcgacagcuccugcgaggugaugauccccaaggggacgggcgacauccuggucgacugcagcgggggccagcagcacuuccugaaggacaaccucaucgaccugggcugcccccacaucccgcugcucgggaagauggccaucuacaucugccggauguccaaccacccccgcaccaccauggccuuccuguucugguucagcuucggcuacgugaucacgugcaucuucugcaaggcccuguucuacucccucaucaucaucgggacccugggcaagaagaucaagcaguaccgggagcugaagccccagacgugcaccaucugcgagaccacccccgugaacgccaucgacgcggagaugcacgaccucaacugcagcuacaacaucugcccguacugcgccucccgccugacgagcgacgggcuggcccggcacgucacccagugccccaagcgcaaggagaagguggaggagaccgagcucuaccugaaccuggagcggauccccuggaucgugcgcaagcuccugcaggucagcgaguccaccggcguggcccugaagcggagcuccuggcucaucgugcugcugguccuccugccggugagccugucccccgugcagagcgcgcccgucggccacgggaagacgaucgagaccuaccagacccgcgagggcuucaccuccaucugccucuucaugcuggggagcauccuguucaucguguccugccucgugaagggccuggucgacagcgugggggacuccuucuuccccggccugagcgugugcaagacgugcuccaucggcagcaucaacggguucgagaucgagucccacaagugcuacugcagccucuucugcugcccguacugccggcacugcuccgccgaccgcgagauccaccagcugcaccugagcaucugcaagaagcggaagaccggcuccaacgucaugcucgccgugugcaagcgcaugugcuuccgggccaccaucgaggccagccgccgggcgcugcugauccgcagcaucaucaacaccacguucgccaugugcauccucacccugaccaucugcguggucuccaccagcgccguggagauggagaaccugcccgccgggacgugggagcgggaggaggaccucaccaacuucugccaccaggagugccaggugaccgagaccgagugccugugccccuacgaggcccugguccuccgcaagccccuguuccuggacuccaucgugaagggcaugaagaaccuccugaacagcacgucccuggagaccagccucuccaucgaggcgccguggggcgccaucaacgugcagagcaccuucaagcccaccgucuccacggccaacaucgcccugagcugguccagcguggagcaccgcggcaacaagauccuggugaccggccgguccgagagcaucaugaagcucgaggagcgcaccggggucuccugggaccugggcguggaggacgccagcgaguccaagcugcucaccgugagcaucauggaccugucccagauguacagccccgucuucgaguaccugagcggggaccgccagguggaggaguggcccaaggcgacgugcaccggcgacugcccggagcgcugcgggugcaccuccagcacgugccuccacaaggaguggccccacucccggaacuggcgcugcaaccccaccuggugcuggggcgugggcaccgggugcacgugcugcggcgucgacgugaaggaccuguucaccgaccacauguucgugaaguggaaggucgaguacaucaagaccgaggccaucgugugcguggagcugacgagccaggagcggcagugcucccucaucgaggccgggacccgcuucaaccugggccccgucaccaucacccugagcgagccgcggaacauccagcagaagcugccgcccgagaucaucacgcugcaccccaagaucgaggagggcuucuucgaccugaugcacgugcagaaggugcucuccgccagcaccgucugcaagcugcaguccugcacccacgggaucccgggcgaccuccagguguaccacaucgggaaccuccugaagggcgaccgcgugaacgggcaccugauccacaagaucgagccccacuucaacaccagcuggauguccugggacggcugcgaccucgacuacuacugcaacaugggcgacuggcccagcugcacguacaccggggucacccagcacaaccacgcggccuucgugaaccugcugaacaucgagaccgacuacacgaagaccuuccacuuccacuccaagcgggugaccgcccacggcgacacgccccagcucgaccugaaggcccgcccgacguacggggccggcgagaucaccguccugguggaggucgcggacauggagcuccacaccaagaagguggagaucagcgggcugaaguucgccucccugaccugcacgggcugcuacgccugcagcuccggcaucagcugcaaggugcggauccacgucgacgagcccgacgagcucaccgugcacgugaaguccagcgaccccgacgucguggccgccgggaccagccugauggcgcgcaagcuggaguucggcaccgacuccacguucaaggccuucagcgccaugcccaagaccucccucugcuucuacaucguggagcgggaguacugcaagagcugcuccgaggacgacacccagaagugcgucgacaccaagcuggagcagccgcagagcauccugaucgagcacaaggggacgaucaucggcaagcagaacgacacgugcaccgcccgcgccuccugcuggcucgagagcgugaaguccuucuucuacgggcugaagaacaugcugggcagcguguucggcaacuuccucaucgggauccugcuguuccucgcgcccuucguccugcuggugcuguucuucauguucggcuggaagauccucuucugcuucaagugcugccggcgcacccgggggcuguucaaguaccgccaccugaaggacgacgaggagacgggcuaccggcgcaucaucgagcgccucaacuccaagaagggcaagaaccggcugcuggacggggagcgccucgccgaccggaagaucgccgagcuguucagcaccaagacccacaucggcuga

SEQ ID NO: 12062 - RNA, 5052 nt, Artificial Sequence
  derived and/or modified CDS sequence (opt1) from CCHFV(Min)__KX013481.1__GP
augcacacccugcuggugugcuucauccuguaccugcagcuccugggccucggcggggcccacgggcagagcaacgccaccgagcacaacgggaccaacaccaccaccgcccccuccaccucccaguccccgaagccccucgucagcaccgccccgccccacgcccuggaguccagcaccaucaagcccaccacccccgccuccgagaccgaggggagcggcgagaccacgcccccgcccaacaccacccagggccccagcccgcccgagaccacccccgagcgccccgccaccaccgcgaccagcacccccuccacggacaacaccaacagcaccacccacgugacggacaacaaccccaccuccaccaucagcaccuccccgagcuccagccccuccacgcccagcacgccccaggggauccaccacccggcccggaaccugcucagcguguccagccugaagaccgccaccacgcccacccccaccucccccggcgagaucagcuccgagaccagcucccugcacagcgccaugucccgcacgagcacccucuacaccgcgacccaggucuccaccgagaacgccaaccacagcgccccgcgccaguccgagagcuccgcccagcccacgaccaccagccccaugaccucccccgcccagagcauccuggugauguccgcggccccgaucgccauccagaacauccaccccagccccacgaaccgcagcaagcggaaccuggagauggagaucauccucacccugucccaggggcugaagaaguacuacggcaagauccucaagcugcugcaccucacccuggaggaggacaccgaggggcugcucgaguggugcaagcgcaaccugggcagcaacugcgacgacgacuucuuccagaagcggaucgaggaguucuucaugacgggcgagggguacuucaacgaggugcugcaguucaagacccucuccacccugagcccgaccgagcccucccacgcccggccgcccacggucgagccguucaagagcuacuucgccaagggcuuccuguccaucgacagcggguacuucuccgcgaagugcuacccccggagcuccaccagcggccuccagcugaucaacgugacccagcaccccgcccgcaucgccgagacccccggcccgaagacgaccucccugaagaccaucaacugcaucaaccuccgggccagcguguucaaggagcaccgcgagaucgagaucaacguccugcugccccagaucgccgugaaccucuccaacugccacguggucaucaacagccacgugugcgacuacucccuggacaccgacgggcccgugcggcugccccacaucuaccacgagggcacguucaucccggggaccuacaagaucgucaucgacaagaagaacaagcucaacgaccgcugcacccuggugaccaacugcgugaucaagggccgggagguccgcaaggggcagagcgugcugcggcaguacaagacggagaucaagaucggcaaggcgagcaccggcucccgcaagcuccugagcgaggagcccggggacgacugcaucucccggacccagcugcuccgcaccgagacggccgagauccacgacgacaacuacggcgggcccggcgacaagaucaccaucugcaacgggagcaccaucguggaccagcggcugggcuccgagcugggcugcuacaccaucaaccgcgucaagagcuucaagcucugcgagaacuccgccacggggaagaccugcgagaucgacagcacccccgugaagugccgccagggcuucugccugaagaucacccaggaggggcggggccacgugaagcugucccgcgggagcgaggucgugcuggacgccugcgacuccagcugcgaggucaugaucccgaagggcacgggcgacauccucguggacugcuccgggggccagcagcacuuccugaaggacaaccugaucgaccucgggugcccccacaucccccugcugggcaagauggccaucuacaucugccggaugagcaaccacccccgcaccaccauggcguuccucuucugguucuccuucggcuacgugaucacgugcaucuucugcaaggcccuguucuacagccugaucaucaucgggacccucggcaagaagaucaagcaguaccgggagcugaagccgcagacgugcaccaucugcgagaccgcccccgucaacgccaucgacgcggagaugcacgaccugaacugcuccuacaacaucugccccuacugcgccagccgccucaccuccgacgggcuggcccggcacgugccccagugcccgaagcgcaaggagaagguggaggagacggagcuguaccucaaccuggagcggauccccuggaucguccgcaagcugcuccaggugagcgagagcaccggcguggcccugaagcgguccagcuggcugaucguccuccuggugcugcucaccgugucccugagccccguccaguccgccccgguggggcacggcaagaccaucgagacguaccagacccgcgagggcuucaccagcaucugccuguucaugcucggguccauccuguuccuggugagcugccucgucaagggccugguggacuccgugagcgacuccuucuuccccgggcugagcgucugcaagaccugcacgaucggcuccaucaacggguucgagaucgagagccacaagugcuacugcucccucuucugcugccccuacugccggcacugcagcgcggaccgcgagauccaccagcugcaccuguccaucugcaagaagcggaagaccggcagcaacgugaugcucgccgugugcaagcgcaugugcuuccgggccaccaucgaggccucccgccgggcccugcugauccgcagcaucaucaacaccacguucgucaucugcauccucacccugaccaucugcguggugagcaccuccgcggucgagauggagaaccugcccagcggcacgugggagcgcgaggaggaccucaccaacuucugccaccaggagugccaggugaccgagaccgagugccugugcccguacgaggcccuggugcuccggaagccccuguuccuggacuccaucgucaaggggacgaagaaccuccugaacagcaccucccuggagaccagccucuccaucgaggcccccuggggcgccaucaacgugcagagcaccuucaagcccacgguguccaccgccaacaucgcgcugagcugguccagcgucgagcaccgcgggaacaagauccuggugaccggccgguccgagagcaucaugaagcucgaggagcgcaccgggguguccugggaccugggcgucgaggacgccagcgaguccaagcugcucacggugagcaucauggaccugucccagauguacagcccgguguucgaguaccugagcggcgaccggcaggucgaggaguggcccaaggcgaccugcaccggggacugccccgagcgcugcggcugcaccuccagcacgugccuccacaaggaguggccccacucccggaacuggcgcugcaacccgaccuggugcuggggcgugggcaccgggugcacgugcugcggcguggacgucaaggaccuguucaccgaccacauguucgugaaguggaagguggaguacaucaagacggaggccaucgucugcguggagcugaccagccaggagcggcagugcucccucaucgaggcgggcacccgcuucaaccuggggcccgugaccaucacgcugagcgagccccggaacauccagcagaagcugccgcccgagaucaucacccugcaccccaaggucgaggagggcuucuucgaccugaugcacgugcagaaggugcucuccgccagcaccgucugcaagcugcaguccugcacccacgggauccccggcgaccuccagguguaccacaucggcaaccuccugaagggggaccgcaucaacggccaccugauccacaagaucgagccccacuucaacacgagcuggauguccugggacgggugcgaccucgacuacuacugcaacaugggcgacuggcccagcugcaccuacaccggggugacccagcacaaccacgccgccuucgucaaccugcugaacaucgagacggacuacaccaagaccuuccacuuccacuccaagcgggugaccgcccacggcgacacgccccagcucgaccugaaggcgcgccccaccuacggcgccggggagaucaccguccugguggagguggccgacauggagcuccacaccaagaaggucgagaucagcggccugaaguucgccucccuggccugcacggggugcuacgcgugcagcuccggcaucagcugcaaggugcggauccacguggacgagcccgacgagcucaccguccacgugaaguccagcgacccggacguggucgccgccagcaccucccugauggcccgcaagcuggaguucgggaccgacagcacguucaaggccuucuccgcgaugcccaagaccagccucugcuucuacaucguggagcgggaguacugcaaguccugcagcgaggaggacacccagaagugcguggacaccaagcuggagcagccccaguccauccugaucgagcacaagggcacgaucaucggcaagcagaacgacacgugcaccgccaaggccagcugcuggcucgaguccgucaagagcuucuucuacgggcugaagaacaugcugggcuccguguucgggaacuucuucaucggcauccuccuguuccuggcccccuucgugcugcucguccuguucuucauguucggguggaagauccuguucugcuucaagugcugccgccggacccgcggccuccugaaguaccggcaccugaaggacgacgaggagacgggcuaccgccgcaucaucgagcggcucaacaacaagaaggggaagaaccgccugcuggacggcgagcggcucgcggaccgcaagaucgccgagcuguucagcaccaagacccacaucggguga

SEQ ID NO: 12063 - RNA, 5052 nt, Artificial Sequence
  derived and/or modified CDS sequence (opt1) from CCHFV(Kosovo/9553/2001)__AY675511.1__GP
augcacacccugcucgugugcuucauccuguaccugcagcuccugggccuggggggcgcccacgggcagagcaacgccaccgagcacaacggcacgaacaccaccaccgcgcccgggacgucccagagcccgaagccccccgccuccaccacccccagccacgccccggaguccagcaccaucaagcucacgacccccaccuccgagaccgagggcagcggcgagacgaccccccccaccuccaccacgcaggggagcccgccccuggagaccacccccgagcgcuccaccacgaccgccaccagcaccuccggcacggacaacaugaacagcaccacccagaugaccgacaacacgcccacccugaccgccuccaccagcccguccagcucccccagcacgcccagcaccucccaggggcuccacuaccccguccggagccugcuguccgugagcuccccgaagaccgugaccacgcccacccccaugagccccggcgagauguccagcgagaccuccagccagcacuccgcgaugagccgcaccccgaccccccacacggccacccaggucuccaccgagaacgccaaccggagcaccucccgccagagcgaguccagcgcccagcccgcgacgcagucccccgugaccagcccggcccagagcauccuccugauguccgccacccccaccacgauccagaacauccaccccagccccaccaaccgguccaagcgcaaccuggagauggagaucauccucacccugagccaggggcugaagaaguacuacggcaagauccucaagcugcugcaccucacccuggaggaggacacggagggccugcucgaguggugcaagcggaaccugggguccaacugcgacgacgacuucuuccagaagcgcaucgaggaguucuucaucaccggcgagggguacuucaacgaggugcugcaguucaagacccucagcaccccgucccccacggagcccagccacgcccggcugccgaccgccgagcccuucaaguccuacuucgcgaagggcuuccugagcaucgacuccggcuacuucagcgccaagugcuacccccgcuccagcaccuccgggcuccagcugaucaacgucacccagcaccccgcccggaucgccgagacgccgggccccaagaucaccagccugaagaccaucaacugcaucaaccuccgcgccuccguguucaaggagcaccgggagguggagaucaacguccugcugccccagaucgcggugaaccucagcaacugccacguggucaucaacagccacgugugcgacuacucccuggacaccgacgggcccgugcgccugccgcggaucuaccacgagggcacguucaugcccgggaccuacaagaucgucaucgaccgcaagaacaagcucaacgaccggugcacccuggugaccaacugcgugaucaagggccgcgagguccggaagggccagagcgugcugcgccaguacaagacggagaucaagaucgggaaggcccccaccggcucccggaagcuccugagcgaggagcccggggacgacugcaucucccgcacccagcugcuccgcaccgagacggccgagauccacgacgacaacuacggcgggccgggcgacaagaucaccaucugcaacggcagcaccaucguggaccagcggcugggguccgagcugggcugcuacaccaucaaccgcgucaagagcuucaagcucugcgagaacuccgccacggggaagaccugcgagaucgacagcacccccgugaagugccggcagggcuucugccugaagaucacccaggaggggcgcggccacgugaagcugucccggggcagcgaggucgugcuggacgccugcgacuccagcugcgaggucaugauccccaaggggaccggcgacauccucguggacugcuccgggggccagcagcacuuccugaaggacaaccugaucgaccucggcugcccccacaucccgcugcuggggaagauggcgaucuacaucgcccgcaugagcaaccaccccaagacgaccauggccuuccucuucugguucucccugggcuacgugaucaccugcauccugugcaaggcccucuucuacagccugaucaucaucgggacccugggcaagaagaucaagcaguaccgggagcucaagccccagacgugcaccaucugcgagaccgcccccgucaacgcgaucgacgccgagaugcacgaccugaacugcuccuacaacaucugcccguacugcgccagccgccugaccagcgacgggcucgcccggcacgugaagcagugccccaagcgcaaggagaagguggaggagacggagcuguaccugaaccucgagcggauccccugggucgugcgcaagcugcugcagguguccgagagcaccggcgucgcgcucaagcgguccagcuggcugaucgugcugcucgugcugcugaccgucucccucagccccgugcaguccgccccggugggccacgggaagaccaucgagacguaccagacccgcgagggcuucaccagcaucugccuguucaugcugggguccauccucuucaucgucagcugccuggugaagggccugguggacuccgucagcgacuccuucuuccccgggcucagcgugugcaagaccugcuccaucggcagcaucaacggcuucgagaucgagucccacaagugcuacugcagccuguucugcugccccuacugccggcacugcuccgccgaccgcgagauccaccagcugcaccucagcaucugcaagaagcggaagacggggagcaacgugaugcuggccgucugcaagcgcaugugcuuccgggccaccaucgaggcgucccgccgcgcccugcucauccggagcaucaucaacaccaccuucgugaucugcauccugacgcugaccaucugcguggccuccaccagcgccgucgagauggagacccucccggccgcgacgugggagcgcgaggaggaccugaccaacuucugccaccaggagugccaggugcccgagaccgagugccugugccccuacgaggcccucgugcugcggaagccccuguuccucgacuccaucgucaagggcaugaagaaccugcugaacagcaccucccucgagacgagccuguccaucgaggccccguggggggccaucaacgugcagagcaccuucaagcccaccguguccaccgccaacaucgcgcugagcugguccagcgucgagcaccgcggcaacaagauccucgugacggggcgguccgagagcaucaugaagcuggaggagcgcaccggcguguccugggaccugggcgucgaggacgccagcgaguccaagcuccugaccgugagcaucauggaccugagccagauguacucccccguguucgaguaccucagcggggaccggcaggucgaggaguggcccaaggccaccugcacgggcgacugcccggagcgcugcgggugcaccuccagcaccugccugcacaaggaguggccccacucccggaacuggcgcugcaaccccaccuggugcuggggcguggggaccggcugcacgugcugcggcguggacgucaaggaccuguucaccgaccacauguucgugaaguggaagguggaguacaucaagaccgaggccaucgucugcguggagcucaccagccaggagcggcagugcucccugaucgaggcggggacgcgcuucaaccugggccccgugaccaucacccucagcgagccgcggaacauccagcagaagcugccccccgagaucaucacccugcaccccaagaucgaggagggguucuucgaccucaugcacguccagaaggugcuguccgccagcacggugugcaagcugcaguccugcacccacggcaucccgggcgaccuccaggucuaccacaucgggaaccugcugaagggcgaccgcgugaacgggcaccucauccacaagaucgagccccacuucaacaccagcuggauguccugggacggcugcgaccuggacuacuacugcaacaugggggacuggcccagcugcaccuacacgggcgugacccagcacaaccacgccgccuucgucaaccugcucaacaucgagaccgacuacaccaagacguuccacuuccacuccaagcgggugaccgcccacggcgacaccccccagcuggaccugaaggcgcgcccgaccuacggggccggcgagaucacgguccucguggagguggccgacauggagcugcacaccaagaaggucgagaucagcgggcugaaguucgccucccucgccugcaccggcugcuacgcgugcagcuccgggaucagcugcaaggugcggauccacguggacgagcccgacgagcugaccguccacgugaagagcuccgaccccgacguggucgccgccagcacgucccugauggcccgcaagcucgaguucggcaccgacagcaccuucaaggccuucuccgcgaugcccaagaccagccugugcuucuacaucguggagaaggaguacugcaaguccugcagcgaggacgacacgaagaagugcguggacaccaagcuggagcagccgcaguccauccucaucgagcaccggggcaccaucaucgggaagcccaacgacaccugccccgccaagacgagcugcuggcuggaguccgucaagagcuucuucuacggccugaagaacaugcucggguccguguucggcaacuucuucaucgggauccugcuguuccuggcccccuucuuccucuggaugcugagcuucauguucggcuggaagauccuguucugcuucaagugcugccgccggacccgcggccucuucaaguaccgccaccugaaggacgacgaggagaccggguaccggcgcaucaucgagcggcugaacaacaagaagggcaagaaccgccuccuggacggggagcggcuggccgaccgcaagaucgcggagcucuucuccaccaagacgcacaucggcuga

SEQ ID NO: 12064 - RNA, 5052 nt, Artificial Sequence
  derived and/or modified CDS sequence (opt1) from CCHFV(4495-ST-2008)__KR814869.1__GP
augcacacccugcucgugugcuucauccuguaccugcagcuccugggccccgggggcgcccacgggcagccgaacgccaccgagcacaaccgcacgaacaccaccaccgcgcccagcacgucccagagccccaagcccccggucuccaccgcccccccccacgcccuggagagccccaccaucaaguccaccacgccgaccagcgagaccgagggcuccggggagaccacgcccccccccaacaccacccagggcccgagcccccccgagaccacgcccgagcggccggccaccaccgccaccuccacgcccagcaccgacaacaccaacuccaccacgcacgugaccgacaacaaccccaccagcaccaucuccacgagccccuccagcuccccgagcacccccuccaccccccgcggcauccaccaccccgcgcggaaccuccugagcgugagcuccccgaagaccgccacgacccccacccccaccagccccggggagaucuccagcgagacguccagccugcacuccgccaugagccgcaccuccacccucuacaccgccacccaggcgagcacggagaacgccaaccacuccaccccgcggcagagcgagucccccgcccagcccaccaccacgagccugaugaccuccccggcccagagcauccuggucauguccgccgcgcccaccgccauccagaacauccaccccagccccaccaaccgcuccaagcggaaccucgagauggagaucauccugacgcugagccagggccucaagaaguacuacgggaagauccugaagcugcuccaccugacccuggaggaggacaccgagggccuccuggaguggugcaagcgcaaccuggggagcaacugcgacgacgacuucuuccagaagcggaucgaggaguucuucaugaccggcgagggcuacuucaacgaggugcuccaguucaagacgcuguccacccugagcccgaccgagcccucccacgcccgcccccccaccguggagccguucaagagcuacuucgccaagggguuccucuccaucgacagcggcuacuucuccgccaagugcuacccccggagcuccacgagcgggcugcagcugaucaacgucacccagcaccccgcgcgcaucgccgagacccccggcccgaagaccacgucccucaagaccaucaacugcaucaaccugcgggccagcguguucaaggagcaccgcgagaucgagaucaacgugcugcucccccagaucgccgucaaccuguccaacugccacguggugaucaacagccacgucugcgacuacucccuggacaccgacggccccgugcggcucccccacaucuaccacgaggggaccuucaucccgggcacguacaagaucgugaucgacaagaagaacaagcugaacgaccgcugcacccuggucaccaacugcgugaucaaggggcgggaggugcgcaagggccagagcguccuccggcaguacaagaccgagaucaagaucgggaagguguccacgggcagccgcaagcugcugagcgaggaguccggcgacgacugcaucagccggacccagcuccugcgcaccgagaccgccgagauccacgacgacaacuacgggggccccggggacaagaucacgaucugcaacggcuccaccaucguggaccagcgccuggggagcgagcucggcugcuacaccaucaaccgggucaaguccuucaagcugugcgagaacagcgcgaccggcaagacgugcgagaucgacuccacccccgugaagugccgccagggguucugccugaagaucacccaggagggccgggggcacgugaagcucagccgcggcuccgaggucgugcuggacgccugcgacagcuccugcgaggucaugauccccaaggggaccggcgacauccugguggacugcagcggcgggcagcagcacuuccugaaggacaaccucaucgaccugggcugcccgcacaucccccugcucgggaagauggccaucuacaucugccggauguccaaccacccccgcaccacgauggccuuccuguucugguucagcuucggcuacgugaucaccugccuguucugcaaggcccucuucuacucccugaucaucaucggcacccuggggaagaagaucaagcaguaccgggagcuccgcccccagaccugcacgaucugcgagaccgcgccggucaacgccaucgacgccgagaugcacgaccugaacugcagcuacaacaucugccccuacugcgccucccggcugaccagcgacggccucgcgcgccacgugccccagugcccgaagcggaaggagaagguggaggagaccgagcuguaccugaaccucgagcgcauccccuggaucguccggaagcugcugcagguguccgagagcacggggguggcccucaagcgcagcuccuggcugaucguccugcucgugcugcugaccgugagccucucccccguccagagcgcccccgugggccacgggaagaccaucgagaccuaccagacgcgggagggcuucaccuccaucugccuguucaugcugggcagcauccucuuccugguguccugccuggucaaggggcucguggacagcguguccgacagcuucuucccgggccuguccgucugcaagaccugcagcaucggguccaucaacggcuucgagaucgagagccacaagugcuacugcucccugcucugcugccccuacugccgccacugcagcgccgaccgggagauccaccagcugcaccuguccaucugcaagaagcgcaagaccgggagcaacgugaugcucgccgugugcaagcggaugugcuuccgcgcgacgaucgaggccucccgccgggcccugcugauccgcagcaucaucaacaccaccuucgucaucugcauccucacccugacgaucugcguggugagcaccuccgccgucgagauggagaaccugcccagcggcaccugggagaaggaggaggaccucaccaacuucugccaccaggagugccaggugacggagaccgagugccugugccccuacgaggcccuggugcuccggaagccgcuguuccuggacuccaucgucaagggcaugaagaaccuccugaacagcaccucccuggagaccagccucuccaucgaggcgcccuggggggccaucaacgugcagagcacguucaagcccaccguguccaccgccaacaucgcccugagcugguccagcgucgagcaccgcggcaacaagauccuggugaccgggcgguccgagagcaucaugaagcucgaggagcgcacgggcaucuccugggaccuggggguggaggacgccagcgaguccaagcugcucaccgucagcaucauggaccugucccagauguacagccccguguucgaguaccugagcggcgaccggcagguggaggaguggccgaaggcgaccugcaccggcgacugccccgagcgcugcgggugcacguccagcaccugccuccacaaggaguggccccacucccggaacuggcgcugcaaccccaccuggugcuggggcgucgggaccggcugcaccugcugcgggguggacgugaaggaccuguucacggaccacauguucgucaaguggaagguggaguacaucaagaccgaggccaucgugugcgucgagcugaccagccaggagcggcagugcucccucaucgaggccggcacccgcuucaaccugggcccggugacgaucacccugagcgagccccggaacauccagcagaagcucccccccgagaucaucacccugcacccgaagguggaggagggguucuucgaccugaugcacguccagaaggugcucuccgccagcaccgugugcaagcugcaguccugcacgcacggcauccccggggaccugcaggucuaccacaucggcaaccuccugaagggcgaccgcgugaacgggcaccugauccacaagaucgagccccacuucaacaccagcuggauguccugggacggcugcgaccucgacuacuacugcaacaugggggacuggcccagcugcaccuacaccggcgugacgcagcacaaccacgcggccuucgucaaccugcugaacaucgagaccgacuacaccaagaccuuccacuuccacuccaagcgggugacggcccacggggacaccccgcagcucgaccugaaggcccgccccaccuacggcgccggcgagaucaccguccugguggagguggcggacauggagcuccacacgaagaaggucgagaucagcgggcugaaguucgccucccuggccugcaccggcugcuacgccugcagcuccgggaucagcugcaaggugcggauccacguggacgagcccgacgagcucaccguccacgugaaguccagcgaccccgacguggucgccgcgagcaccucccugauggcccgcaagcuggaguucggcacggacagcaccuucaaggccuucuccgccaugccgaagaccagccucugcuucuacaucguggagcgggaguacugcaaguccugcagcgaggaggacacccagcgcugcguggacacgaagcuggagcagccccaguccauccugaucgagcacaaggggaccaucaucggcaagcagaacgacaccugcaccgccaaggcgagcugcuggcucgaguccgucaagagcuucuucuacggccugaagaacaugcugggguccguguucggcaacuucuucaucgggauccuccuguuccuggcccccuucgugcugcucguccuguucuucauguucggcuggaagauccuguucugcuucaagugcugccggcgcgcccgcgggcuccugaaguaccggcaccugaaggacgacgaggagacgggcuaccgcaagaucaucgagcggcucaacaacaagaagggcaagaaccgccugcuggacggggagcggcucgccgaccgcaagaucgcggagcuguucagcaccaagacccacaucggcuga

SEQ ID NO: 12065 - RNA, 5052 nt, Artificial Sequence
  derived and/or modified CDS sequence (opt1) from CCHFV(Mamon)__KX013478.1__GP
augcacacccugcuggugugcuucauccuguaccugcagcugcugggccucggcggggcccacgggcagagcaacaccaccgagcacaacgggaccaacaccaccaccgcccccuccaccagccaguccccgaagccccucgucagcaccgcgccgccccacgcccuggaguccagcaccaucaagcccaccacccccgccuccgagaccgaggggagcggcgagaccaccccgccgcccaacaucacccagggccccagcccgcccgagaccacccccgagcgccccgccacgaccgccaccagcacccccuccacggacaacaccaacagcaccacccacgugacggacaacaaccccaccuccaccaucagcaccuccccgagcuccagccccuccacgcccagcacgccccaggggauccaccacccggcccggaaccugcucagcguguccagccccaagaccgccaccacgcccacccccaccuccccgggcgagaucagcuccaagaccagcucccugcacagcgccaugucccgcacgagcacccuguacaccgccacccaggucuccaccgagaacgcgaaccacagcgcgccccggcaguccgagagcuccgcccagcccacgaccaccagccccaugaccuccccggcccagagcauccucgugauguccgccgcgcccacggccauccagaacauccaccccagcccgaccaaccgcagcaagcggaaccuggagauggagaucauccugacccucucccaggggcugaagaaguacuacggcaagauccugaagcuccugcaccugacccucgaggaggacacggaggggcugcuggaguggugcaagcgcaaccucggcagcaacugcgacgacgacuucuuccagaagcggaucgaggaguucuucaugaccggcgagggguacuucaacgaggugcugcaguucaagacccuguccacccucagccccacggagcccucccacgcccggccgcccaccgucgagcccuucaagagcuacuucgccaagggcuuccuguccaucgacagcggguacuucuccgccaagugcuacccccggagcuccaccagcggccugcagcucaucaacgugacccagcaccccgcgcgcaucgccgagacgcccggccccaagaccaccucccugaagaccaucaacugcaucaaccugcgggccagcguguucaaggagcaccgcgagaucgagaucaacguccuccugccccagaucgccgugaaccuguccaacugccacguggucaucaacagccacgugugcgacuacucccucgacacggacgggcccgugcggcugccgcacaucuaccacgagggcaccuucauccccgggaccuacaagaucgucaucgacaagaagaacaagcugaacgaccgcugcacccucgugacgaacugcgugaucaagggccgggagguccgcaaggggcagagcgugcugcggcaguacaagaccgagaucaagaucggcaaggccagcaccggcucccgcaagcugcucagcgaggagcccggggacgacugcaucucccggacccagcugcugcgcacggagaccgcggagauccacgacgacaacuacggcgggcccggcgacaagaucaccaucugcaacgggagcaccaucguggaccagcggcucggcuccgagcugggcugcuacacgaucaaccgcgucaagagcuucaagcugugcgagaacuccgccaccgggaagaccugcgagaucgacagcaccccggugaagugccgccagggcuucugccucaagaucacgcaggaggggcggggccacgugaagcugucccgcgggagcgaggucguguccgacgccugcgacagcuccugcgaggucaugauccccaagggcaccggcgacauccugguggacugcagcgggggccagcagcacuuccugaaggacaaccucaucgaccuggggugcccccacaucccccugcucggcaagauggccaucuacaucugccggauguccaaccacccgcgcaccaccguggccuuccuguucugguucagcuucggcuacgucaucacgugcaucuucugcaaggcgcuguucuacucccucaucaucaucgggacgcugggcaagaagaucaagcaguaccgggagcugaagccccagaccugcaccaucugcgagaccgcccccgugaacgccaucgacgccgagaugcacgaccucaacugcagcuacaacaucugccccuacugcgcgucccgccugacgagcgacgggcuggcccggcacgugccgcagugccccaagcgcaaggagaaggucgaggagaccgagcucuaccugaaccuggagcggauccccuggaucgugcgcaagcuccuccaggugagcgaguccaccggcgucgcccugaagcggagcuccuggcucaucgugcugcuggugcuccugaccgucagccuguccccggugcagagcgcccccguggggcacggcaagacgaucgagaccuaccagacccgcgagggcuucaccuccaucugccucuucaugcuggggagcauccuguuccucgucuccugccuggugaagggccugguggacagcgucuccgacagcuucuuccccgggcucuccgugugcaagacgugcagcaucggcuccaucaacggguucgagaucgagagccacaagugcuacugcucccuguucugcugccccuacugccggcacugcagcgccgaccgcgagauccaccagcugcaccucuccaucugcaagaagcggaagaccggcagcaacgugaugcuggcggucugcaagcgcaugugcuuccgggccaccaucgaggccagccgccgggcccugcucauccgcuccaucaucaacaccacguucgugaucugcauccugacccugaccaucugcguggucagcaccuccgccguggagauggagaaccucccgagcggcacgugggagcgcgaggaggaccugaccaacuucugccaccaggagugccaggugaccgagaccgagugccugugccccuacgaggcgcucguccugcggaagccccuguuccucgacuccaucgugaaggggaugaagaaccugcugaacagcacgucccucgagaccagccuguccaucgaggcccccuggggcgccaucaacgugcagagcaccuucaagccgaccgucuccacggccaacaucgcccugagcugguccagcguggagcaccgcgggaacaagauccucgugaccggccgguccgagagcaucaugaagcuggaggagcgcaccggggucuccugggaccugggcguggaggacgcgagcgaguccaagcuccugaccgugagcaucauggaccugagccagauguacucccccgucuucgaguaccucagcggcgaccgccagguggaggaguggcccaaggccacgugcaccggggacugccccgagcgcugcggcugcaccuccagcacgugccugcacaaggaguggccgcacucccggaacuggcgcugcaaccccaccuggugcuggggcgugggcaccgggugcacgugcugcggcgucgacgugaaggaccuguucaccgaccacauguucgugaaguggaaggucgaguacaucaagaccgaggccaucgugugcguggagcucacgagccaggagcggcagugcucccugaucgaggccggcacccgcuucaaccuggggcccgucaccaucacccucagcgagccccggaacauccagcagaagcugccgcccgagaucaucacgcugcaccccaagguggaggagggcuucuucgaccucaugcacgugcagaagguccuguccgcgagcaccgugugcaagcugcaguccugcacccacgggauccccggcgaccuccagguguaccacaucggcaaccugcugaagggggaccgcgucaacggccaccucauccacaagaucgagccgcacuucaacaccagcuggauguccugggacgggugcgaccuggacuacuacugcaacaugggcgacuggcccagcugcacguacaccggggugacccagcacaaccacgccgccuucgucaaccugcucaacaucgagaccgacuacacgaagaccuuccacuuccacuccaagcgggugaccgcccacggcgacacgccccagcuggaccugaaggcccgccccacguacggcgcgggggagaucaccgugcucgucgagguggccgacauggagcugcacaccaagaagguggagaucagcggccugaaguucgccucccucgccugcaccgggugcuacgccugcagcuccggcaucagcugcaagguccggauccacguggacgagccggacgagcugacggugcacgucaagagcuccgaccccgacgugguggcggccagcaccucccugauggcccgcaagcucgaguucgggaccgacagcaccuucaaggccuucuccgccaugcccaagacgagccugugcuucuacaucgucgagcgggaguacugcaaguccugcagcgaggaggacacccagaagugcguggacaccaagcuggagcagccccaguccauccucaucgagcacaagggcaccaucaucggcaagcagaacgacacgugcaccgcgaagaccagcugcuggcuggaguccgugaaguccuucuucuacgggcugaagaacaugcucggcuccgucuucgggaacuucuucaucggcauccugcuguuccucgccccguucgugcugcuggugcuguucuucauguucggguggaagauccucuucugcuucaagugcugccgccggacccgcggccugcugaaguaccggcaccucaaggacgacgaggagacgggcuaccgccgcaucaucgagcggcugaacaacaagaaggggaagaaccgccugcucgacggcgagcggcuggccgaccgcaagaucgccgagcuguucagcaccaagacccacaucggguga

SEQ ID NO: 12066 - RNA, 5052 nt, Artificial Sequence
  derived and/or modified CDS sequence (opt1) from CCHFV(81-R-2014)__KR814865.1__GP
augcacacccugcuggugugcuucauccuguaccugcagcuccugggccucggcggggcccacgggcagagcaacgccaccgagcacaacggcaccaacaccaccaccgugcccuccaccagccaguccccgaagccccucgugagcaccaccccgccccacgcgcuggaguccagcaccaucaagcccaccacccccaccuccgagaccgaggggagcggcgagacggcgccccugcccaacaccacccagggcccgccgccgcccgagaccacgccggagcggcccgccaccaccgugaccuccacgcccagcaccgacaacaccaacuccaccauccacgugacggacaacaaccccaccagcaccaucuccaccagcccguccagcucccccagcacgcccuccacgccccaggggauccaccacccggcccggagccuccugagcguguccagccccaagaccgccaccacgcccacccccaccuccccgggcgagaucaacagcgagaccuccagccugcacuccgccaugagccgcacgcccacccuccacaccgccacccagguguccaccgagaacgccaaccacagcgcgccccggcaguccgagagcuccgcccagcccacgaccaccagccugaugaccuccccggcccagagcauccugcucauguccgccgcccccacggccauccagaacacccaccccagcccgaccaaccgcuccaagcggaaccuggagauggagaucauccugacccucagccaggggcugaagaaguacuacggcaagauccugaagcuccugcaccugacgcucgaggaggacaccgaggggcugcuggaguggugcaagcgcaaccucggcagcaacugcgacgacgacuucuuccagaagcggaucggcgaguucuucaugaccggggagggcuacuucaacgagguccugcaguucaagacccuguccacgcucagccccaccgagcccucccacgcgcgccugcccaccguggagccguucaagagcuacuucgccaagggguuccuguccaucgacagcggcuacuucuccgccaagugcuacccccggagcuccaccagcggccuccagcugaucaacgugacgcagcaccccgcccgcaucgccgagacccccgggccgaagaccaccucccugaagacgaucaacugcaucaaccuccgggcgagcgucuucaaggagcaccgcgagaucgagaucaacgugcugcugccccagaucgccgugaaccucuccaacugccacgucgugaucaacagccacgugugcgacuacucccuggacaccgacggccccguccggcugccccacaucuaccacgaggggaccuucaucccgggcaccuacaagaucgugaucgacaagaagaacaagcucaacgaccgcugcacgcuggugaccaacugcgucaucaaggggcgggaggugcgcaagggccagagcgugcugcggcaguacaagaccgagaucaagaucggcaaggccuccaccgggagccgcaagcuccugagcgaggagcccggcgacgacugcaucucccggacgcagcugcuccgcaccgagaccgccgagauccacgacgacaacuacgggggccccggggacaagaucaccaucugcaacggcagcacgaucgucgaccagcggcugggguccgagcuggggugcuacaccaucaaccgcgucaagagcuucaagcugugcgagaacuccgccaccggcaagaccugcgagaucgacagcacgcccgugaagugccgccagggguucugccucaagaucacccaggagggccgggggcacgucaagcugucccgcggcagcgaggugguccuggacgcgugcgacuccagcugcgaggugaugauccccaagggcaccggggacauccucguggacugcuccggcgggcagcagcacuuccugaaggacaaccugaucgaccucggcugcccccacaucccccugcugggcaagauggccaucuacaucugccggaugagcaaccacccccgcaccaccauggccuuccucuucugguucuccuucggguacgucaucacgugcaucuucugcaaggcccuguucuacagccugaucaucaucggcacccucgggaagaagaucaagcaguaccgggagcugaagccgcagaccugcaccaucugcgagacggcccccgugaacgcgaucgacgccgagaugcacgaccugaacugcuccuacaacaucugccccuacugcgccagccgccucaccuccgacggccuggcccggcacgugccccagugcccgaagcgcaaggagaaggucgaggagaccgagcuguaccucaaccuggagcggauccccuggaucgugcgcaagcugcuccaggugagcgaguccaccggggucgcgcugaagcggagcagcuggcugaucgugcuccuggugcugcucacggucucccugagccccgugcaguccgccccggugggccacggcaagaccaucgagaccuaccagacccgcgagggguucacgagcaucugccuguucaugcucggcuccauccuguuccuggucagcugccucgugaaggggcugguggacuccgucagcgacuccuucuuccccggccugagcgugugcaagaccugcuccaucgggagcaucaacggcuucgagaucgagucccacaagugcuacugcagccucuucugcugccccuacugccggcacugcuccgccgaccgcgagauccaccagcugcaccugagcaucugcaagaagcggaagaccggcuccaacgugaugcucgccgucugcaagcgcaugugcuuccgggccaccaucgaggcgagccgccgggcccugcugauccgcuccaucaucaacacgaccuucgugaucugcauccucacccugaccaucugcguggucagcacgagcgccguggagauggagaaccugcccgccgggaccugggagcgcgaggaggaccucaccaacuucugccaccaggagugccaggugaccgagacggagugccugugcccguacgaggcccugguccuccggaagccccuguuccuggacuccaucgugaagggcaugaagaaccuccugaacagcaccucccuggagaccagccucuccaucgaggcgcccuggggcgccaucaacgugcagagcaccuucaagcccacggucuccaccgccaacaucgcccugagcugguccagcguggagcaccgcggcaacaagauccuggugaccgggcgguccgagagcaucaugaagcucgaggagcgcaccggcgucuccugggaccugggcguggaggacgccagcgaguccaagcugcucacggugagcaucauggaccugucccagauguacagcccggucuucgaguaccuguccggggaccgccagguggaggaguggcccaaggcgaccugcaccggcgacugccccgagcgcugcgggugcaccagcagcacgugccuccacaaggaguggccccacucccggaacuggcgcugcaacccgaccuggugcuggggcguggggaccggcugcacgugcugcggcgucgacgugaaggaccuguucaccgaccacauguucgugaaguggaaggucgaguacaucaagacggaggccaucgugugcguggagcugaccagccaggagcggcagugcucccucaucgaggccgggacccgcuucaaccugggccccgucaccaucacgcugagcgagccccggaacauccagcagaagcugccgcccgagaucaucacccugcaccccaagguggaggagggguucuucgaccugaugcacgugcagaagguccucuccgccagcaccgugugcaagcugcaguccugcacccacggcauccccggcgaccuccagguguaccacaucgggaaccuccugaagggcgaccgcaucaacgggcaccugauccacaagaucgagccccacuucaacacgagcuggauguccugggacggcugcgaccucgacuacuacugcaacaugggggacuggcccagcugcaccuacaccggcgucacccagcacaaccacgcggccuucgugaaccugcugaacaucgagacggacuacaccaagaccuuccacuuccacuccaagcgggucaccgcccacggcgacacgccccagcucgaccugaaggcccgccccaccuacggggccggcgagaucaccgugcugguggaggucgcggacauggagcuccacaccaagaagguggagaucagcgggcugaaguucgccucccuggccugcacgggcugcuacgccugcagcuccgggaucagcugcaaggugcggauccacgucgacgagcccgacgagcucaccgugcacgugaaguccagcgacccggacgucguggccgcguccaccagccugauggcccgcaagcuggaguucggcaccgacagcacguucaaggccuucuccgccaugcccaagaccagccucugcuucuacaucguggagcgggaguacugcaaguccugcagcgaggaggacacccagaagugcgucgacacccgccuggagcagccccaguccauccugaucgagcacaagggcacgaucaucgggaagcagaacgacacgugcaccgccaaggcgagcugcuggcucgaguccgucaagagcuucuucuacggccugaagaacaugcugggguccguguucggcaacuucuucaucgggauccuccuguuccuggcccccuucguccugcucgugcuguucuucauguucggcuggaagauccuguucugcuucaagugcugccggcgcacccggggccuccugaaguaccgccaccugaaggacgacgaggagacgggguaccgccggaucaucgagcgccucaacaacaagaagggcaagaaccggcugcuggacggggagcgccucgccgaccggaagaucgccgagcuguucagcaccaagacccacaucggcuga

SEQ ID NO: 12067 - RNA, 5052 nt, Artificial Sequence
  derived and/or modified CDS sequence (opt1) from CCHFV(5180-R-2011)__KR814874.1__GP
augcacacccugcucgugugcuucauccuguaccugcagcuccugggccucgggggcgcccaccgccagagcaacgccaccgagcacaacgggacgaacaccaccaccgcgcccuccacgagccaguccccgaagccgcccgucagcaccgcgccgcccuacgcccccgaguccagcaccaucaagcccaccacgcccgccuccgagaccgagggcagcggggagaccacgcccccgcccaacaccacccagggccccuccccgcccgaggccacccccgagcggcccgccaccacggccaccagcacccccuccaccgacaacacgaacagcaccacccacgccaccgacaacaaccccacguccaccaucagcaccucccccagcuccagccccuccaccccgagcacgccccagggcauccaccaccccgcccgcaaccuccugagcguguccagccccaagaccgcgaccaccccgacgcccaccucccccggggacaucagcuccgagaccagcucccugcacagcgccaugucccggacccccacgcuccacaccgccacccaggccagcaccgagaacgccaaccacuccgcgccgcgccagagcgaguccagcgcccagcagaccacgaccucccccaugaccagccccgcccagccgauccuggugauguccgccgcccccaccgcgauccagaacauccaccccagccccacgaaccgguccaagcgcaaccuggagauggagaucauccucacccugagccagggccugaagaaguacuacgggaagauccucaagcugcugcaccucacccuggaggaggacaccgagggccugcucgaguggugcaagcggaaccuggggagcaacugcgacgacgacuucuuccagaagcgcaucgaggaguucuucaugacgggcgagggcuacuucaacgagguccugcaguucaagacccucuccacccugagcccgaccgagcccucccacgcccggccgcccacgguggagcccuucaagagcuacuucgccaagggguuccuguccaucgacagcggcuacuucuccgccaagugcuacccccgccucagcaccuccgggcugcagcugaucaacgugacccagcaccccgcccggaucgcggagacccccggcccgaagacgaccagccucaagaccaucaacugcaucaaccugcgcgccuccgucuucaaggagcaccgggagaucgagaucaacgugcugcucccccagaucgccgugaaccugagcaacugccacgucgugaucaacucccacgugugcgacuacagccuggacaccgacggccccguccgccucccccacaucuaccacgaggggacguucaucccgggcaccuacaagaucgugaucgacaagaagaacaagcugaacgaccggugcacccuggugaccaacugcgucaucaaggggcgcgagauccggaagggccaguccgugcuccgccaguacaagacggagaucaagaucgggaaggccagcaccggcucccggaagcugcugagcgaggagcccggcgacgacugcaucagccgcacccagcuccugcggaccgagacggccgagauccacgacgacaacuacgggggccccggggacaagaucaccaucugcaacggcuccaccaucguggaccagcgccuggggagcgagcucggcugcuacaccaucaaccgcgucaaguccuucaagcugugcgagaacagcgcgacgggcaagaccugcgagaucgacuccacccccgugaagugccggcagggguucugccugaagaucacccaggagggccgcgggcacgugaagcucagccggggcuccgaggucgugcuggacgccugcgacacgagcugcgaggugaugaucccgaaggggaccggcgacauccuggucgacugcuccggcgggcagcagcacuuccugaaggacaaccucaucgaccugggcugcccccacaucccccugcucgggaagauggccaucuacaucugccgcaugagcaaccacccccggaccaccauggccuuccuguucugguucuccuucggcuacgugaucacgugcaucuucugcaaggcgcuguucuacagccucaucaucaucggcacccuggggaagaagaucaagcaguaccgcgagcugaagccgcagaccugcaccaucugcgagaccgcccccgucaacgccaucgacgccgagaugcacgaccucaacugcuccuacaacaucugccccuacugcgccagccggcugacguccgacggccuggcgcgccacgugccgcagugccccaagcggaaggagaagguggaggagaccgagcucuaccugaaccuggagcgcauccccuggaucguccggaagcuccuccaggugagcgaguccaccgggguggcccugaagcgcagcuccuggcugaucguccugcuggugcuccugaccgugagccugagccccguccaguccgccccggugggccacgggaagacgaucgagaccuaccagacccgggagggcuucaccagcgugugccucuucaugcugggcuccauccuguuccucgucagcugccuggugaaggggcugguggacuccgucagcgacuccuucuuccccggccucagcgugugcaagacgugcuccaucgggagcaucaacggcuucgagaucgagucccacaagugcuacugcagccuguucugcugccccuacugccgccacugcuccgccgaccgggagauccaccagcugcaccucagcaucugcaagaagcgcaagaugggguccaacgugaugcuggccgucugcaagcggaugugcuuccgcgcgaccaucgaggccagccggcgcgcccugcucauccgcuccaucaucaacaccaccuucgugaucugcauccugacgcugaccaucugcguggucagcaccuccgccguggagauggagaaccuccccagcggcaccugggagcgggaggaggaccugacgaacuucugccaccaggagugccaggugaccgagaccgagugccugugcccguacgaggcccucguccugcgcaagccccuguuccucgacagcaucgugaagggcaugaagaaccugcugaacuccaccagccucgagacgucccugagcaucgaggcgcccuggggcgccaucaacgugcaguccaccuucaagcccaccgucagcaccgccaacaucgcccuguccuggagcuccguggagcaccgggggaacaagauccucgugacggggcgcagcgaguccaucaugaagcuggaggagcggaccggcgucagcugggaccuggggguggaggacgcguccgagagcaagcuccugaccguguccaucauggaccugagccagauguacuccccggucuucgaguaccucagcggcgaccgccagguggaggaguggcccaaggcgaccugcacgggcgacugccccgagcggugcgggugcaccuccuccacgugccugcacaaggaguggccccacagccgcaacuggcggugcaacccgaccuggugcuggggcguggggaccggcugcacgugcugcggggucgacgugaaggaccuguucaccgaccacauguucgugaaguggaaggucgaguacaucaagaccgaggccaucgugugcguggagcucaccagccaggagcgccagugcagccugaucgaggccggcacccgguucaaccugggccccgucaccaucacccucuccgagccccgcaacauccagcagaagcugcccccggagaucaucacccugcaccccaagguggaggagggguucuucgaccucaugcacgugcagaagguccugagcgccuccacggugugcaagcugcagagcugcacccacggcauccccggggaccuccagguguaccacaucggcaaccugcugaagggcgaccgggucaacgggcaccucauccacaagaucgagccccacuucaacaccuccuggaugagcugggacggcugcgaccuggacuacuacugcaacaugggggacuggccguccugcaccuacacgggcgugacccagcacaaccacgccgccuucgugaaccugcucaacaucgagaccgacuacaccaagacguuccacuuccacagcaagcgcgucaccgcccacggggacacgccccagcuggaccugaaggcccggcccaccuacggcgccggcgagaucaccgugcucgucgagguggcggacauggagcugcacaccaagaagguggagaucuccgggcugaaguucgccagccucgccugcaccggcugcuacgccugcuccagcgggaucuccugcaagguccgcauccacguggacgagcccgacgagcugaccgugcacgucaagagcaacgacccggacgugguggccgcguccacgagccugauggcccggaagcucgaguucggcaccgacuccaccuucaaggccuucagcgccaugcccaagaccagccugugcuucuacaucgucgagcgcgaguacugcaaguccugcagcgaggaggacacgcagaagugcguggacaccaagcuggagcagccccaguccauccucaucgagcacaaggggaccaucaucggcaagcagaacgacacgugcaccgcgaaggccagcugcuggcuggaguccgucaagagcuucuucuacggccugaagaacaugcucggguccguguucggcaacuucuucaucgggauccugcuguuccucgccccguucgugcugcuggugcuguucuucauguucggcuggaagauccucuucugcuucaagugcugccggcgcacccgggggcugcugaaguaccgccuccugaaggacgacgaggagaccggcuaccgccggaucaucgagcgccugaacaacaagaagggcaagaaccggcuccuggacggggagcgccuggccgaccggaagaucgccgagcuguucagcaccaagacgcacaucggcuga

SEQ ID NO: 12068 - RNA, 5052 nt, Artificial Sequence
  derived and/or modified CDS sequence (opt1) from CCHFV(24-R-2012)__KR814856.1__GP
augcacacccugcucgugugcuucauccuguaccugcagcuccugggccucgggggcgcccaccgccagagcaacgccaccgagcacaacgggacgaacaccaccaccgcgcccuccacgagccaguccccgaagccgcccgucagcaccgcgccgccccacgcccccgaguccagcaccaucaagcccaccacgcccgccuccgagaccgagggcagcggggagaccacgcccccgcccaacaccacccagggccccuccccgcccgaggccacccccgagcggaccgccacgaccgccaccagcacccccuccacggacaacaccaacagcaccacccacgccacggacaacaaccccaccuccaccaucagcaccucccccagcuccagccccuccacgcccagcaccccgcagggcauccaccaccccgcccgcaaccuccugagcguguccagccccaagaccgcgaccacgcccaccccgaccucccccggggacaucagcuccgagaccagcucccugcacagcgccaugucccggacgcccacccuccacaccgccacccaggccagcaccgagaacgccaaccacuccgcgccccgccagagcgaguccagcgcccagcagacgaccaccuccccgaugaccagccccgcccagcccauccuggugauguccgccgccccgacggcgauccagaacauccaccccagccccaccaaccgguccaagcgcaaccuggagauggagaucauccucacccugagccagggccugaagaaguacuacgggaagauccucaagcugcugcaccucacccuggaggaggacacggagggccugcucgaguggugcaagcggaaccuggggagcaacugcgacgacgacuucuuccagaagcgcaucgaggaguucuucaugaccggcgagggcuacuucaacgagguccugcaguucaagacccucuccacccugagccccacggagccgucccacgcccggccgcccaccguggagcccuucaagagcuacuucgccaagggguuccuguccaucgacagcggcuacuucuccgccaagugcuacccccgccucagcaccuccgggcugcagcugaucaacgugacccagcaccccgcccggaucgcggagacgcccggccccaagaccaccagccucaagaccaucaacugcaucaaccugcgcgccuccgucuucaaggagcaccgggagaucgagaucaacgugcugcucccgcagaucgccgugaaccugagcaacugccacgucgugaucaacucccacgugugcgacuacagccuggacacggacggccccguccgccucccccacaucuaccacgaggggaccuucauccccggcaccuacaagaucgugaucgacaagaagaacaagcugaacgaccggugcacccuggugacgaacugcgucaucaaggggcgcgaggugcggaagggccaguccgugcuccgccaguacaagaccgagaucaagaucgggaaggccagcaccggcucccggaagcugcugagcgaggagccgggcgacgacugcaucagccgcacccagcuccugcggacggagaccgccgagauccacgacgacaacuacgggggccccggggacaagaucaccaucugcaacggcuccaccaucgucgaccagcgccuggggagcgagcucggcugcuacacgaucaaccgcgugaaguccuucaagcugugcgagaacagcgcgaccggcaagaccugcgagaucgacuccacccccgugaagugccggcagggguucugccugaagaucacgcaggagggccgcgggcacgucaagcucagccggggcuccgagguggugcuggacgccugcgacaccagcugcgaggucaugauccccaaggggaccggcgacauccugguggacugcuccggcgggcagcagcacuuccugaaggacaaccucaucgaccugggcugcccgcacaucccccugcucgggaagauggccaucuacaucugccgcaugagcaaccacccccggaccaccauggccuuccuguucugguucuccuucggcuacgucaucacgugcaucuucugcaaggcgcuguucuacagccucaucaucaucggcacccuggggaagaagaucaagcaguaccgcgagcugaagccccagaccugcaccaucugcgagacggccccggugaacgccaucgacgccgagaugcacgaccucaacugcuccuacaacaucugccccuacugcgccagccggcugaccuccgacggccuggcgcgccacgugccccagugcccgaagcggaaggagaaggucgaggagaccgagcucuaccugaaccuggagcgcauccccuggaucgugcggaagcuccuccaggugagcgaguccaccggggucgcccugaagcgcagcuccuggcugaucgugcugcuggugcuccugacggucagccugagccccgugcaguccgcccccgugggccacgggaagaccaucgagaccuaccagacccgggagggcuucacgagcgucugccucuucaugcugggcuccauccuguuccucgugagcugccuggugaaggggcuggucgacuccgugagcgacuccuucuucccgggccucagcgugugcaagaccugcuccaucgggagcaucaacggcuucgagaucgagucccacaagugcuacugcagccuguucugcugccccuacugccgccacugcuccgccgaccgggagauccaccagcugcaccucagcaucugcaagaagcgcaagaugggguccaacgucaugcuggccgugugcaagcggaugugcuuccgcgcgaccaucgaggccagccggcgcgcccugcucauccgcuccaucaucaacaccacguucgugaucugcauccugacccugaccaucugcgucgugagcaccuccgccguggagauggagaaccuccccagcggcacgugggagcgggaggaggaccugaccaacuucugccaccaggagugccaggucaccgagaccgagugccugugccccuacgaggcccucgugcugcgcaagccgcuguuccucgacagcaucgugaagggcaugaagaaccugcugaacuccacgagccucgagaccucccugagcaucgaggcgcccuggggcgccaucaacguccaguccaccuucaagcccaccgugagcacggccaacaucgcccuguccuggagcuccguggagcaccgggggaacaagauccucgucaccgggcgcagcgaguccaucaugaagcuggaggagcggaccggcgugagcugggaccuggggguggaggacgcguccgagagcaagcuccugaccgucuccaucauggaccugagccagauguacucccccguguucgaguaccucagcggcgaccgccagguggaggaguggccgaaggccacgugcaccggcgacugccccgagcggugcgggugcaccuccagcacgugccugcacaaggaguggccccacagccgcaacuggcggugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcucaccucccaggagcgccagugcagccugaucgaggccggcacccgguucaaccugggcccggugaccaucacccucuccgagccccgcaacauccagcagaagcugccgcccgagaucaucacgcugcaccccaagguggaggagggguucuucgaccucaugcacguccagaaggugcugagcgccuccaccgugugcaagcugcagagcugcacccacggcauccccggggaccuccaggucuaccacaucggcaaccugcugaagggcgaccgggugaacgggcaccucauccacaagaucgagccccacuucaacaccuccuggaugagcugggacggcugcgaccuggacuacuacugcaacaugggggacuggcccuccugcacguacaccggcgugacccagcacaaccacgcggccuucgucaaccugcucaacaucgagaccgacuacacgaagaccuuccacuuccacagcaagcgcgugaccgcccacggggacaccccgcagcuggaccugaaggcccggcccacguacggcgccggcgagaucaccguccucguggagguggcggacauggagcugcacaccaagaaggucgagaucuccgggcugaaguucgccagccucgccugcaccggcugcuacgccugcuccagcgggaucuccugcaaggugcgcauccacguggacgagcccgacgagcugacgguccacgucaagagcaacgaccccgacgugguggccgcguccaccagccugauggcccggaagcucgaguucggcaccgacuccaccuucaaggccuucagcgccaugccgaagacgagccugugcuucuacaucguggagcgcgaguacugcaaguccugcagcgaggaggacacccagaagugcguggacaccaagcuggagcagccccaguccauccucaucgagcacaaggggaccaucaucggcaagcagaacgacacgugcaccgcgaaggccagcugcuggcuggaguccgucaagagcuucuucuacggccugaagaacaugcucggguccguguucggcaacuucuucaucgggauccugcuguuccucgcccccuucgugcugcugguccuguucuucauguucggcuggaagauccucuucugcuucaagugcugccggcgcacccgggggcugcugaaguaccgccuccugaaggacgacgaggagaccggcuaccgccggaucaucgagcgccugaacaacaagaagggcaagaaccggcuccuggacggggagcgccuggccgaccggaagaucgccgagcuguucagcacgaagacccacaucggcuga

SEQ ID NO: 12069 - RNA, 5052 nt, Artificial Sequence
  derived and/or modified CDS sequence (opt1) from CCHFV(46-ST-2012)__KR814860.1__GP
augcacacccugcucgugugcuucauccuguaccugcagcuccugggccucggcggggcccacgggcagagcaacgccaccgagcacaacgggaccaacaccaccaccguccccagcaccagccaguccccgaagccccucgugagcaccaccccgccccacgcgcuggaguccagcaccaucaagcccaccacccccaccuccgagaccgaggggagcggcgagaccgcgccccugcccaacaccacccaggggcccccgccgcccgagaccaccccggagcggcccgccaccaccgugaccuccacgcccagcaccgacaacaccuccagcaccauccacgucacggacaacaaccccaccuccaccaucagcaccuccccgagcuccagccccuccacgcccagcacgccccagggcauccaccacccggcccggagccuccuguccgugagcucccccaagaccgccaccacgcccacccccaccagcccgggcgagaucaacuccgagaccagcucccugcacagcgccaugucccgcacgcccacccuccacaccgccacccaggugagcaccgagaacgccaaccacuccgcgccccggcagagcgaguccagcgcccagcccacgaccaccucccugaugaccagcccggcccaguccauccugcucaugagcgccgcccccacggccauccagaacauccaccccuccccgaccaaccgcagcaagcggaaccuggagauggagaucauccugacccucagccaggggcugaagaaguacuacggcaagauccugaagcuccugcaccugacccucgaggaggacacggaggggcugcuggaguggugcaagcgcaaccucggcuccaacugcgacgacgacuucuuccagaagcggaucgaggaguucuucaugaccggcgagggguacuucaacgagguccugcaguucaagacccugagcacccucucccccacggagcccagccacgcccgccugcccaccguggagccguucaaguccuacuucgccaagggcuuccugagcguggacuccggguacuucagcgccaagugcuacccccgguccagcaccuccggccuccagcugaucaacgucacccagcaccccgcccgcaucgccgagacgcccggcccgaagaccaccagccugaagaccaucaacugcaucaaccuccgggcguccguguucaaggagcaccgcgagaucgagaucaacgugcugcugccccagaucgccgucaaccucagcaacugccacguggugaucaacucccacgucugcgacuacagccuggacacggacgggcccgugcggcugccccacaucuaccacgagggcaccuucaucccggggaccuacaagaucgugaucgacaagaagaacaagcucaacgaccgcugcacccuggucacgaacugcgugaucaagggccgggaggugcgcaaggggcaguccguccugcggcaguacaagaccgagaucaagaucggcaaggccagcaccggcagccgcaagcuccuguccgaggagcccggggacgacugcaucagccggacccagcugcuccgcacggagaccgccgagauccacgacgacaacuacggcgggcccggcgacaagaucaccaucugcaacggguccaccaucguggaccagcggcugggcagcgagcugggcugcuacacgaucaaccgcgugaaguccuucaagcugugcgagaacagcgccaccgggaagaccugcgagaucgacuccacccccgucaagugccgccagggcuucugccucaagaucacgcaggaggggcggggccacgugaagcugagccgcggguccgaggucgugcuggacgcgugcgacagcuccugcgaggugaugaucccgaagggcaccggcgacauccucgucgacugcagcgggggccagcagcacuuccugaaggacaaccugaucgaccucgggugcccccacaucccccugcugggcaagauggccaucuacaucugccggauguccaaccacccccgcaccaccauggccuuccucuucugguucagcuucggcuacgugaucacgugcaucuucugcaaggcccuguucuacucccugaucaucaucgggacgcucggcaagaagaucaagcaguaccgggagcugaagccgcagaccugcaccaucugcgagaccgcccccgugaacgcgaucgacgccgagaugcacgaccugaacugcagcuacaacaucugccccuacugcgccucccgccucacgagcgacgggcuggcccggcacgucccccagugcccgaagcgcaaggagaagguggaggagaccgagcuguaccucaaccuggagcggauccccuggaucgugcgcaagcugcuccaggucuccgagagcaccggcguggcgcugaagcggagcuccuggcugaucgugcuccugguccugcucaccgugagccugucccccgugcagagcgccccggucgggcacggcaagacgaucgagaccuaccagacccgcgagggcuucaccuccaucugccuguucaugcucgggagcauccuguuccugguguccugccucgugaagggccuggucgacagcguguccgacagcuucuuccccgggcuguccgugugcaagacgugcagcaucggcuccaucaacggguucgagaucgagagccacaagugcuacugcucccucuucugcugccccuacugccggcacugcagcgccgaccgcgagauccaccagcugcaccuguccaucugcaagaagcggaagaccggcagcaacgucaugcucgccgugugcaagcgcaugugcuuccgggccaccaucgaggcgucccgccgggcccugcugauccgcagcaucaucaacgccaccuucgugaucugcauccucacgcugaccaucugcgucgugagcaccuccgccguggagauggagagccugcccgccggcaccugggagcgcgaggaggaccucacgaacuucugccaccaggagugccaggucaccgagaccgagugccugugcccguacgaggcgcuggugcuccggaagccccuguuccuggacuccaucgugaaggggaugaagaaccuccugaacagcaccucccuggagacgagccucuccaucgaggcccccuggggcgccaucaacguccagagcaccuucaagcccaccguguccaccgccaacaucgcccugagcugguccagcguggagcaccgcgggaacaagauccuggucacgggccgguccgagagcaucaugaagcucgaggagcgcaccgggguguccugggaccugggcguggaggacgcgagcgaguccaagcugcucaccgucagcaucauggaccugucccagauguacagcccgguguucgaguaccugagcggcgaccgccagguggaggaguggcccaaggcgaccugcacgggggacugccccgagcgcugcggcugcaccuccuccacgugccuccacaaggaguggccccacucccggaacuggcgcugcaacccgaccuggugcuggggcgugggcaccgggugcacgugcugcggcguggacgugaaggaccuguucaccgaccacauguucgucaaguggaagguggaguacaucaagaccgaggccaucgugugcgucgagcugaccagccaggagcggcagugcucccucaucgaggccggcacgcgcuucaaccuggggcccgugaccaucacccugagcgagccccggaacauccagcagaagcugccgcccgagaucaucacccugcaccccaagguggaggagggcuucuucgaccugaugcacguccagaaggugcucuccgcgagcacggugugcaagcugcaguccugcacccacgggauccccggcgaccugcaggucuaccacaucggcaaccuccugaagggggaccgcaucaacggccaccugauccacaagaucgagccccacuucaacaccagcuggauguccugggacgggugcgaccucgacuacuacugcaacaugggcgacuggcccagcugcaccuacacgggggugacccagcacaaccacgccgccuucgucaaccugcugaacaucgagaccgacuacaccaagacguuccacuuccacuccaagcgggugaccgcccacggcgacacgccccagcucgaccugaaggcccgccccaccuacggcgcgggggagaucacggugcuggucgagguggccgacauggagcuccacaccaagaagguggagaucagcggccugaaguucgccucccuggccugcaccgggugcuacgccugcagcuccggcaucagcugcaagguccggauccacguggacgagcccgacgagcucaccgugcacgucaaguccagcgacccggacgugguggcggccagcacgucccugauggcccgcaagcuggaguucgggaccgacagcaccuucaaggccuucuccgccaugcccaagaccagccucugcuucuacaucgucgagcgggaguacugcaaguccugcagcgaggaggacacgcagaagugcguggacacccgccuggagcagccccaguccauccugaucgagcacaagggcaccaucaucggcaagcagaacgacacgugcacggcgaaggccagcugcuggcucgaguccgucaagagcuucuucuacgggcugaagaacaugcugggcuccgucuucgggaacuucuucaucggcauccuccuguuccuggcccccuucgugcugcucgugcuguucuucauguucggguggaagauccuguucugcuucaagugcugccggcgcacccggggccuccugaaguaccgccaccugaaggacgacgaggagaccggcuaccgccggaucaucgagcgccucaacaacaagaaggggaagaaccggcugcuggacggcgagcgccucgccgaccggaagaucgcggagcuguucagcaccaagacgcacaucggguga

SEQ ID NO: 12070 - RNA, 5052 nt, Artificial Sequence
  derived and/or modified CDS sequence (opt1) from CCHFV(ROS/HUVLV-100)__DQ206448.1__GP
augcacacccugcuggugugcuucauccuguaccugcagcuccugggccucggcggggcccaccgccagagcaacgccaccgagcacaacgggaccaacaccaccaccgcccccuccaccagccaguccccgaagccccucgucagcaccgccccgccccacgcccuggaguccagcaccaucaagcccaccacccccguguccgagaccgaggggagcggggagaccacgcccccgcccaacaccacccagggccccagcccgcccgaggccacccccgagcggcccaccaccaccgccaccagcacccccuccacggacaacaccaacagcaccacccacgugacggacaacaaccccaccuccaccaucagcaccuccccgagcuccagccccuccacgcccagcacgccccagggcauccaccacccggcgcgcaaccugcucagcgucuccagccccaagaccgccaccacgcccacccccaccuccccgggggagaucagcuccgagaccagcucccugcacagcgccaugucccggacgagcacccuguacaccgccacccagguguccaccgagaacgcgaaccacagcgcgccccgccaguccgagagcuccgcccagcagacgaccaccagccccaugaccucccccgcccagagcauccucgugauguccgccgcgccgacggccauccagaacauccaccccagccccaccaaccggagcaagcgcaaccuggagauggagaucauccugacccucucccagggccugaagaaguacuacgggaagauccugaagcuccugcaccugacccucgaggaggacacggagggccugcuggaguggugcaagcggaaccucgggagcaacugcgacgacgacuucuuccagaagcgcaucgaggaguucuucaugaccggcgagggcuacuucaacgagguccugcaguucaagacccuguccacccucagcccgacggagcccucccacgcccggccgcccaccguggagccguucaagagcuacuucgccaagggguuccuguccaucgacagcggcuacuucuccgccaagugcuacccccgccugagcaccuccgggcuccagcugaucaacgugacccagcaccccgcgcggaucgccgagacgcccggcccgaagaccaccagccugaagaccaucaacugcaucaaccuccgcgccuccgucuucaaggagcaccgggagaucgagaucaacgugcugcugccccagaucgccgugaaccucagcaacugccacgucgugaucaacucccacgugugcgacuacagccuggacacggacggccccguccgccugccccacaucuaccacgaggggaccuucaucccgggcaccuacaagaucgugaucgacaagaagaacaagcucaacgaccggugcacccuggugacgaacugcgucaucaaggggcgcgaggugcggaagggccaguccgugcugcgccaguacaagaccgagaucaagaucgggaaggccagcaccggcagccggaagcuccuguccgaggagcccggcgacgacugcaucagccgcacccagcugcuccggacggagaccgcggagauccacgacgacaacuacgggggccccggggacaagaucaccaucugcaacggcuccaccaucgucgaccagcgccuggggagcgagcugggcugcuacacgaucaaccgcgugaaguccuucaagcucugcgagaacagcgccaccggcaagaccugcgagaucgacuccacccccgugaagugccggcagggguucugccugaagaucacgcaggagggccgcgggcacgucaagcugagccggggcuccgaggugguccuggacgccugcgacagcuccugcgaggugaugaucccgaaggggaccggcgacauccucguggacugcagcggcgggcagcagcacuuccugaaggacaaccugaucgaccucggcugcccccacaucccccugcuggggaagauggccaucuacaucugccgcauguccaaccacccccggaccaccauggccuuccucuucugguucagcuucggcuacgucaucacgugcaucuucugcaaggcgcuguucuacucccugaucaucaucggcacgcucgggaagaagaucaagcaguaccgcgagcugaagccgcagaccugcaccaucugcgagaccgcccccgugaacgccaucgacgccgagaugcacgaccugaacugcagcuacaacaucugccccuacugcgcgucccggcucacgagcgacggccuggcccgccacgugccccagugcccgaagcggaaggagaaggucgaggagaccgagcuguaccucaaccuggagcgcauccccuggaucgugcggaagcugcuccagguguccgagagcaccggggucgcccugaagcgcagcuccuggcugaucgugcuccuggugcugcucaccgucagccugucccccgugcagagcgccccggugggccacgggaagacgaucgagaccuaccagacccgggagggcuucaccuccaucugccuguucaugcucggcagcauccuguuccuggucuccugccucgugaaggggcugguggacagcgucuccgacagcuucuuccccggccuguccgugugcaagacgugcagcaucggguccaucaacggcuucgagaucgagagccacaagugcuacugcucccucuucugcugccccuacugccgccacugcagcgccgaccgggagauccaccagcugcaccuguccaucugcaagaagcgcaagaccgggagcaacgugaugcucgcggucugcaagcggaugugcuuccgcgccaccaucgaggccucccggcgcgcccugcugauccgcagcaucaucaacaccacguucgugaucugcauccucacccugaccaucugcguggucagcaccuccgccguggagauggagaaccugcccagcggcacgugggagcgggaggaggaccucaccaacuucugccaccaggagugccaggugaccgagaccgagugccugugcccguacgaggcgcugguccuccgcaagccccuguuccuggacuccaucgugaagggcaugaagaaccuccugaacagcacgucccuggagaccagccucuccaucgaggcccccuggggcgccaucaacgugcagagcaccuucaagcccaccgucuccacggccaacaucgcccugagcugguccagcguggagcaccggggcaacaagauccuggugaccgggcgcuccgagagcaucaugaagcucgaggagcggaccggcgucuccugggaccuggggguggaggacgcgagcgaguccaagcugcucaccgugagcaucauggaccugucccagauguacagcccggucuucgaguaccugagcggcgaccgccagguggaggaguggcccaaggccacgugcaccggcgacugccccgagcggugcgggugcaccuccagcacgugccuccacaaggaguggccccacucccgcaacuggcggugcaacccgaccuggugcuggggcguggggaccggcugcacgugcugcggggucgacgugaaggaccuguucaccgaccacauguucgugaaguggaaggucgaguacaucaagaccgaggccaucgugugcguggagcugacgagccaggagcgccagugcucccucaucgaggccggcacccgguucaaccugggccccgucaccaucacccugagcgagccccgcaacauccagcagaagcugccgcccgagaucaucacgcugcaccccaagguggaggagggguucuucgaccugaugcacgugcagaagguccucuccgcgagcaccgugugcaagcugcaguccugcacccacggcauccccggggaccuccagguguaccacaucggcaaccuccugaagggcgaccgggucaacgggcaccugauccacaagaucgagccccacuucaacaccagcuggauguccugggacggcugcgaccucgacuacuacugcaacaugggggacuggcccagcugcacguacaccggcgugacccagcacaaccacgccgccuucgucaaccugcugaacaucgagaccgacuacacgaagaccuuccacuuccacuccaagcgcgugaccgcccacggggacacgccccagcucgaccugaaggcccggcccacguacggcgcgggcgagaucaccgugcuggucgagguggccgacauggagcuccacaccaagaagguggagaucagcgggcugaaguucgccucccuggccugcaccggcugcuacgccugcagcuccgggaucagcugcaagguccgcauccacguggacgagcccgacgagcucacggugcacgucaaguccagcgacccggacgugguggcggccagcaccucccugauggcccggaagcuggaguucggcaccgacagcaccuucaaggccuucuccgccaugcccaagacgagccucugcuucuacaucgucgagcgcgaguacugcaaguccugcagcgaggaggacacccagaagugcguggacaccaagcuggagcagccccaguccauccugaucgagcacaaggggaccaucaucggcaagcagaacgacacgugcaccgcgaaggccagcugcuggcucgaguccgugaaguccuucuucuacggccugaagaacaugcugggguccgucuucggcaacuucuucaucgggauccuccuguuccuggcccccuucgugcugcucgugcuguucuucauguucggcuggaagauccuguucugcuucaagugcugccggcgcacccgggggcuccugaaguaccgccugcucaaggacgacgaggagaccggcuaccgccggaucaucgagcgccugaacaacaagaagggcaagaaccggcugcucgacggggagcgccuggccgaccggaagaucgcggagcuguucagcacgaagacccacaucggcuga

SEQ ID NO: 12071 - RNA, 5052 nt, Artificial Sequence
  derived and/or modified CDS sequence (opt1) from CCHFV(Saf)__KX013487.1__GP
augcacacccugcuggugugcuucauccuguaccugcagcugcugggccucggcggggcccacgggcagagcaacgccaccgagcacaacgggaccaacaccaccaccgcccccuccaccagccaguccccgaagccccucgucagcaccgccccgccccacgcccuggaguccagcaccaucaagcccaccacccccgccuccgagaccgaggggagcggcgagaccacgccgccgcccaacaccacccagggccccagcccgcccgagaccacccccgagcgccccgccaccaccgcgaccagcacccccuccaccgacaacaccaacagcaccacccacgugacggacaacaaccccaccuccaccaucagcaccuccccgagcuccagccccuccacgcccagcacgccccaggggauccaccacccggcccggaaccugcucagcguguccagccccaagaccgccaccacgcccacccccaccuccccgggcgagaucagcuccgagaccagcucccugcacagcgccaugucccgcacgagcacccuguacaccgcgacccaggucuccaccgagaacgccaaccacagcgcgccccggcaguccgagagcuccgcccagcccacgaccaccagccccaugaccuccccggcccagagcauccucgugauguccgcggcccccacggccauccagaacauccaccccagcccgaccaaccgcagcaagcggaaccuggagauggagaucauccugacccucucccaggggcugaagaaguacuacggcaagauccugaagcuccugcaccugacccucgaggaggacacggaggggcugcuggaguggugcaagcgcaaccucggcagcaacugcgacgacgacuucuuccagaagcggaucgaggaguucuucaugaccggcgagggguacuucaacgaggugcugcaguucaagacccuguccacccucagccccacggagcccucccacgcccgcccgcccaccgucgagcccuucaagagcuacuucgccaagggcuuccuguccaucgacagcggguacuucuccgcgaagugcuacccccggagcuccaccagcggccugcagcucaucaacgugacccagcaccccgcccgcaucgccgagacgcccggccccaagaccaccucccugaagaccaucaacugcaucaaccugcgggccagcguguucaaggagcaccgcgagaucgagaucaacguccuccugccccagaucgccgugaaccuguccaacugccacguggucaucaacagccacgugugcgacuacucccucgacacggacgggcccgugcggcugccgcacauccaccacgagggcaccuucauccccgggaccuacaagaucgucaucgacaaggagaacaagcugaacgaccgcugcacccucgugacgaacugcgugaucaagggccgggagguccgcaaggggcagagcgugcugcggcaguacaagaccgagaucaagaucggcaaggcgagcaccggcucccgcaagcugcucagcgaggagcccggggacgacugcaucucccggacccagcugcugcgcacggagaccgccgagauccacgacgacaacuacggcgggcccggcgacaagaucaccaucugcaacgggagcaccaucguggaccagcggcucggcuccgagcugggcugcuacacgaucaaccgcgucaagagcuucaagcugugcgagaacuccgccaccgggaagaccugcgagaucgacagcaccccggugaagugccgccagggcuucugccucaagaucacgcaggaggggcggggccacgugaagcugucccgcgggagcgaggucgugcuggacgccugcgacuccagcugcgaggucaugauccccaagggcaccggcgacauccugguggacugcuccgggggccagcagcacuaccucaaggacaaccugaucgaccuggggugcccccacaucccccuccugggcaagauggccaucuacaucugccggaugagcaaccacccgcgcaccaccauggcguuccuguucugguucuccuucggcuacgugaucacgugcaucuucugcaaggcccucuucuacagccugaucaucaucgggacgcugggcaagaagaucaagcaguaccgggagcucaagccccagaccugcaccaucugcgagaccgcccccgucaacgccaucgacgcggagaugcacgaccugaacugcuccuacaacaucugccccuacugcgccagccgccugacguccgacgggcucgcccggcacgugccgcagugccccaagcgcaaggagaagguggaggagaccgagcuguaccugaaccucgagcggauccccuggaucguccgcaagcugcuccaggugagcgagagcaccggcguggcccucaagcgguccagcuggcugaucguccugcucgugcugcugaccgugucccucagcccgguccaguccgcccccguggggcacggcaagacgaucgagaccuaccagacccgcgagggcuucaccagcaucugccuguucaugcugggguccauccucuuccuggugagcugccuggucaagggccucguggacuccgugagcgacuccuucuuccccgggcugagcgucugcaagacgugcuccaucggcagcaucaacggguucgagaucgagucccacaagugcuacugcagccuguucugcugccccuacugccggcacugcuccgcggaccgcgagauccaccagcuccaccugagcaucugcaagaagcggaagaccggcuccaacgugaugcuggccgugugcaagcgcaugugcuuccgggccaccaucgaggccagccgccgggcccuccugauccgcagcaucaucaacaccacguucgucaucugcauccugacccucaccaucugcgugguguccaccagcgcggucgagauggagaaccugccguccggcacgugggagcgcgaggaggaccugaccaacuucugccaccaggagugccaggugaccgagaccgagugccucugccccuacgaggcccuggugcugcggaagccccucuucagcgacuccaucgucaaggggaugaagaaccugcugaacagcacgucccucgagaccagccuguccaucgaggcccccuggggcgccaucaacgugcagagcaccuucaagccgaccguguccacggccaacaucgcgcugagcugguccagcgucgagcaccgcgggaacaagauccucgugaccggccgguccgagagcaucaugaagcuggaggagcgcaccgggguguccugggaccugggcgucgaggacgccagcgaguccaagcuccugaccgugagcaucauggaccugagccagauguacucccccguguucgaguaccucagcggcgaccggcaggucgaggaguggcccaaggccacgugcaccggggacugccccgagcgcugcggcugcaccuccagcacgugccugcacaaggaguggccgcacucccggaacuggcgcugcaaccccaccuggugcuggggcgugggcaccgggugcacgugcugcggcguggacgucaaggaccuguucaccgaccacauguucgugaaguggaagguggaguacaucaagaccgaggccaucgucugcguggagcucacgagccaggagcggcagugcucccugaucgaggcgggcacccgcuucaaccuggggcccgugaccaucacccucagcgagccccggaacauccagcagaagcugccgcccgagaucaucacgcugcaccccaaggucgaggagggcuucuucgaccucaugcacgugcagaaggugcuguccgccagcaccgucugcaagcugcaguccugcacccacgggauccccggcgaccuccagguguaccacaucggcaaccugcugaagggggaccgcgugaacggccaccucauccacaagaucgagccgcacuucaacaccagcuggauguccugggacgggugcgaccuggacuacuacugcaacaugggcgacuggcccagcugcacguacaccggggucacccagcacaaccacgccgccuucgugaaccugcucaacaucgagaccgacuacaugaagacguuccacuuccacuccaagcgggucaccgcccacggcgacacgccccagcuggaccugaaggcgcgccccaccuacggcgccggggagaucacggugcucguggaggucgccgacauggagcugcacaccaagaagguggagaucagcggccugaaguucgugucccucgccugcaccgggugcuacgccugcagcuccggcaucagcugcaagguccggauccacguggacgagccggacgagcugaccgugcacgucaagagcuccgaccccgacgugguggcggccagcacgucccugauggcccgcaagcucgaguucgggaccgacagcaccuucaaggccuucuccgccaugcccaagaccagccugugcuucuacaucgucgagcgggaguacugcaaguccugcagcgaggaggacacgcagaagugcguggacaccaagcuggagcagccccaguccauccucaucgagcacaagggcaccaucaucggcaagcagaacgacacgugcacggcgaaggccagcugcuggcuggaguccgugaaguccuucuucuacgggcugaagaacaugcucggcuccgucuucgggaacuucuucaucggcauccugcuguuccucgccccguucgugcugcuggugcuguucuucauguucggguggaagauccucuucugcuucaagugcugccgccggacccgcggccugcugaaguaccggcaccucaaggacgacgaggagaccggcuaccgccgcaucaucgagcggcugaacaacaagaaggggaagaaccgccugcucgacggcgagcggcuggccgaccgcaagaucgcggagcuguucagcaccaagacgcacaucggguga

SEQ ID NO: 12072 - RNA, 5052 nt, Artificial Sequence
  derived and/or modified CDS sequence (opt1) from CCHFV(52-R-2014)__KR814862.1__GP
augcacacccugcucgugugcuucauccuguaccugcagcuccugggccucgggggcgcccaccgccagagcaacgccaccgagcacaacgggacgaacaccaccaccgcgcccuccacgagccaguccccgaagccgcccgucagcaccgcgccgccccacgcccccgaguccagcaccaucaagcccaccacgcccgccuccgagaccgagggcagcggggagaccacgcccccgcccaacaccacccagggccccuccccgcccgaggccacccccgagcggcccgccaccacggccaccagcacccccuccaccgacaacacgaacagcaccacccacgccaccgacaacaaccccacguccaccaucagcaccucccccagcuccagccccuccaccccgagcacgccccagggcauccaccaccccgcccgcaaccuccugagcguguccagccccaagaccgcgaccaccccgacgcccaccucccccggggacaucagcuccgagaccagcucccugcacagcgccaugucccggacccccacgcuccacaccgccacccaggccagcaccgagaacgccaaccacuccgcgccgcgccagagcgaguccagcgcccagcagaccacgaccucccccaugaccagccccgcccagccgauccuggugauguccgccgcccccaccgcgauccagaacauccaccccagccccacgaaccgguccaagcgcaaccuggagauggagaucauccucacccugagccagggccugaagaaguacuacgggaagauccucaagcugcugcaccucacccuggaggaggacaccgagggccugcucgaguggugcaagcggaaccuggggagcaacugcgacgacgacuucuuccagaagcgcaucgaggaguucuucaugacgggcgagggcuacuucaacgagguccugcaguucaagacccucuccacccugagcccgaccgagcccucccacgcccggccgcccacgguggagcccuucaagagcuacuucgccaagggguuccuguccaucgacagcggcuacuucuccgccaagugcuacccccgccucagcaccuccgggcugcagcugaucaacgugacccagcaccccgcccggaucgcggagacccccggcccgaagacgaccagccucaagaccaucaacugcaucaaccugcgcgccuccgucuucaaggagcaccgggagaucgagaucaacgugcugcucccccagaucgccgugaaccugagcaacugccacgucgugaucaacucccacgugugcgacuacagccuggacaccgacggccccguccgccucccccacaucuaccacgaggggacguucaucccgggcaccuacaagaucgugaucgacaagaagaacaagcugaacgaccggugcacccuggugaccaacugcgucaucaaggggcgcgaggugcggaagggccaguccgugcuccgccaguacaagacggagaucaagaucgggaaggccagcaccggcucccggaagcugcugagcgaggagcccggcgacgacugcaucagccgcacccagcuccugcggaccgagacggccgagauccacgacgacaacuacgggggccccggggacaagaucaccaucugcaacggcuccaccaucgucgaccagcgccuggggagcgagcucggcugcuacaccaucaaccgcgugaaguccuucaagcugugcgagaacagcgcgacgggcaagaccugcgagaucgacuccacccccgugaagugccggcagggguucugccugaagaucacccaggagggccgcgggcacgucaagcucagccggggcuccgagguggugcuggacgccugcgacacgagcugcgaggucaugaucccgaaggggaccggcgacauccugguggacugcuccggcgggcagcagcacuuccugaaggacaaccucaucgaccugggcugcccccacgucccccugcucgggaagauggccaucuacaucugccgcaugagcaaccacccccggaccaccauggccuuccuguucugguucuccuucggcuacgugaucacgugcaucuucugcaaggcgcuguucuacagccucaucaucaucggcacccuggggaagaagaucaagcaguaccgcgagcugaagccgcagaccugcaccaucugcgagaccgcccccgugaacgccaucgacgccgagaugcacgaccucaacugcuccuacaacaucugccccuacugcgccagccggcugacguccgacggccuggcgcgccacgucccgcagugccccaagcggaaggagaagguggaggagaccgagcucuaccugaaccuggagcgcauccccuggaucgugcggaagcuccugcaggucagcgaguccaccgggguggcccugaagcgcagcuccuggcucaucgugcugcugguccuccugaccgugagccugagccccgugcaguccgccccggucggccacgggaagacgaucgagaccuaccagacccgggagggcuucaccagcgugugccucuucaugcugggcuccauccuguuccucgugagcugccuggucaaggggcugguggacuccgugagcgacuccuucuuccccggccucagcgucugcaagacgugcuccaucgggagcaucaacggcuucgagaucgagucccacaagugcuacugcagccuguucugcugccccuacugccgccacugcuccgccgaccgggagauccaccagcugcaccucagcaucugcaagaagcgcaagaugggguccaacgugaugcuggccgugugcaagcggaugugcuuccgcgcgaccaucgaggccagccggcgcgcccugcucauccgcuccaucaucaacaccaccuucgucaucugcauccugacgcugaccaucugcguggugagcaccuccgccgucgagauggagaaccuccccagcggcaccugggagcgggaggaggaccugacgaacuucugccaccaggagugccaggugaccgagaccgagugccugugcccguacgaggcccucgugcugcgcaagccccuguuccucgacagcaucgucaagggcaugaagaaccugcugaacuccaccagccucgagacgucccugagcaucgaggcgcccuggggcgccaucaacgugcaguccaccuucaagcccaccgugagcaccgccaacaucgcccuguccuggagcuccgucgagcaccgggggaacaagauccucgugacggggcgcagcgaguccaucaugaagcuggaggagcggaccggcgugagcugggaccugggggucgacgacgcguccgagagcaagcuccugaccguguccaucauggaccugagccagauguacuccccgguguucgaguaccucagcggcgaccgccaggucgaggaguggcccaaggcgaccugcacgggcgacugccccgagcggugcgggugcaccuccuccacgugccugcacaaggaguggccccacagccgcaacuggcggugcaacccgaccuggugcuggggcguggggaccggcugcacgugcugcgggguggacgucaaggaccuguucaccgaccacauguucgugaaguggaagguggaguacaucaagaccgaggccaucgucugcguggagcucaccagccaggagcgccagugcagccugaucgaggccggcacccgguucaaccugggccccgugaccaucacccucuccgagccccgcaacauccagcagaagcugcccccggagaucaucacccugcaccccaaggucgaggagggguucuucgaccucaugcacgugcagaaggugcugagcgccuccacggucugcaagcugcagagcugcacccacggcauccccggggaccuccagguguaccacaucggcaaccugcugaagggcgaccgggugaacgggcaccucauccacaagaucgagccccacuucaacaccuccuggaugagcugggacggcugcgaccuggacuacuacugcaacaugggggacuggccguccugcaccuacacgggcgucacccagcacaaccacgccgccuucgugaaccugcucaacaucgagaccgacuacaccaagacguuccacuuccacagcaagcgcgucaccgcccacggggacacgccccagcuggaccugaaggcccggcccaccuacggcgccggcgagaucaccgugcucguggaggucgcggacauggagcugcacaccaagaagguggagaucuccgggcugaaguucgccagccucgccugcaccggcugcuacgccugcuccagcgggaucuccugcaaggugcgcauccacgucgacgagcccgacgagcugaccgugcacgucaagagcaacgacccggacgugguggccgcguccacgagccugauggcccggaagcucgaguucggcaccgacuccaccuucaaggccuucagcgccaugcccaagaccagccugugcuucuacaucguggagcgcgaguacugcaaguccugcagcgaggaggacacgcagaagugcgucgacaccaagcuggagcagccccaguccauccucaucgagcacaaggggaccaucaucggcaagcagaacgacacgugcaccgcgaaggccggcugcuggcuggagagcgugaaguccuucuucuacgggcugaagaacaugcucggcagcguguucgggaacuucuucaucggcauccugcuguuccucgccccguucguccugcuggugcuguucuucauguucggguggaagauccucuucugcuucaagugcugccggcgcacccggggccugcugaaguaccgccuccugaaggacgacgaggagaccggcuaccgccggaucaucgagcgccugaacaacaagaaggggaagaaccggcuccuggacggcgagcgccuggccgaccggaagaucgccgagcuguucuccaccaagacgcacaucggguga

SEQ ID NO: 12073 - RNA, 5052 nt, Artificial Sequence
  derived and/or modified CDS sequence (opt1) from CCHFV(Turkey-Kelkit06)__GQ337054.1__GP
augcacacgccccuggugugcuucauccucuaccugcagcugcucugccugggcggggcccacggccagcugaacgccaccgagcacaacgggaccaacaacaccaccgcgccgggcgccagccagucccccaagccgcccaugagcaccacgccgccccacgcccccgaguccagcaccaucaagcccaccacccccaucuccgaggccgaggggagcggcgagacgaccuccccgcccaacaccacccagggccucagcucccccgagacgaccagcgagcgccccgccaccaccuccaucagcacguccagcaccgacuccaccaaccccaccacgcagaugaccgacaacacccccacccccacggucagcaccuccccgagcuccagccccagcacccccuccacgccccaggggauccaccacccggcgcggagccugcuguccgugagcucccccaagaccgugaccacccccacccccacgagcccgggcgagauguccagcgagaccuccagccagcacuccgccaugagccgcauccccacgccccacaccgccacccgggucuccaccgagaucaccaaccaccgcacgccccggcagagcgaguccagcgcccagcagaccaccccgucccccaugaccagccccgcgcaguccauccuccugaugagcgccgccccgaccgccgugcaggacauccaccccagccccaccaaccgcuccaagcggaaccuggagacggagaucauccucacccugagccaggggcugaagaaguacuacggcaagauccucaagcugcugcaccucacccuggagcaggacaccgaggggcugcucgaguggugcaagggcaaccugggcuccaacugcgacgacgacuucuuccagaagcgcaucgaggaguucuucaugacgggggagugcuacuucaacgaggugcugcaguucaagacccucagcacccugucccccaccgagccgagccacgcccggcugcccacggcggagcccuucaaguccuacuucgccaagggcuuccucagcaucgacuccggguacuucagcgccaagugcuacccccgcuccagcgccuccggccugcagcugaucaacgucacccagcacccggcccggaucgcggagacccccggccccaagaccacgagccucaagaccaucaacugcaucaaccugcgcgccuccguguucaaggagcaccgggagguggagaucaacguccugcucccccagaucgccgugaaccugagcaacugccacguggucaucaacucccacgugugcgacuacagccuggacaccgacgggccggugcgccucccccggaucuaccacgagggcaccuucauccccgggacguacaagaucgucaucgacaagaagaacaagcugaacgaccgcugcacccuggugaccaacugcgugaucaagggccgggagguccgcaaggggcagagcgugcuccggcaguacaagaccgagaucaagaucggcaaggccuccacgggcuuccgcaagcugcugagcgaggagcccggggacgacugcaucucccggacccagcuccugcgcaccgagaccgccgagauccacgacgacaacuacggcgggccgggcgacaagaucacgaucugcaacgggagcaccaucguggaccagcgccugggcuccgagcucggcugcuacaccaucaaccgggucaagagcuucaagcugugcaagaacuccgcgaccgggaagacgugcgagguggacagcacccccgugaagugccgccagggcuucugccugaagaucacccaggaggggcggggccacgucaagcucucccgcgggagcgaggugguccuggacgccugcgacuccagcugcgaggugaugauccccaagggcaccggcgacauccugguggacugcuccgggggccagcagcacuuccugaaggacaaccucaucgaccuggggugcccccacaucccgcugcucggccggauggccaucuacaucugccgcaugagcaaccacccccggacgaccauggccuuccuguucugguucuccuucggcuacgucaucacgugcaucuucugcaaggcccuguucuacagccucaucaucaucgggacccugggcaagaagaucaagcaguaccgcgagcugaagccccagaccugcaccaucugcgagaccgcgcccgugaacgccaucgacgccgagaugcacgaccucaacugcuccuacaacaucugcccguacugcgccagccggcugaccuccgacgggcuggcgcgccacgugacccagugccccaagcggaaggagaaggucgaggagacggagcucuaccugaaccuggagcgcauccccuggaucgugcggaagcuccuccaggugagcgagagcaccggcgucgcccugaagcgcuccagcuggcugaucgugcugcuggugcuccugaccgucucccugagcccggugcaguccgcccccguggggcacggcaagaccaucgagaucuaccagacgcgggagggcuucgccagcaucugccucuucaugcugggguccauccuguucaucgucagcugccucgugaagggccugguggacuccgucagcgaguccuucuuccccgggcugagcgugugcaagaccugcuccaucggcagcgugaacggguucgagaucgagucccacaagugcuacugcagccucuucugcugccccuacugccgccacugcuccgccgaccgggagauccaccagcugcaccugagcaucugcaagaagcgcaagaccggcuccaacgucaugcucgcggugugcaagcggaugugcuuccgcgccaccaucgaggccagccgccgggcccugcugauccgcagcaucaucaacacgaccuucgugaucugcauccucacccugaccaucugcgucguguccacgagcgccguggagauggagaaccugccggcgggcaccugggagcgggaggaggaccucaccaacuucugccaccaggagugccaggucaccgagacggagugccugugccccuacgaggcccuggugcuccgcaagccccuguuccuggacuccaucgugaaggggaugaagaaccuccugaacagcaccucccuggagaccagccucuccaucgaggcccccuggggcgccaucaacguccagagcaccuucaagccgacgguguccaccgccaacaucgcgcugagcugguccagcgugguccaccgggggaacaagauccuggugaccggccgcuccgagagcaucaugaagcucgaggagcggaccgggguguccugggaccugggcgucgaggacgccagcgaguccaagcugcucacggugagcaucauggaccugucccagauguacagccccguguucgaguaccugagcggcgaccgccaggucgaggaguggcccaaggcgaccugcaccggggacugccccgagcggugcggcugcaccuccagcacgugccuccacaaggaguggucccacagccgcaacuggcggugcaacccgaccuggugcuggggcguggggaccgggugcacgugcugcggcguggacgucaaggaccuguucaccgaccacauguucgugaaguggaagguggaguacaucaagaccgaggccaucgucugcguggcccugaccucccaggagcgccagugcagccucaucgaggccggcacccgguucaaccuggggcccgugaccaucacgcuguccgagccccgcaacauccagcagaagcugcccccggagaucaucacccuccaccccaagaucgaggagggcuucuucgaccugaugcacguccagaaggugcucagcgccuccaccgugugcaagcugcagagcugcacccacgggauccccggcgaccugcaggucuaccacaucggcaaccuccugaagggggaccgggugaacggccaccugauccacaagaucgagucccacuucaacacgagcuggauguccugggacgggugcgaccucgacuacuacugcaacaugggcgacuggcccagcugcaccuacaccggggucacccagcacaaccacgccgccuucgugaaccugcugaacaucgagacggacuacaccaagaccuuccacuuccacuccaagcgcgugaccgcgcacggcgacacgccgcagcucgaccugaaggcccggcccaccuacggcgccgggggcaucaccguccugguggagguggccgacauggagcuccacaccaagaaggucgagaucagcgggcugaaguucgccucccuggcgugcacgggcugcuacgccugcagcuccgggaucagcugcaaggugcgcauccacguggacgagcccgacgagcucaccguccacgucaagagcuccgaccccgacgugguggccgccagcaccucccugauggcccggaagcuggaguucggcaccgacagcacguucaaggcguucuccgccaugccgaagaccagccucugcuucuacaucguggagcgcgaguacugcaaguccugcagcgaggacgacacccagaagugcguggacacccggcuggagcagccccaguccauccugaucgagcacaagggcacgaucaucgggaagcagaacgacacgugcaccgccaaggccagcugcuggcucgaguccgucaagagcuucuucuacggccugaagaacaugcugggguccguguucggcaaccucuucaucgggauccugcuguuccucgcgcccuucgugcugcugguccuguucuucauguucggcuggaagauccucuucugcuucaagugcugccgccgcacccggggccuguucaaguaccgccaccugaaggacgacgaggagaccggguaccggcgcaucaucgagcggcucaacagcaagaagggcaagaaccgccugcuggacggggaccggcucgccgaccgcaagaucgccgagcuguucuccaccaagacccacaucggcuga

SEQ ID NO: 12074 - RNA, 5052 nt, Artificial Sequence
  derived and/or modified CDS sequence (opt1) from CCHFV(V42/81)__GU477490.1__GP
augcacacccugcucgugugcuucauccuguaccugcagcuccugggccucgggggcgcccacguccagcccaacgccaccgagcacaaccgcacgaacaccaccaccgcgccggggacgagccacucccucaagccccuggugagcaccaccccgccccaggcccccgaguccagcaccaucaagcccacgacccccaccuccgagaccgagggcagcggggaggccacgccccuguccaacaccauccaggccccgagcucccccgagaccaccagcgagcggcccgccacggcggugaucuccaccagcggcaccgacuccaccaacagcacgacccagaccaccgacaacaaccccacgaccaccgucggcaccuccccgagcuccagccccuccacgcccagcacgccccaggggauccaccaccacgcccgcagccuccuguccgugaccagcccggagaccgugaccacccccaagcccaccagcccccgggagauguccuccgagaccagcaaccagcacuccgccaugagccgcacgccgacccaccacaccgucacccagguguccaccgagaacacgagccacuccacgccccggcagcccgagagcuccgcccagcccaccagcuccagcccgaugaccucccccgcgcagagcacccugcucauguccgccgcccccaccgccgugcagagcauccaccccagcccgaccaaccgcuccaagcggaaccuggagaccgagaucauccugacgcucagccagggccugaagaaguacuacgggaagauccugaagcuccugcaccugacccucgaggaggacaccgagggccugcuggaguggugcaagcgcaaccucggguccaacugcgacgacgacuucuuccagaagcggaucgaggaguucuucaugaccggcgagggcuacuucaacgagguccugcaguucaagacgcccagcaccgugucccccaccgagccgagccacgcccgccugcccaccgcggagcccuucaaguccuacuucgccaagggguuccucagcaucgacuccggcuacuucagcgccaagugcuacucccggagcuccacgagcgggcugcagcugaucaacgugacccagcaccccgcccgcaucgccgagaccccgggccccaagaccacgucccucaagaccaucaacugcaucaaccugcgggcgagcgucuucaaggagaaccgcgagaucgagaucuccgugcugcucccccagaucgccgugaaccugagcaacugccacgucgugaucaacagccacgugugcgacuacucccuggacaccgacggccccguccggcucccgcgcaucaaccacgaggggaccuucauccccggcacguacaagaucgugaucgacaagaagaacaagcugaacgaccggugcacccuggugaccaacugcgucaucaaggggcgcgaggugcggaagggccagagcgugcuccgccaguacaagaccgagaucaagaucgggaaggccuccacgggcagccggaagcugcuguccaaggagcccggcgacgacugcaucagccgcacccagcucaugcgcaccgagaccgccgagauccacgacgacaacuacgggggccccggggacaagaucacgaucugcaacggcuccaccaucgucgaccagcggcuggggagcgagcugggcugcuacaccaucaaccgcgugaaguccuucaagcucugcgagaacagcgccaccggcaaggcgugcgaggucgacuccacgccggugaagugccggcagggguucugccugaagaucacccaggagggccgcgggcacgugaagcugagccggggcuccgaggucgugcucgacgccugcgacagcuccugcgaggugaugauccccaaggggaccggcgacauccuggucgacugcagcggcgggcagcagcacuuccugaaggacaaccugaucgaccucgagugcccccacaucccccugcugggcaagcucgccaucuacaucugccgcauguccaaccacccgcggaccaccauggccuuccuguucugguucggguucggcuacgugaucacgugcauccugugcaaggcccucuucuacagccugaucaucaucggcacccuggggaagaagaucaagcaguaccgcgagcucaagccccagaccugcaccaucugcgagacggcgcccgugaacgccaucgacgccgagaugcacgaccugaacugcuccuacaacaucugccccuacugcgccagccggcugaccagcgacggccucgcgcgccacgucacccagugcccgaagcggaaggagaagguggaggagaccgagcuguaccugaaccucgagcgcauccccuggaucgugcggaagcugcugcaggucuccgagagcacggggguggugcucaagcgcuccagcuggcugaucguccugcucgugcugcugaccgugucccucagccccguccaguccgcccccgugggccacgggaagaccaucgagaccuaccagacgcgggagggcuucaccagcaucugccuguucaugcugggcuccauccucuucaucgugagcugcaucgucaaggggcugguggacuccgugagcgacuccuucuucccgggccugagcgucugcaagaccugcuccaucagcuccaucaacggguucgagaucgagagccacaagugcuacugcucccucuucugcugccccuacugccgccacugcagcgccgaccgggagauccaccagcugcaccugagcaucugccgcaagcggcgcaccggcuccaacgugaugcucgccgugugcaagcgcaugugcuuccgggccacgaucgaggucagccgccgggcgcugcugauccgcuccaucaucaacaccaccuucgugaucugcauccucacccugacgaucugcguggucagcaccuccgccguggagauggagaaccugcccgccgggaccugggagcgggaggaggaccucaccaacuucugccaccaggagugccaggugacggagaccgagugccugugcccguacgaggcccugguccuccgcaagccccuguuccuggacagcaucgugaagggcaagaagaaccuccugaacuccaccagccuggagaccucccucagcaucgaggcccccuggggcgcgaucaacauccaguccacguucaagcccaccgugagcgccgccaacaucgcccuguccuggagcuccgucgagcaccgggggaacaagauccuggugagcggccgcuccgagagcaucaugaagcucgaggagcggaccgggguguccuggaaccugggcgucgaggacgccagcgagagcaagcugcucaccguguccaucauggaccugagccagauguacuccccgguguucgaguaccugagcggggaccgccaggucgaggaguggcccaaggcgacgugcaccggcgacugccccgagcggugcggcugcaccuccuccacgugccuccacaaggaguggccccacagccgcaacuggcggugcaacccgaccuggugcuggggcguggggaccgggugcacgugcugcggcguggacgucaaggaccuguucaucgaccacauguucgugaaguggaagguggaguacaucaagaccgaggccaucgucugcguggagcugaccagccaggagcgccagugcucccucaucgaggccgggacccgguucaaccugggccccgugaccaucacccugagcgagccccgcaacauccagcagaagcugcccccggagaucaucacccugcaccccaagaucgaggagggcuucuucgaccugaugcacguccagaaggugcucuccgccagcacggucugcaagcugcaguccugcacccacgggauccccggcgaccuccagguguaccacaucgggaaccuccugaagggcgaccgggugaacggccaccugauccacaagaucgagccccacuucaacaccagcuggauguccugggacgggugcgaccucgacuacuacugcaacaugggcgacuggccgagcugcaccuacacgggggucacccagcacaaccacgcggccuucgugaaccugcugaacaucgagaccgacuacaccaagacguuccacuuccacuccaagcgcgugaccgcccacggcgagacgccccagcucgaccugaaggcccggcccgccuacggggcgggcgagaucaccguccugguggagguggccgacauggagcuccacaccaagaaggucgagaucagcggccugaaguucgccucccuggccugcaccgggugcuacgccugcagcagcggcaucuccugcaaggugcgcauccacguggacgagcccgacgagcucaccguccacgucaagagcaacgacccggacgugguggcggccuccaccagccugauggcccggaagcuggaguccgggacggacagcaccuucaaggccuucuccgccaugcccaagaccagccucugcuucuacaucguggagcgcgaguacugcaaguccugcagcgaggacgacacccagaagugcguggagacgaagcuggagcagccccaguccauccugaucgagcacaagggcaccaucaucgggaagcagaacgacacgugcaccgcgaaggccagcugcuggcucgaguccgucaagagcuucuucuacggccugaagaacaugcugggcuccguguucgggaacuucuucaucggcauccuccuguuccuggcccccuucgugcuccugguccuguucuucauguucggguggaagauccuguucugcuucaagugcugccgccggacccgcggccucuucaaguaccggcaccugaaggaggacgaggagaccggguaccgccggaucaucgagcgccugaacagcaagaagggcaagaaccggcuccuggacggcgagcgccuggccgaccggaagaucgcggagcuguucuccaccaagacccacaucggguga

SEQ ID NO: 12075 - RNA, 5052 nt, Artificial Sequence
  derived and/or modified CDS sequence (opt1) from CCHFV(75-R-2012)__KR814863.1__GP
augcacacccugcuggugugcuucauccuguaccugcagcuccugggccucggcggggcccaccgccagagcaacgccaccgggcacaacgggaccaacaccaccaccgcccccuccaccagccaguccccgaagccccucgucagcaccgccccgccccacgcccuggaguccagcaucaucaagcacaccacccccguguccgagaccgaggggagcggcgagaccacgcccccgcccaacaccacccagggccccagcccccuggagaccacccccgagcggcccgccaccaccgccaccagcaccccguccaccgacaacacgaacagcaccacccacgugaccgacaacaaccccacguccaccaucagcaccucccccagcuccagccccuccaccccgagcacgccccaggggauccaccaccccgcgcgcaaccuccugagcgucuccagccugaagaccgccaccacccccacgccgaccucccccggcgagaucagcuccgagaccagcucccuccacagcgccaugucccggaccagcacgcuguacaccgccacccagguguccaccgagaacgccaaccacagcgcgccccgccaguccgagagcuccgcccagcagaccacgaccagccccaugaccuccccggcccagagcauccuggugauguccgccgcgcccaccgccauccagaacacgcaccccagccccaccaaccggagcaagcgcaaccucgagauggagaucauccugacccugucccaggggcucaagaaguacuacggcaagauccugaagcugcuccaccugacccuggaggaggacacggaggggcuccuggaguggugcaagcggaaccugggcagcaacugcgacgacgacuucuuccagaagcgcaucgaggaguucuucaugaccggcgagggguacuucaacgaggugcuccaguucaagacccuguccacccagagcccgacggagcccucccacgcccggcccccgaccguggagcccuucaagagcuacuucgccaagggcuuccuguccaucgacagcggguacuucuccgccaagugcuacccccgccucagcaccuccggccugcagcugaucaacgugacccagcaccccgcgcggaucgccgagacgccgggccccaagaccaccagccucaagaccaucaacugcaucaaccugcgcgccuccgucuucaaggagcaccgggagaucgagaucaacgugcugcucccccagaucgccgugaaccugagcaacugccacgucgugaucaacucccacgugugcgacuacagccuggacacggacgggcccguccgccucccgcacaucuaccacgagggcaccuucauccccgggaccuacaagaucgugaucgacaagaagaacaagcugaacgaccggugcacccuggugacgaacugcgucaucaagggccgcgaggugcggaaggggcaguccgugcuccgccaguacaagaccgagaucaagaucggcaaggccagcaccggcagccggaagcugcuguccgaggagcccggggacgacugcaucagccgcacccagcuccugcggacggagaccgcggagauccacgacgacaacuacggcgggcccggcgacaagaucaccaucugcaacggguccaccaucgucgaccagcgccugggcagcgagcucggcugcuacacgaucaaccgcgugaaguccuucaagcugugcgagaacagcgccaccgggaagaccugcgagaucgacuccgccccggugaagugccggcagggcuucugccugaagaucacccaggaggggcgcggccacgucaagcugagccggggguccgaggugguccucgacgccugcgacagcuccugcgaggugaugauccccaagggcacgggcgacauccugguggacugcagcgggggccagcagcacuuccugaaggacaaccucaucgaccuggggugcccccacaucccccugcucggcaagauggccaucuacaucugccgcauguccaaccacccgcggaccaccauggcguuccuguucugguucagcuucggcuacgucaucacgugcaucuucugcaaggcccuguucuacucccucaucaucaucgggacccugggcaagaagaucaagcaguaccgcgagcugaagccccagacgugcaccaucugcgagaccgcccccgugaacgccaucgacgcggagaugcacgaccucaacugcagcuacaacaucugccccuacugcgccucccggcugaccagcgacgggcuggcccgccacgugccgcagugccccaagcggaaggagaaggucgaggagacggagcucuaccugaaccuggagcgcauccccuggaucgugcggaagcuccuccagguguccgagagcaccggcgucgcccugaagcgcagcuccuggcucaucgugcugcuggugcuccugaccgucagccugucccccgugcagagcgccccgguggggcacggcaagaccaucgagacguaccagacccgggagggcuucaccuccaucugccucuucaugcuggggagcauccuguuccucgucuccugccuggugaagggccuggugaacagcgucuccgacagcuucuuccccgggcucuccgugugcaagaccugcagcaucggcuccaucaacggguucgagaucgagagccacaagugcuacugcucccuguucugcugccccuacugccgccacugcagcgcggaccgggagauccaccagcugcaccucuccaucugcaagaagcgcaagacgggcagcaacgugaugcuggccgucugcaagcggaugugcuuccgcgccaccaucgaggccucccggcgcgcccugcucauccgcagcaucaucaacaccaccuucgugaucugcauccugacgcugaccaucugcguggucagcaccuccgcgguggagauggagaaccucccgagcggcaccugggagcgggaggaggaccugacgaacuucugccaccaggagugccaggugaccgagaccgagugccugugccccuacgaggcccucguccugcgcaagccccuguuccucgacuccaucgugaaggggaugaagaaccugcugaacagcaccucccucgagacgagccuguccaucgaggcccccuggggcgccaucaacgugcagagcaccuucaagccgaccgucuccaccgccaacaucgcgcugagcugguccagcguggagcaccgggggaacaagauccucgugacgggccgcuccgagagcaucaugaagcuggaggagcggaccggggucuccugggaccugggcguggaggacgccagcgaguccaagcuccugaccgugagcaucauggaccugucccagauguacagccccgucuucgaguaccucagcggcgaccgccagguggaggaguggcccaaggcgaccugcacgggggacugccccgagcggugcggcugcaccuccuccacgugccugcacaaggaguggccgcacucccgcaacuggcggugcaaccccaccuggugcuggggcgugggcaccgggugcacgugcugcggcgucgacgugaaggaccuguucaccgaccacauguucgugaaguggaaggucgaguacaucaagaccgaggccaucgugugcguggagcucaccagccaggagcgccagugcucccugaucgaggcgggcacgcgguucaaccuggggcccgucaccaucacccucagcgagccccgcaacauccagcagaagcugccgcccgagaucaucacccugcaccccaagguggaggagggcuucuucgaccucaugcacgugcagaagguccuguccgccagcacggugugcaagcugcaguccugcacccacgggauccccggcgaccuccagguguaccacaucggcaaccugcugaagggggaccgggucaacggccaccucauccacaagaucgagccgcacuucaacaccagcuggauguccugggacgggugcgaccuggacuacuacugcaacaugggcgacuggcccagcugcaccuacacgggggugacccagcacaaccacgccgccuucgucaaccugcucaacaucgagaccgacuacaccaagacguuccacuuccacuccaagcgcgugaccgcccacggcgacacgccccagcuggaccugaaggcgcggcccaccuacggcgccggggagaucacggugcucgucgagguggccgacauggagcugcacaccaagaagguggagaucagcggccugaaguucgccucccucgccugcaccgggugcuacgcgugcagcuccggcaucagcugcaagguccgcauccacguggacgagccggacgagcugaccgugcacgucaaguccagcgaccccgacgugguggccgccagcacgucccugauggcccggaagcucgaguucgggaccgacagcaccuucaaggccuucuccgcgaugcccaagaccagccugugcuucuacaucgucgagcgcgaguacugcaaguccugcagcgaggaggacacgcagaagugcguggacaccaagcuggagcagccccaguccauccucaucgagcacaagggcaccaucaucggcaagcagaacgacacgugcacggccaaggccagcugcuggcuggaguccgucaagagcuuccuguacgggcucaagaacaugcugggcuccgucuucgggaacuucuucaucggcauccugcuguuccucgccccguucgugcugcuggugcuguucuucauguucggguggaagauccuguucugcuucaagugcugccggcgcacccggggccugcucaaguaccgccugcugaaggacgacgaggagaccggcuaccgccggaucaucgagcgccucaacaacaagaaggggaagaaccggcugcuggacggcgagcgccucgcggaccggaagaucgccgagcuguucagcaccaagacgcacaucggguga

SEQ ID NO: 12076 - RNA, 5052 nt, Artificial Sequence
  derived and/or modified CDS sequence (opt1) from CCHFV(VLG/TI29414)__AY179961.1__GP
augcacacccugcuggugugcuucauccuguaccugcagcuccugggccucgggggcgcccacauccagagcaacgccaccgagcacaacgggaccaacaccaccaccgcccccuccaccagccaguccccgaagccccucgucagcaccgccccgccccacgcccuggaguccagcaccaucaagcccaccacccccguguccgagaccgagggcagcgggggcaccacgcccccgcccaacaccacccagggccccagcccgcccgaggccacccccgagcgccccgccaccacggcgaccagcacccccuccaccgacaacacgaacagcaccacccacgugaccgacaacaaccccacguccaccaucagcaccuccccgagcuccagccccuccacccccagcacgccccaggggauccaccacccggcccggaaccugcucagcgucuccagccccaagaccgccaccacccccacgcccaccuccccgggcgacaucagcuccgagaccagcucccugcacagcgccaugucccgcaccagcacgcuguacaccgcgacccagguguccaccgagaacgccaaccacagcgcgccccggcaguccgagagcuccgcccagcagaccacgaccagccccaugaccucccccgcccagccgauccucgugaugagcgcggcccccaccgccauccagaacauccaccccuccccgacgaaccgcagcaagcggaaccuggagauggagaucauccugacccucagccaggggcugaagaaguacuacggcaagauccugaagcuccugcaccugacccucgaggaggacaccgaggggcugcuggaguggugcaagcgcucccucggcagcaacugcgacgacgacuucuuccagaagcggaucgaggaguucuucaugacgggcgagggguacuucaacgagguccugcaguucaagacccuguccacccucagccccaccgagcccucccacgcccggccgcccacgguggagcccuucaagagcuacuucgccaagggcuuccuguccaucgacagcggguacuucuccgcgaagugcuacccccggcugagcaccuccggccuccagcugaucaacgugacccagcaccccgcccgcaucgccgagacccccggccccaagacgaccagccugaagaccaucaacugcaucaaccuccgggccuccgucuucaaggagcaccgcgagaucgagaucaacgugcugcugccccagaucgccgugaaccucagcaacugccacgucgugaucaacucccacgugugcgacuacagccuggacaccgacgggcccguccggcugccgcacaucuaccacgagggcacguucauccccgggaccuacaagaucgugaucgacaagaagaacaagcucaacgaccgcugcacccuggugaccaacugcgucaucaagggccgggaggugcgcaaggggcaguccgugcugcggcaguacaagacggagaucaagaucggcaaggcgagcaccggcagccgcaagcuccuguccgaggagcccggggacgacugcaucagccggacccagcugcuccgcgccgagcccgccgagauccacgacgacaacuacggcgggccgggcgacaagaucaccaucugcaacggguccacgaucgucgaccagcggcugggcagcgagcugggcugcuacaccaucaaccgcgugaaguccuucaagcucugcgagaacagcgccaccgggaagaccugcgagaucgacuccacgcccgugaagugccgccagggcuucugccugaagaucacccaggaggggcggggccacgucaagcugagccgcggguccgaggugguccuggacgccugcgacagcuccugcgaggugaugauccccaagggcaccggcgacauccucguggacugcagcgggggccagcagcacuuccugaaggacaaccugaucgaccucgggugcccccacaucccgcugcugggcaagauggcgaucuacaucugccggauguccaaccacccccgcaccacgauggccuuccucuucugguucagcuucggcuacgucaucacgugcaucuucugcaaggcccuguucuacucccugaucaucaucgggacccucggcaagaagaucaagcaguaccgggagcugaagccccagaccugcaccaucugcgagacggcccccgugaacgcgaucgacgccgagaugcacgaccugaacugcagcuacaacaucugcccguacugcgccucccgccucaccagcgacgggcuggcccggcacgugccccagugccccaagcgcaaggagaaggucgaggagaccgagcuguaccucaaccuggagcggaucccguggaacgugcgcaagcugcuccagguguccgagagcaccggcgucgcccugaagcggagcuccuggcugaucgugcuccuggugcugcucacggucagccugucccccgugcagagcgcgcccguggggcacggcaagaccaucgagaccuaccagacccgcgagggcuucacguccaucugccuguucaugcucgggagcauccuguuccuggucuccugccucgugaagggccugguggacagcgucuccgacagcuucuuccccgggcuguccgugugcaagaccugcagcaucggcuccaucaacggguucgagaucgagagccacaagugcuacugcucccucuucugcugcccguacugccggcacugcagcgccgaccgcgagauccaccagcugcaccuguccaucugcaagaagcggaagaugggcagcaacgugaugcucgccgucugcaagcgcaugugcuuccgggccaccaucgaggccucccgccgggcgcugcugauccgcagcaucaucaacaccacguucgugaucugcauccucacccugaccaucugcguggucagcaccuccgccguggagauggagaaccugcccagcggcacgugggagcgcgaggaggaccucaccaacuucugccaccaggagugccaggugaccgagaccgagugccugugccccuacgaggcccugguccuccggaagccccuguuccuggacuccaucgugaaggggaugaagaaccuccugaacagcacgaaccuggagaccucccucagcaucgaggccccguggggcgccaucaacgugcaguccaccuucaagcccaccgucagcacggcgaacaucgcccuguccuggagcuccguggagcaccgcgggaacaagauccuggugaccggccggagcgaguccaucaugaagcucgaggagcgcaccggggucagcugggaccugggcguggaggacgccuccgagagcaagcugcucaccguguccaucauggaccugagccagauguacucccccgucuucgaguaccugagcggcgaccgccagguggaggaguggcccaaggccacgugcaccggggacugcccggagcgcugcggcugcaccagcagcacgugccuccacaaggaguggccccacagccggaacuggcgcugcaaccccaccuggugcugggagguggggaccggcugcacgugcugcggguggaacgucaaggaccuguucaccgaccacauguucgugaaguggaagguggaguacaucaagacggaggcgaucgucugcguggagcugaccucccaggagcggcagugcagccucaucgaggccggcacccgcuucaaccugggccccgugaccaucacccuguccgagccgcggaacauccagcagaagcugccgcccgagaucaucacgcugcaccccaaggucgaggagggguucuucgaccugaugcacgugcagaaggugcucagcgccuccaccgucugcaagcugcagagcugcacccacggcaucccgggggaccuccagguguaccacaucggcaaccuccugaagggcgaccgcgugaacgggcaccugauccacaagaucgagccccacuucaacaccuccuggaugagcugggacggcugcgaccucgacuacuacugcaacaugggggacuggcccuccugcacguacaccggcaugacccagcacaaccacgccgccuucgucaaccugcugaacaucgagaccgacuacacgaagaccuuccacuuccacagcaagcgggugaccgcgcacggggacacgccccagcucgaccugaaggcccgcccgacguacggcgccggcgagaucaccguccugguggagguggccgacauggagcuccacaccaagaaggucgagaucuccgggcugaaguucgccagccuggcgugcaccggcugcuacgccugcuccagcgggaucuccugcaaggugcggauccacguggacgagcccgacgagcucacgguccacgugaaguccaacgaccccgacgugaucgccgccuccaccagccugauggcccgcaagcuggaguucggcaccgacagcaccuucaaggcguucuccgccaugcccaagacgagccucugcuucuacaucgccgagcgggaguacugcaaguccugcagcgaggaggacacccagaagugcgucgacaccaagcuggagcagccgcaguccauccugaucgagcacaaggggaccaucaucggcaagcagaacgacacgugcaccgccaaggcgagcugcuggcucgaguccgugaaguccuucuucuacggccugaagaacaugcugggguccguguucggcaacuucuucaucgggauccuccuguuccuggcccccuucguccugcucgugcuguucuucauguucggcuggaagauccuguucugcuucaagugcugccgccggacccgcgggcuccugaaguaccggcugcucaaggacgacgaggagaccggcuaccgccgcaucaucgagcggcugaacaacaagaagggcaagaaccgccugcucgacggggagcggcuggccgaccgcaagaucgccgagcuguucagcacgaagacccacaucggcuga

SEQ ID NO: 12077 - RNA, 5055 nt, Artificial Sequence
  derived and/or modified CDS sequence (opt1) from CCHFV__KJ648916.1__GP
augcacaucagccugauguacgccauccucugccugcagcugugcggccucggggagacccacggcucccacaacgagacccgccacaacaagacggacaccaugaccacccccggggacaacccgagcuccgagccccccgugagcacggcccuguccaucacccuggaccccagcaccgucaccccgacgacccccgcguccggccucgaggggagcggcgagguguacaccuccccccccaucaccacgggcagccugccgcuguccgagaccacccccgagcuccccgugaccacggggaccgacacccugagcgccggcgacgucgaccccuccacccagacggccgggggcaccagcgccccgaccgugcggaccucccugcccaacagccccuccacgcccagcaccccgcaggacacccaccaccccgugcgcaaccuccuguccgucaccagccccgggcccgacgagacgagcaccccguccggcaccggcaaggagagcuccgccaccagcuccccccaccccgugagcaaccggcccccgacgccccccgcgaccgcccaggggcccaccgagaacgacucccacaacgccaccgagcacccggagagccugacgcaguccgccacccccggccucaugaccagccccacccagaucgugcacccgcaguccgcgacccccaucacgguccaggacacccaccccagccccaccaacgccuccaaggccaaccugaagauggagaucauccugacccucagccaggggcugaagaaguacuacggcaagauccugcgccuccugcagcugacgcucgaggaggacaccgagggccugcuggaguggugcaagcggaaccucgggcuggacugcgacgacaccuucuuccagaagcgcaucgaggaguucuucaucaccggcgaggggcacuucaacgaggugcugcaguuccggacgccgggcacccucuccaccaccgagagcacgcccgccgggcugcccaccgccgagcccuucaaguccuacuucgcgaagggcuuccugagcaucgacuccggcuacuacagcgccaagugcuacagcgggaccuccaacagcggccuccagcugaucaacaucacccgccacuccacgcggaucguggacaccccggggcccaagaucaccaaccugaagaccaucaacugcaucaaccucaaggccagcaucuucaaggagcaccgcgaggucgagaucaacgugcugcugccccagguggccgucaaccucuccaacugccacguggugaucaagagccacgucugcgacuacucccuggacaucgacggcgccgugcggcugccccacaucuaccacgaggggguguucaucccgggcacguacaagaucgucaucgacaagaagaacaagcucaacgaccgcugcacccuguucaccgacugcgugaucaagggccgggaggugcgcaaggggcagagcguccugcggcaguacaagaccgagauccgcaucggcaaggcguccacggggagccggcgccuccuguccgaggagcccagcgacgacugcaucucccggacccagcugcuccgcaccgagaccgccgagauccacggcgacaacuacgggggccccggcgacaagaucacgaucugcaacgggagcaccaucguggaccagcggcugggcuccgagcuggggugcuacaccaucaaccgcguccgcagcuucaagcugugcgagaacuccgccaccggcaagaacugcgagaucgacagcgugcccgugaagugccggcagggcuacugccuccgcaucacgcaggaggggcggggccacgucaagcugagccgcggguccgagguggugcuggacgccugcgacaccagcugcgagaucaugaucccgaagggcaccggggacauccucgucgacugcuccggcggccagcagcacuuccugaaggacaaccugaucgaccucgggugccccaagaucccccugcugggcaagauggccaucuacaucugccggaugagcaaccaccccaagaccacgauggcguuccucuucugguucuccuucggguacgugaucaccugcauccugugcaaggccaucuucuaccugcucaucaucgugggcacccuggggaagcgccugaagcaguaccgggagcucaagccgcagaccugcaccaucugcgagacgacccccgucaacgccaucgacgccgagaugcacgaccugaacugcagcuacaacaucugccccuacugcgccucccgccugaccagcgacggccucgcgcggcacgugauccagugccccaagcgcaaggagaagguggaggagaccgagcuguaccugaaccucgagcggaucccgugggucgugcgcaagcugcugcagguguccgagagcacgggcgucgcccucaagcgguccagcuggcugaucgugcugcucgugcuguucaccgucucccugagccccgugcaguccgcccccaucgggcagggcaagaccaucgaggccuaccgcgcgcgggagggguacaccagcaucugccucuucgugcugggcuccauccuguucaucgucagcugccucaugaaggggcugguggacuccgugggcaacagcuucuucccgggccugagcaucugcaagacgugcuccaucagcuccaucaacggguucgagaucgagagccacaagugcuacugcucccucuucugcugccccuacugccgccacugcagcaccgacaaggagauccacaagcugcaccuguccaucugcaagaagcggaagaagggcagcaacgucaugcucgccgugugcaagcugaugugcuuccgcgccaccauggagguguccaaccgggcccuguucauccgcagcaucaucaacaccacguucguccucugcauccugauccuggccgugugcguggucuccaccagcgcgguggagauggagaaccuccccgccgggaccugggagcgcgaggaggaccugaccaacuucugccaccaggagugccaggugacggagaccgagugccugugccccuacgaggcccucguccugcggaagccgcuguuccucgacuccaccgccaagggcaugaagaaccugcugaacagcaccucccucgagacgagccuguccaucgaggcccccuggggggcgaucaacgugcagagcaccuacaagcccaccguguccaccgccaacaucgcccugagcuggagcuccgucgagcaccgcggcaacaagauccucgugagcggccgguccgagagcaucaugaagcuggaggagcgcacggggaucuccugggaccugggcguggaggacgccagcgaguccaagcuccugaccgucagcgugauggaccugucccagauguacagccccguguucgaguaccucuccggggaccggcaggucggcgaguggccgaaggccaccugcaccggcgacugccccgagcgcugcgggugcacgagcuccaccugccugcacaaggaguggccccacagccggaacuggcgcugcaaccccaccuggugcuggggcguggggaccggcugcacgugcugcgggcuggacgugaaggaccucuucaccgacuacauguucgucaaguggaagguggaguacaucaagaccgaggcgaucgugugcgucgagcugaccucccaggagcggcagugcagccugaucgaggccggcacgcgcuucaaccucggcccggugaccaucacccuguccgagccccggaacauccagcagaagcugccccccgagaucaucacccuccacccgcgcaucgaggagggguucuucgaccugaugcacgugcagaagguccugagcgccuccaccgugugcaagcuccagagcugcacgcacggcguccccggggaccugcagguguaccacaucggcaaccugcucaagggggacaaggugaacggccaccugauccacaagaucgagccccacuucaacaccagcuggauguccugggacggcugcgaccuggacuacuacugcaacaugggggacuggcccagcugcaccuacaccggcgucacgcagcacaaccacgccuccuucgugaaccuccugaacaucgagaccgacuacaccaagaacuuccacuuccacagcaagcgggugaccgcgcacggggacacgccgcagcuggaccucaaggcccgccccaccuacggcgccggggagaucaccguccugguggagguggccgacauggagcugcacaccaagaagaucgagaucuccggccucaaguucgccagccuggcgugcacgggcugcuacgccugcuccagcgggaucuccugcaagguccggauccacguggacgagcccgacgagcugaccgugcacgucaagagcgacgaccccgacgugguggccgccuccagcucccucauggcccgcaagcuggaguucggcaccgacagcaccuucaaggcguucuccgccaugccgaagacgagccugugcuucuacaucgucgagcgggagcacugcaaguccugcagcgaggaggacaccaagaagugcgugaacaccaagcucgagcagccccaguccauccugaucgagcacaaggggaccaucaucggcaagcagaacagcacgugcaccgccaaggccagcugcuggcuggaguccgugaagagcuucuucuacggccugaagaacaugcucuccgggaucuucggcaacgucuucauggggaucuuccuguuccuggcccccuucauccuccugauccuguucuucauguucggcuggcgcauccucuucugcuucaagugcugccggcgcacccgggggcuguucaaguaccgccaccugaaggacgacgaggagaccggcuaccgccggaucaucgagaagcucaacaacaagaagggcaagaacaagcugcuggacggggagcgccucgcggaccggcgcaucgccgagcuguucagcacgaagacccacaucggcuga

SEQ ID NO: 12078 - RNA, 3495 nt, Artificial Sequence
  derived and/or modified CDS sequence (opt1) from CCHVF(CCHVF 10200)__U39455.2__Gn-NSm-Gc
agcgaggagcccuccgacgacugcgugagccgcacccagcugcuccggaccgagacggccgagauccacggcgacaacuacgggggcccgggggacaagaucaccaucugcaacggcuccaccaucgucgaccagcgccuggggagcgagcugggcugcuacaccaucaaccgggugcgcuccuucaagcucugcgagaacagcgccacgggcaagaacugcgagaucgacuccgugcccgucaagugccggcagggguacugccugcgcaucacccaggagggccgggggcacgugaagcugagccgcggcuccgaggugguccucgacgcgugcgacaccagcugcgagaucaugauccccaaggggaccggcgacauccugguggacugcuccggcgggcagcagcacuuccugaaggacaaccucaucgaccugggcugccccaagaucccgcugcucgggaagauggccaucuacaucugccggaugagcaaccaccccaagacgaccauggccuuccuguucugguucuccuucggcuacgugaucacgugcauccugugcaaggccaucuucuaccuccugaucaucgucggcacccuggggcgccggcucaagcaguaccgcgagcugaagccccagaccugcaccaucugcgagaccacccccgugaacgccaucgacgcggagaugcacgaccugaacugcagcuacaacaucugcccguacugcgccucccggcucacgagcgacggccuggcccgccacgugauccagugccccaagcggaaggagaaggucgaggagaccgagcuguaccucaaccuggagcgcauccccuggguggugcggaagcugcuccaggucuccgagagcaccgggguggcccugaagcgcuccagcuggcugaucgugcuccugguccuguucaccgugagccucucccccgugcagagcgcgccgaucggccaggggaagacgaucgaggccuaccgggcccgcgagggcuacaccuccaucugccuguucguccugggcagcauccucuucaucguguccugccugaugaaggggcugguggacagcgucggcaacuccuucuuccccgggcucagcaucugcaagaccugcuccaucagcuccaucaacggcuucgagaucgagagccacaagugcuacugcucccuguucugcugccccuacugccggcacugcagcaccgacaaggagauccacaagcugcaccucuccaucugcaagaagcgcaagacggggagcaacgugaugcuggccgucugcaagcugaugugcuuccgcgccaccauggagguguccaaccgggcgcuguucauccgcagcaucaucaacaccaccuucgugcugugcauccugauccucgccgucugcgugguguccacgagcgccgucgagauggagaaccugcccgccggcaccugggagcgggaggaggaccugaccaacuucugccaccaggagugccaggugaccgagacggagugccugugcccguacgaggcccucgugcugcgcaagccccuguuccucgacagcaccgcgaagggcaugaagaaccugcugaacuccaccagccucgagaccucccugagcaucgaggcccccuggggcgccaucaacguccaguccacguacaagcccaccgugagcaccgccaacaucgcccuguccuggagcuccguggagcaccgggggaacaagauccucgucagcgggcgcuccgagagcaucaugaagcuggaggagcggaccggcaucuccugggaccuggggguggaggacgcgagcgaguccaagcuccugaccgugagcgucauggaccugucccagauguacagcccgguguucgaguaccucagcggcgaccgccagguggaggaguggcccaaggccacgugcaccggcgacugccccgagcggugcgggugcaccuccagcacgugccugcacaaggaguggccccacucccgcaacuggcggugcaacccgaccuggugcuggggcgucgggaccggcugcacgugcugcggccuggacgugaaggaccucuucaccgacuacauguucgugaaguggaaggucgaguacaucaagaccgaggccaucgugugcguggagcugaccagccaggagcgccagugcucccugaucgaggccgggacccgguucaaccucggccccgucaccaucacgcugagcgagccccgcaacauccagcagaagcugcccccggagaucaucacccuccacccccggaucgaggagggguucuucgaccugaugcacgugcagaaggugcuguccgccagcaccgucugcaagcuccaguccugcacccacggcgugcccggggaccuccagguguaccacaucggcaaccugcucaagggcgacaaggucaacgggcaccugauccacaagaucgagccgcacuucaacacgagcuggauguccugggacggcugcgaccuggacuacuacugcaacaugggggacuggcccagcugcaccuacaccggcgugacccagcacaaccacgcguccuucgugaaccuccugaacaucgagacggacuacaccaagaacuuccacuuccacagcaagcgcgucaccgcccacggggacacgccccagcuggaccucaaggcccggcccaccuacggcgccggcgagaucaccgugcugguggaggucgcggacauggagcugcacaccaagaagaucgagaucuccgggcucaaguucgccagccuggccugcaccggcugcuacgccugcuccagcuccaucagcugcaaggugcgcauccacguggacgagccggacgagcugacgguccacgucaagagcgacgaccccgacgugguggccgcguccagcucccucauggcccggaagcuggaguucgggaccgacagcaccuucaaggccuucuccgccaugcccaagaccagccugugcuucuacaucguggagcgcgagcacugcaaguccugcagcgaggaggacacgaagaagugcgugaacaccaagcucgagcagccccaguccauccugaucgagcacaagggcaccaucaucgggaagcagaacagcacgugcaccgccaaggcguccugcuggcuggagagcgucaaguccuucuucuacggccucaagaacaugcugagcggcaucuucgggaacguguucaugggcaucuuccuguuccucgccccguucauccugcugauccucuucuucauguucggguggcgcauccuguucugcuucaagugcugccggcgcacccggggccuguucaaguaccgccaccucaaggacgacgaggagaccggguaccggcgcaucaucgagaagcugaacaacaagaagggcaagaacaagcugcucgacggcgagcggcuggccgacgggcgcaucgccgagcuguucuccaccaagacccacaucggc

SEQ ID NO: 12079 - RNA, 3495 nt, Artificial Sequence
  derived and/or modified CDS sequence (opt1) from CCHVF(CCHVF IbAr10200)__AF467768.2__Gn-NSm-Gc
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccggguccgcuccuucaagcucugcgagaacagcgccacgggcaagaacugcgagaucgacuccgugcccgugaagugccggcagggguacugccugcgcaucacccaggagggccgggggcacgucaagcugagccgcggcuccgagguggugcucgacgcgugcgacaccagcugcgagaucaugauccccaaggggaccggcgacauccuggucgacugcuccggcgggcagcagcacuuccugaaggacaaccucaucgaccugggcugccccaagaucccgcugcucgggaagauggccaucuacaucugccggaugagcaaccaccccaagacgaccauggccuuccuguucugguucuccuucggcuacgugaucacgugcauccugugcaaggccaucuucuaccuccugaucaucgugggcacccuggggaagcgccucaagcaguaccgggagcugaagccccagaccugcaccaucugcgagaccacccccgucaacgccaucgacgcggagaugcacgaccugaacugcagcuacaacaucugcccguacugcgccucccgccucacgagcgacggccuggcccggcacgugauccagugccccaagcgcaaggagaagguggaggagaccgagcuguaccucaaccuggagcggauccccugggucgugcgcaagcugcuccagguguccgagagcaccggggucgcccugaagcgguccagcuggcugaucgugcuccuggugcuguucaccgucagccucucccccgugcagagcgcgccgaucggccaggggaagacgaucgaggccuaccgcgcccgggagggcuacaccuccaucugccuguucgugcugggcagcauccucuucaucgucuccugccugaugaaggggcugguggacagcgugggcaacuccuucuuccccgggcucagcaucugcaagaccugcuccaucagcuccaucaacggcuucgagaucgagagccacaagugcuacugcucccuguucugcugccccuacugccgccacugcagcaccgacaaggagauccacaagcugcaccucuccaucugcaagaagcggaagaaggggagcaacgucaugcuggccgugugcaagcugaugugcuuccgcgccacgauggaggucuccaaccgcgcccucuucauccggagcaucaucaacaccaccuucgugcugugcauccugauccucgccgugugcgucguguccaccagcgccguggagauggagaaccugcccgccggcacgugggagcgcgaggaggaccugaccaacuucugccaccaggagugccaggucaccgagaccgagugccugugcccguacgaggcccucgugcugcggaagccccuguuccucgacagcacggcgaagggcaugaagaaccugcugaacuccaccagccucgagaccucccugagcaucgaggcccccuggggcgccaucaacgugcaguccaccuacaagcccacggucagcaccgccaacaucgcccuguccuggagcuccguggagcaccgcgggaacaagauccucgugagcgggcgguccgagagcaucaugaagcuggaggagcgcaccggcaucuccugggaccugggggucgaggacgcgagcgaguccaagcuccugaccgugagcgugauggaccugucccagauguacagcccggucuucgaguaccucagcggcgaccgccaggugggcgaguggcccaaggcgaccugcacgggggacugccccgagcggugcggcugcaccuccagcacgugccugcacaaggaguggccccacucccggaacuggcgcugcaacccgaccuggugcuggggcguggggaccggcugcacgugcugcgggcuggacgucaaggaccucuucaccgacuacauguucgugaaguggaagguggaguacaucaagaccgaggccaucgucugcguggagcugaccagccaggagcggcagugcucccugaucgaggccggcacccgcuucaaccucgggcccgugaccaucacccugagcgagccccggaacauccagcagaagcugcccccggagaucaucacgcuccacccccgcaucgaggagggcuucuucgaccugaugcacguccagaaggugcuguccgccagcaccgugugcaagcuccaguccugcacccacgggguccccggcgaccuccagguguaccacaucggcaaccugcugaagggggacaaggugaacggccaccugauccacaagaucgagccgcacuucaacaccagcuggauguccugggacgggugcgaccuggacuacuacugcaacaugggcgacuggcccagcugcacguacaccggggucacccagcacaaccacgcguccuucgugaaccuccugaacaucgagaccgacuacacgaagaacuuccacuuccacagcaagcgggugaccgcccacggcgacacgccccagcuggaccucaaggcccgccccaccuacggcgccggggagaucaccguccugguggagguggcggacauggagcugcacaccaagaagaucgagaucuccggccucaaguucgccagccuggccugcaccgggugcuacgccugcuccagcggcaucuccugcaagguccggauccacguggacgagccggacgagcugaccgugcacgucaagagcgacgaccccgacgugguggccgcgagcuccagccucauggcccgcaagcuggaguucgggacggacuccaccuucaaggccuucagcgccaugcccaagaccucccugugcuucuacaucgucgagcgggagcacugcaagagcugcuccgaggaggacaccaagaagugcgugaacacgaagcucgagcagccccagagcauccugaucgagcacaagggcaccaucaucggcaagcagaacuccacgugcaccgccaaggcgagcugcuggcuggaguccgucaagagcuucuucuacgggcucaagaacaugcuguccggcaucuucgggaacguguucaugggcaucuuccuguuccucgccccguucauccugcugauccucuucuucauguucggguggcgcauccuguucugcuucaagugcugccgccggacccgcggccuguucaaguaccggcaccucaaggacgacgaggagaccggcuaccgccggaucaucgagaagcugaacaacaagaaggggaagaacaagcugcucgacggcgagcgccuggccgaccggcgcaucgccgagcuguucagcaccaagacccacaucggg

SEQ ID NO: 12080 - RNA, 3495 nt, Artificial Sequence
  derived and/or modified CDS sequence (opt1) from CCHVF(CCHVF Turkey-Kelkit06)__GQ337054.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcaagaacuccgccacgggcaagaccugcgagguggacagcacccccgugaagugccgccagggguucugccugaagaucacccaggagggccgggggcacgucaagcugucccgcggcagcgagguggugcucgacgcgugcgacuccagcugcgaggucaugauccccaaggggacgggcgacauccugguggacugcuccggcgggcagcagcacuuccugaaggacaaccucaucgaccugggcugcccccacaucccgcugcucgggcggauggccaucuacaucugccgcaugagcaaccacccccggaccaccauggccuuccuguucugguucuccuucggcuacgugaucaccugcaucuucugcaaggcccuguucuacagccucaucaucaucggcacgcuggggaagaagaucaagcaguaccgcgagcugaagccccagaccugcaccaucugcgagaccgcccccgucaacgcgaucgacgccgagaugcacgaccucaacugcuccuacaacaucugcccguacugcgccagccggcugacguccgacggccuggcccgccacgugacccagugccccaagcggaaggagaagguggaggagaccgagcucuaccugaaccuggagcgcauccccuggaucguccggaagcuccugcaggugagcgaguccaccgggguggcgcugaagcgcagcagcuggcucaucguccugcuggugcuccugacggugucccugagccccguccaguccgccccggugggccacgggaagaccaucgagaucuaccagacccgggagggcuucgccagcaucugccucuucaugcugggcuccauccuguucaucgugagcugccucgucaaggggcugguggacuccgugagcgaguccuucuuccccggccugagcgucugcaagaccugcuccaucgggagcgugaacggcuucgagaucgagucccacaagugcuacugcagccucuucugcugccccuacugccgccacugcuccgccgaccgggagauccaccagcugcaccugagcaucugcaagaagcgcaagacgggguccaacgucaugcucgccgugugcaagcggaugugcuuccgcgcgaccaucgaggccagccgccgggcccugcugauccgcuccaucaucaacaccaccuucgugaucugcauccucacgcugaccaucugcgucgugagcaccagcgccguggagauggagaaccugcccgccggcaccugggagcgggaggaggaccucacgaacuucugccaccaggagugccaggucaccgagaccgagugccugugcccguacgaggcgcuggugcugcgcaagccccucuuccuggacuccaucgugaagggcaugaagaaccugcucaacagcaccucccuggagacgagccuguccaucgaggcccccuggggggccaucaacguccagagcaccuucaagcccaccguguccaccgccaacaucgcccucagcugguccagcgugguccaccggggcaacaagauccuggugaccgggcgcuccgagagcaucaugaagcuggaggagcggacgggcguguccugggaccucggggucgaggacgcgagcgaguccaagcugcugaccgugagcaucauggaccucucccagauguacagcccgguguucgaguaccugagcggcgaccgccaggucgaggaguggcccaaggccaccugcaccggcgacugccccgagcggugcgggugcacguccagcaccugccugcacaaggaguggucccacagccgcaacuggcggugcaaccccaccuggugcuggggcguggggaccggcugcacgugcugcggcguggacgucaaggaccucuucaccgaccacauguucgugaaguggaagguggaguacaucaagaccgaggccaucgucugcguggcccugaccucccaggagcgccagugcagccugaucgaggccgggacgcgguucaaccucggcccggugaccaucacccuguccgagccccgcaacauccagcagaagcugccccccgagaucaucacccuccacccgaagaucgaggagggguucuucgaccugaugcacguccagaaggugcugagcgcguccacggugugcaagcuccagagcugcacccacggcauccccggggaccugcaggucuaccacaucggcaaccugcucaagggcgaccgggugaacgggcaccugauccacaagaucgagucccacuucaacaccagcuggauguccugggacggcugcgaccuggacuacuacugcaacaugggggacuggcccagcugcaccuacacgggcgugacccagcacaaccacgccgccuucgucaaccuccugaacaucgagaccgacuacaccaagacguuccacuuccacuccaagcgcgugaccgcccacggggacaccccgcagcuggaccucaaggcgcggcccaccuacggcgccggcgggaucacggugcuggucgagguggccgacauggagcugcacaccaagaagguggagaucagcggccucaaguucgccucccuggccugcaccgggugcuacgcgugcagcuccggcaucagcugcaagguccgcauccacguggacgagcccgacgagcugaccgugcacgucaagagcuccgaccccgacgugguggccgccagcacgucccucauggcccggaagcuggaguucgggaccgacagcaccuucaaggccuucuccgcgaugccgaagaccagccugugcuucuacaucgucgagcgcgaguacugcaaguccugcagcgaggacgacacgcagaagugcguggacacccgccucgagcagccccaguccauccugaucgagcacaagggcaccaucaucggcaagcagaacgacaccugcaccgccaaggccagcugcuggcuggaguccgugaagagcuucuucuacgggcucaagaacaugcugggcuccgucuucgggaaccuguucaucggcauccuccuguuccuggcccccuucgugcuccuggugcuguucuucauguucggguggaagauccucuucugcuucaagugcugccggcgcacgcggggccuguucaaguaccgccaccugaaggacgacgaggagaccggcuaccggcgcaucaucgagcggcucaacagcaagaaggggaagaaccgccugcuggacggcgaccggcucgccgaccgcaagaucgcggagcuguucuccaccaagacccacaucggg

SEQ ID NO: 12081 - RNA, 3498 nt, Artificial Sequence
  derived and/or modified CDS sequence (opt1) from CCHVF(CCHVF SR3)__AJ538199.1__Gn-NSm-Gc
agcgaggaguccggcgacgacugcaucagccgcacccagcuccuccggaccgagacggccgaggugcacggggacaacuacggcgggcccggcgacaagaucaccaucugcaacggguccaccgucguggaccagcgccugggcagcgagcugggcugcuacaccaucaaccgggugcgcuccuucaagcucugcgagaacagcgccacggggaaguccugcgagaucgacagcaucccggucaagugcaagcagggcuacugccugaagaucacccaggaggggcggggccacgugaagcugucccgcgggagcgaggugguccucgacgugugcgacuccagcugcgaggugaugauccccaagggcaccggcgacauccuggucgacugcuccgggggccagcagcacuuccugaaggacaaccucguggaccuggggugccccaagaucccccugcucggcaagauggcgaucuacaucugccggaugagcaaccacccgaagaccacgauggccuuccuguucugguucuccuucggcuacgugaucacgugcauccugugcaaggccaucuucuuccuccugaucaucuucgggacccugggcaagcgcuucaagcaguaccgggagcucaagccccagaccugcaccaucugcgagaccacccccgucaacgccaucgacgccgagaugcacgaccugaacugcagcuacaacaucugccccuacugcgcgucccgccugaccagcgacgggcucgcccggcacgugacgcagugcccgcgccggaaggagaagguggaggagaccgagcuguaccugaaccucgagcgcauccccugggucgugcggaagcugcuccagguguccgagagcaccggcaccguccucaagcgcagcuccuggcugaucgugcugcucgugcuguucacggucagccugucccccgugcagagcgcccccaucgggcacggcaagaccaucgagaccuaccgggugcgcgaggaguacaccuccaucugccucuucguccugggcagcauccuguucaucguguccuuccucaugaaggggcuggucgacggcguggggaacaucuucuucccgggccugagcgugugcaagacgugcuccaucgggagcaucaacggcuucgagaucgagucccacaagugcuacugcagccucuucugcugccccuacugccggcacugcuccgccgacggcgagauccaccagcugcaccugagcaucugcaagaagcgcaagaccggguccaacgucaugcucgcggugugcaagcggaugugcuuccgcgccaccauggaggugagcaacaaggcccuguucauccgcuccaucaucaacaccacguucgucaugugcauccugaagggcgaguucgccgccgucaagagcauccaccccaucgagauggagucccuccccgcggggaccugggagcgggaggaggaccugaccaacuucugccaccaggagugccaggugaccgagacggagugccugugcccguacgaggcccucgugcugcgccggccccuguuccuggacagcaucgugaagggcaugaagaaccuccugaacagcaccucccuggagaccagccucuccaucgaggcccccuggggcgccaucaacgugcagagcaccuacaagcccacggucuccaccgccaacaucgcgcugagcugguccagcguggagcaccgcgggaacaaggugcuggucuccggccggagcgaguccaucaugaagcucgaggagcgcaccgggaucagcugggaccugggcguggaggacgccuccgagagcaagcugcucaccguguccgucauggaccugagccagauguacuccccgguguucgaguaccugagcggggaccgccagguggaggaguggcccaaggcgaccugcacgggcgacugccccgagcggugcggcugcaccagcuccacgugccuccacaaggaguggccccacagccggaacuggcgcugcaacccgaccuggugcuggggcgucgggaccgggugcacgugcugcggccuggacgugaaggaccuguucaccgacuacauguucgugaaguggaaggucgaguacaucaagaccgaggccaucgugugcguggagcucaccucccaggagcggcagugcagccugaucgaggccgggacccgcuucaaccugggcuccgucaccaucacccucagcgagccccggaacauccagcagaagcugccgcccgagaucaucacgcugcaccccaagaucgaggagggcuucuucgaccucaugcacgugcagaaggugcuguccgccagcaccgucugcaagcugcaguccugcacccacggggugcccggcgaccuccagguguaccacaucgggaaccugcugaagggcgaccgcgucaacgggcaccucauccacaagaucgagcagcacuucaacaccagcuggauguccugggacggcugcgaccuggacuacuacugcaacaugggcgacuggcccagcugcacguacaccggggugacccagcacaaccacgccuccuucgugaaccugcucaacaucgagaccgacuacacgaagaccuuccacuuccacagcaagcgggucaccgcccacggcgacaccccgcagcuggaccugaaggcccgccccacguacggggccggcgagaucaccgugcucguggaggucgcggacauggagcugcacaccaagaagaucgagaucuccgggcugaaguucgccggccugaccugcacgggcugcuacgccugcagcuccgggaucagcugcaaggugcggauccacguggacgagcccgacgagcugaccguccacgugaaguccgacgaccccgacguggucgccgcgagcagcucccugauggcccgcaagcucgaguucggcaccgacagcaccuucaaggccuucuccgccaugccgaagacgagccugugcuucuacaucguggagcgggaguacugcaaguccugcaacaaggaggacacccagaagugcgugaacaccaagcuggagcagccccagagcauccucaucgagcacaaggggaccaucaucggcaagcagaacaacacgugcaccgccaaggcguccugcuggcuggagagcgucaaguccuucuucuacgggcugaagaacaugcucggcggcaucuucgggaacguguucaucggcaucuucaccuuccugacccccuucauccugcucauccuguucuucauguucggguggcgcauccuguucugcuucaagugcugccgccggacccgcggccucuucaaguaccggcaccugaaggacgacgaggagacgggcuaccgcaagaucaucgagcggcugaacaacaagaaggggaagaaccgccuccuggacggcgagcggcuggccgaccgcaagaucgccgagcuguucagcaccaagacccacaucggg

SEQ ID NO: 12082 - RNA, 3498 nt, Artificial Sequence
  derived and/or modified CDS sequence (opt1) from CCHVF(CCHVF UCCR4413)__KY484038.1__Gn-NSm-Gc
agcgaguccagcgccuccggcugcaucagccgcacccagaugaucaaguccgagaccgccgagauccacgacgacaucuacgggggccccggggagaagcugacgaucugcaacggcaccaccguggucgaccagcggcucgggagcgagcugggcugcuacaccaucaaccgcaucaagacguacaagcugugcgagaacuccgugaaggagaagaccugcgagaucgacagcgugccggucaagugccggcagggccucugccugaagaucacccaggaggggcgcggccacgugaagcugucccgggggagcgagaucgugcucgacaucugcgacuccagcugcgagcugaugauccccaagggcaccggggacauccuggucgacugcuccggcggccagcagcacuuccuccaggacaaccugguggaccuggggugccccaacaucccccuccugggcaagguggcgaucuacaucugccgcaugagcaaccacccgaagacgaccauggccuuccuguucugguucuccuucggguacgucaucaccugcauccucugcaagauccuguucuaccugcucaucaucaccggcacgcugggcaagaagcugaagcaguaccgggagcucaagccccagaccugcaccaucugcgagagcacccccgugaacgccaucgacgccgagaugcacgaccugaacugcuccuacaacaucugccccuacugcgccagccgccugacguccgacgggcucauccggcacgugaaccugugcccgaagcgcaaggagaaggucgaggagaccgagcuguaccucaaccuggagcggauccccugguucgugcgcaagcugcuccaggugagcgagagcaccggcgucgcgcugaagcgguccagcuggcugcucauccuggugauccugcucaccguguccaugagccccguccaguccgcccccaucaaccagcagcgcgccguggaggccuaccaggcgcgggagggguacacgggcaucugccuguucauccuggggagcgugcucuucaugaccuccuggcugaccaagggccugaucgacagcaucggcgacuccuucuucccggggcucuucgucugcaagaccugcagcaucggcuccaucaacggguucgagaucgagagccaccgcugcuacugcucccugcugugcugccccuacugccggacgugcagcgccgacaaggacucccaccagcuccaccugagcaucugcaagaagaagaaggccggcuccaacgugaugcuggccgugugcaagcgcaugugcuucaaggccaccaucgaggcgagcaaccggguccuccugauccgcuccaucaucaacaccaccuucaucaucugcaugcugauccugguggucugcgugaucagcacgagcgccguggagauggaggaccuccccgccgggaccugggagcgggaggaggaccugaccaacuucugccaccaggagugccaggucaccgagacggagugccugugccccuacgaggccuucgugcuccgcaagccgcuguuccuguccagcaucgugaagggcaagaagaaccuccugaacuccgccagccuggagaccucccucagcaucgaggcgcccuggggcgccaucaacgcccaguccaccuucaagcccaccaucagcacggccaacaucgcccuguccuggagcuccgucgagcaccgcgggaacaaggugcuggugagcggccgguccgagagcaucaugaagcucgaggagcgcaccgggaucuccuggaaccugggcgucgaggacgcgagcgagucccggaugcugaccgugagcgugauggaccucagccagauguaccugcccgucuucgaguaccuguccggggaccgccagguggaggaguggccgaaggccaccugcaccggcgacugccccgagcggugcggcugcacgagcuccaccugccuccacaaggaguggccccacagccgcaacuggcggugcaaccccaccuggugcuggggggugggcaccgggugcacgugcugcggccuggacgucaaggaccuguucaccgacuacauguucgugaaguggaagguggaguacaucaagaccgaggccaucgucugcguggagcucaccucccaggagcgccagugcagccugaucgaggccggcacgcgguucaaccuggggccggugaccaucacccucuccgagccccgcaacauccagcagaagcugcccagcgagaucgucacccugcaccccaagaucgaggagggcuucuucgaccucaugcacgugcagaaggugcuguccgccagcacggucugcaagcugcaguccugcacccacgggguggcgggcgaccuccagguguaccacgucgggaaccugcugaagggcgacaagaucaacggccacagcauccacaagaucgagccgcaccucaacaccuccuggaugagcugggacgggugcgaccuggacuacuacugcaacaugggcgacuggcccuccugcaccuacacgggggugacccagcacaaccacgccgccuucgugaaccugcucaacaucgagaccgacuacaccaagagcuuccacuuccacuccaagcgggucacggcccacggcgacaccccccagcuggaccugaaggcgcgcccgauguacggggccggcgagaucaccgugcucguggaggucgccgacauggagcugcacagcaagaacaucgagaucuccggccugaaguucgccagccucaccugcagcgggugcuacgccugcuccagcggcaucuccugcaaggugcggauccacguggacgagcccgacgagcuggcgguccacgugaagagcgacgaccuggacguggucgccgccuccagcucccucauggcccgcaagaucgaguucgggacggacagcaccuucaaggccuucuccagcaugcccaaggagucccugugcuucuacaucguggagcgggacuucugcaagagcugcgcggccgaggacacccagaagugcgugaaggccaagcuggagcagccccaguccauccucaucgagcacaagggcaccaucaucgggaagcagaacgacacgugcagcaccaagaccuccugcuggcuggagagcuucaaguccuucuucuacggccugaagaacaugcucagcggcgucuucggguccgccaucaugggcauccugcuguuccucgccccguucauccugcugauccucuucuucuucuucggguggcgcauccuguucugccugcggugcugccgccggacccgcggccucuucaaguacaagcacaucaaggacgacgaggaggcgggguacaagaagaucaucgagaagcugaacaacaagaagggcggcacgagcaagcugcucgacggggagcgccuggccgaccggaagaucgccgagcuguucagcaccaaggcccacaucggc

SEQ ID NO: 12083 - RNA, 3495 nt, Artificial Sequence
  derived and/or modified CDS sequence (opt1) from CCHVF(CCHVF 66019)__AB069669.1__Gn-NSm-Gc
agcgaggaguccggcgacgacugcaucagccgcacccagcugcuccggaccgagacggccgaggugcacggggacaacuacggcgggcccggcgacaagaucaccaucugcaacggguccaccaucguggaccagcgccugggcagcgagcugggcugcuacaccaucaaccgggugaaguccuucaagcucugcgagaacagcgggacgggcaaguccugcaagaucgacaacaccccggugaagugccgccagggguucugccugaagaucacccaggagggccgggggcacgucaagcugagccgcggcuccgagguggugcucgacgccugcgacagcuccugcgagaucaugauccccaagggcaccggggacauccuggucgacugcagcggcgggcagcagcacuuccugaaggacaaccucguggaccugggcugccccaacaucccccugcucggcaagauggcgaucuacaucugccggauguccaaccacccgaagacgaccauggccuuccuguucugguucagcuucggguacgugaucacgugcaucuucugcaagaucaucuucuaccugcucaucgucgugggcacccuggggaagaaguucaagcaguaccgcgagcugaagccccagaccugcaccaucugcgagaccacccccacgaacgccaucgacgccgagaugcacgaccucaagugcuccuacaacaucugccccuacugcgccagccggcugaccuccgacggccuggcgcgccacgugacccagugcccgaagcggaaggagaaggucgaggagaccgagcucuaccugaaccuggagcgcauccccuggaucgugcggaagcuccuccaggugagcgaguccacgggggucgcccugaagcgcagcagcuggcucaucgugcugcuggugcuccugaccgucucccugagccccgugcaguccgcccccaucggccacggcaagaccaucgaggccuaccagacccgggagggguacacgagcgugugccucuucaugcugggcgggauccuguucgucguguccugccucaugaagggccugguggacagcgucuccaacagcuucuucccggggcuguccaucugcaagaccugcagcaucggcuccgugaacggcuucgagaucgagagccacaagugcuacugcucccuccugugcugccuguacugccgccacugcagcgcggaccgggagauccaccagcuccaccuguccaucugcaagaagcgccgggccgggggcaacgucaugcuggccgugugcaagcgcaugugccuccgggccaccauggaggugagcaacaagguccuguucauccgcuccaucaucaacaccacguucgugaucugcauccuggugcucgccgucugcaucgugagcaccuccgcgguggagauggagagccugcccgccgggaccugggagcgcgaggaggaccugaccaacuucugccaccaggagugccaggucacggagaccgagugccugugccccuacgaggcccucgugcugcggaagccccuguucagcgacuccaucgugaagggcaugaagaaccuccugaacagcaccucccuggagaccagccucuccaucgaggccccguggggcgccaucaacguccagagcacguucaagcccaccguguccaccgcgaacaucgcccugagcugguccagcguggagcaccgcgggaacaagauccuggucuccggccggagcgaguccaucaugaagcucgaggagcgcaccgggaucagcugggaccugggcguggaggacgccuccgagagcaagcugcucaccguguccgucauggaccugagccagauguacagccccguguucgaguaccuguccggggaccgccagguggaggaguggcccaaggccacgugcaccggcaacugcccggaccggugcggcugcaccagcuccacgugccuccacaaggaguggccccacagccggaacuggcgcugcaaccccaccuggugcuggggcgucgggaccgggugcacgugcugcggccuggacgugaaggaccuguucaccgacuacauguucgugaaguggaaggucgaguacaucaagaccgaggccaucgugugcguggagcucaacucccaggagcggcagugcagccugaucgaggcggggacccgcuucaaccugggccccgucaccaucacccucuccgagccgcggaacauccagcagaagcugcccagcgagaucaucacgcugcacccccgcaucgaggagggcuucuucgaccucaugcacgugcagaaggugcuguccgccagcaccgucugcaagcugcaguccugcacccacggggugcccggcgaccuccagaucuaccacaucgggaaccugcugaagggcgaccgggugaacgggcaccucauccacaagaucgagccgcacuucaacaccagcuggauguccugggacggcugcgaccuggacuacuacugcaacaugggcgacuggcccagcugcacguacaccggggucacccagcacaaccacgccgccuucgugaaccugcucaacaucgagaccgacuacacgaagaacuuccacuuccacuccaagcgcgugaccgcccacggcgacacgccccagcuggaccugaaggcgcggccgaccuacggggccggcgagaucaccguccucguggagguggccgacauggagcugcacaccaagaagaucgccaucagcgggcugaaguucgcgucccugaccugcaccggcugcuacgccugcagcuccggcaucagcugcaagguccgcauccacguggacgagcccgacgagcugacggugcacgucaagagcgaggaccccgacaucguggccgccuccagcucccugauggcccggaagcucgaguucgggaccgacagcaccuucaaggcguucuccgccaugcccaagaccagccugugcuucuacaucguggagcgcgaguacugcgaguccugcagcaaggaggacacgcagaagugcgucaacaccaagcuggagcagccgcaguccauccucaucgagcacaagggcaccaucaucgggaagcagaacgacacgugcaccgccaaggccagcugcuggcuggaguccgucaagagcuucuucuacggccugaagaacaugcucuccgggaucuucggcaacguguucaucggcaucuuccuguuccuggcccccuucauccuccugauccuguucuucauguucggguggcggauccucuucugcuucaagugcugccgccgcacccggggccuguucaaguaccgcuaccugaaggacgacgaggagagcggguaccggcgcaucaucgagcggcucaacaacaagaagggcaagaacaagcugcuggacggcgagcgccucgcggaccggcgcaucgccgagcuguucuccaccaagacccacaucggg

SEQ ID NO: 12084 - RNA, 3495 nt, Artificial Sequence
  derived and/or modified CDS sequence (opt1) from CCHVF(CCHVF 7001)__AB069670.1__Gn-NSm-Gc
gccgagggcgggagcuccgacugcaucagccgcacccagcucgugaagaccgaggucgccgagauccacgaggacuccuacggcgggcccggcgagaagaucacgaucugcaacgggagcaccaucguggaccagcggcucggcuccgagcugggcugcuacaccaucaaccgcgugcggagcuacaagcugugcgagaacuccgcgagcgggaaguccugcgagaucgacagcaucccggucaagugcaagcagggcuucugccucaagaucacccaggaggggcgcggccacgugaagcugucccgggggacggagaucgugcuggacgucugcgacagcuccugcgagcucaugauccccaagggcaccggcgacauccugguggacugcagcgggggccagcagcacuuccugcagaacaaccucaucgaccuggggugccccaacgugccccugcucggcaagauggccaucuacgucugccgcauguccaaccacccgaagaccaccauggccuuccuguucugguucagcuucggcuacgugaucacgugcaucgccugccgggugcuguucuaccuccugaucgccaucgggaccgucggcaagaagcugaagcaguaccgcgagcucaagccccagaccugcaucgugugcgaguccgugcccgucaacgcgaucgacgccgagaugcacgagcugaacugcagcuacaacaucugccccuacugcgccucccggcugagcaccgacgggcucauccgccacgugacgcagugcccgaagcggcgcgagaagguggaggagaccgagcuguuccugaaccucgagcggauccccuggcugguccgcaagcugcuccaggugagcgaguccaccggcauggcccugaagcggagcugcuggaugaucacccugcucauccugcugcucguguccaucagccccguccaguccgcgcccguggggaaggagcgcgccaucgagacguaccaggcccgggagaccuacaccggcaucugccuguucgugcugggcagcguccucuucgccguguccuggcugaccaaggcccugaucgacgggaucggcaacagcuucuucccggggcucuccgucugcaagacgugcagcaucggcuccaucaacggguucgagaucgagagccacaagugcuacugcucccuguucugcugccccuacugccgcgcgugcagcuccgacaagaacacccaccggaugcaccugaacgugugcaagaagcgcaagaugggcagcaacgugaugcucgccgucugcaagcggaugugcuuccgcgccaccaucgaggccuccaacaaggcccugcugauccgcagcaucaucaacuccaccuucgugaucugcauccucauccugacgaucugcguggucagcaccagcgcgguggacauggagaaccugcccgccggcaucugggagaaggaggaggaccucaccaacuucugccaccaggagugccaggugaccgagacggagugccugugccccuacgaggccaugguccugcggaagccgcuguuccucgacaacaucgccaaggggaugaagucccugcugaacagcaccucccucgagaccagccuguccaucgaggcccccuggggcgcgaucaacgugcagagcaccuucaagcccacgguguccgccgccaacaucgcccugagcugguccagcgucgagcaccgcgggaacaagauccucguguccggccggagcgaguccaucaugaagcuggaggagcgcaccggggugagcuggaaccugggcgucgaggacgccuccgagagcaagacccucaccguguccgugauggaccugagccagauguacagccccgucuucgaguaccuguccggcgaccgccagguggaggaguggccgaaggcgacgugcaccggggacugccccgagcggugcggcugcaccagcuccacgugccuccacaaggaguggccccacagccggaacuggcgcugcaaccccaccuggugcuggggcguggggaccggcugcacgugcugcgggcuggacgucaaggacuucuucaccgacuacaugcuggugaaguggaagguggaguacaucaagaccgaggccaucgucugcguggagcucaccucccaggagcggcagugcagccugaucgaggccggcacccgcuucaaccuggggccggugaccaucacccucuccgagccccggaacguccagcagcgccugccgcccgagaucgugacgcugcaccccaagaucgaggagggcuucuucgaccucaugcacgugcagaagauccugagcgccuccaccgucugcaagcugcagagcugcacccacggggugcccggcgacuuccagguguaccacgucggcaaccuccugcgcggggacaaggugaacggccacuccauccacaagaucgagccccacuucaacaccagcuggauguccugggacgggugcgaccuggacuacuucugcaacaugggcgacuggccgagcugcacguacaccggggugacccagcacaaccgggcggccuucaucaacaugcucaacaucgagaccgacuacacgaagaccuuccacuuccacuccaagcgggucaccgcccacggcgacacgccccagcuggaccugaaggcccgccccgccuacggcgcgggggaggugaccgugcucgucgagguggccgaccuggagcugcacaccaagaagcucgaggugagcggccugaagaucgccucccugaccugcagcgggugcuacgccugcuccagcggcaucagcugcaagguccggauccacgugaacgagcccgacgaguucaccgugcacguccgcuccagcgacccggacgugguggccgcgggguccagccucauggcccggaagaucgaguucggcgccgacuccacguucaaggccuucagcuccaugcccaaggacagccugugcuucuacaucgucgagaaggacuacugcuccagcugcaccgacgacgacacccagaagugcgugaacaccaagcuggaccacccccaguccauccucaucgagcacaagggcacgaucaucgggaagcagaacgacacgugcagcaccaagaccuccugcuggcuggagagcgugaagggcuucuucuacgggcugaagaacaugcucuccggcaucuucgggaacgucuuccugggcaucuuccuguuccucgcccccuucgugcugcugaucuucuucuucuucuucggcuggcgccuccuguucugccugaagugcugccgccggacccgcgggcuccugaaguacaagcaccugaaggacgaggaggaggcgggcuacaagaagaucaucgagcggcucaacgggaagaagggcaagagccagcuguucgacggcgagcgccuggccgaccggaagaucgccgagcuguucuccaccaagauccacaucggg

SEQ ID NO: 12085 - RNA, 3495 nt, Artificial Sequence
  derived and/or modified CDS sequence (opt1) from CCHVF(CCHVF 75024)__AB069671.1__Gn-NSm-Gc
agcgaggaguccggcgacgacugcaucagccgcacccagcugcuccggaccgagacggccgagauccacggggacaacuacggcgggcccggcgacaagaucaccaucugcaacggguccaccaucguggaccagcgccugggcagcgagaugggcugcuacaccaucaaccgggugaaguccuucaagcugugcgagaacagcgccacggggaaguccugcgagaucgacagcaucccggugaagugccgccagggcuacugccucaagaucacccaggaggggcggggccacgugaagcugucccgcgggagcgaggucgugcuggacgcgugcgacuccagcugcgaggugaugauccccaagggcaccggcgacauccucgucgacugcuccgggggccagcagcacuuccugaaggacaaccugaucgaccucgggugccccagcaucccccugcugggcaagauggccaucuacaucugccggauguccaaccacccgaagaccacgauggccuuccucuucugguucagcuucggcuacgugaucacgugcauccugugcaaggccaucuucuaccugcucaucaucguggggacccugggcaagcgcuucaagcaguaccgggagcugaagccccagaccugcacgaucugcgagaccacccccgccaacgcgaucgacgccgagaugcacgaccucaacugcuccuacaacaucugccccuacugcgccagccgccugaccuccgacgggcuggcccggcacgucacgcagugcccgaagcgcaaggagaagguggaggagaccgagcucuaccugaaccuggagcggauccccugggugguccgcaagcuccuccaggugagcgagagcaccggcguggcgcugaagcgguccagcuggcucaucguccugcugguccucuucgccaucucccugagccccgugcaguccgcccccaucgggcacggcaagaccaucgagacguaccaggcccgcgaggaguacaccagcaucugccuguucgugcucggcuccauccuguucaucgugagcugccugaugaaggggcucguggacuccaucggcaacaucuucuucccggggcugagcaucugcaagaccugcuccaucggcagcaucaacggguucgagaucgagucccacaagugcuacugcagccugcucugcugccccuacugccggcacugcuccgccgaccgcgagauccaccagcugcaccugagcaucugcaagaagcggaagaccggcuccaacgucaugcucgcggugugcaagcgcaugugcuuccgggccacgauggaggugagcaacaaggcccugcugauccgcuccaucaucaacaccaccuucgucgugugcauccucauccuggccgucugcguggugagcaccagcgccgucgagauggagucccugcccgcgggcacgugggagcgcgaggaggaccucaccaacuucugccaccaggagugccaggugaccgagaccgagugccugugccccuacgaggcccuggugcugcggcgcccccucuuccuggacagcaucguccgggggaugaagaaccagcugaacuccacgagccucgagaccucccugagcaucgaggcccccuggggcgccaucaacgugcaguccaccuacaagcccaccgugagcacggccaacaucgcgcuguccuggagcuccgucgagcaccgcgggaacaagauccucgugagcggccgguccgagagcaucaugaagcuggaggagcgcaccgggaucuccugggaccugggcguggaggacgccagcgaguccaagcuccugaccgucagcgugauggaccugagccagauguacucccccguguucgaguaccucagcggcgaccggcaggucgaggaguggccgaaggcgaccugcaccggggacugccccgagcgcugcggcugcacgaccuccacgugccugcacaaggaguggccccacagccggaacuggcgcugcaaccccaccuggugcuggggcguggggaccggcugcacgugcugcgggcuggacgugaaggaccucuucaccgacuacaugaucgucaaguggaagguggaguacaucaagaccgaggccaucgugugcgucgagcugaccucccaggagcggcagugcagccugaucgaggccggcacccgcuucaaccucggguccgugaccaucacccugagcgagccgcggaacauccagcagaagcugccgcccgagaucaucacgcuccacccccgcaucgaggagggcuucuucgaccugaugcacgugcagaagguccuguccgccagcaccgugugcaagcuccaguccugcacccacggggugccgggcgaccugcaggucuaccacgugggcaaccugcucaagggggacaaggugaacggccaccugauccacaagaucgagccccaccugaacaccagcuggauguccugggacgggugcgaccucgacuacuacugcaacaugggcgacuggcccagcugcacguacaccggggucacccagcacaaccacgccuccuucgugaaccugcugaacaucgagaccgacuacaccaagagcuuccacuuccacuccaagcgggugaccgcccacggcgacaccccgcagcucgaccugaaggcccgccccaccuacggcgcgggggagaucacgguccugguggagguggccgacauggaguucacccccaagaagaucgagaucagcggccucaaguucgccucccugaccugcaccgggugcuacgccugcagcagcggcaucuccugcaagguccggauccacguggacgagcccgacgagcugacggugcacgucaagagcgacgacccggacgugguggccgcguccagcucccucauggcccgcaagcuggaguucgggaccgacagcaccuucaaggccuucuccgccaugcccaagaccagccugugcuucuacaucgucgagcgggaguacugcaaguccugcagcaaggaggacacgcagaagugcgugaacaccaagcucgagcagccccaguccauccugaucgagcacaagggcaccaucaucggcaagcagaacaacacgugcaccgccaaggcgagcugcuggcuggaguccgucaagagcuucuucuacgggcucaagaacaugcuguccggcaucuucgggaaccuguucaugggcaucuuccucuuccuggcccccuucauccugcucauccuguucuucauguucggguggcgcauccuguucugcuucaagugcugccgccggacccgcggccucuucaaguaccggcaccugaaggacgacgaggagaccggcuaccgccggaucaucgagcgccugaacaacaagaaggggaagaacaagcuccuggacggcgagcggcuggccgaccgccggaucgccgagcuguucagcaccaagacccacaucggg

SEQ ID NO: 12086 - RNA, 3495 nt, Artificial Sequence
  derived and/or modified CDS sequence (opt1) from CCHVF(CCHVF 7803)__AB069672.1__Gn-NSm-Gc
agcgaggaguccggcgacgacugcaucagccgcacccagcugcuccggaccgagacggccgagauccacggggacaacuacggcgggcccggcgacaagaucaccaucugcaacggguccaccaucguggaccagcgccugggcagcgagaugggcugcuacaccaucaaccgggucaaguccuucaagcugugcgagaacagcgccacggggaaguccugcgagaucgacagcaucccggugaagugccgccagggcuacugccucaagaucacccaggaggggcggggccacgugaagcugucccgcgggagcgaggucauccuggacgcgugcgacuccagcugcgaggugaugauccccaagggcaccggcgacauccucguggacugcuccgggggccagcagcacuuccugaaggacaaccugaucgaccucgggugccccagcaucccccugcugggcaagauggccaucuacaucugccggauguccaaccacccgaagaccacgauggccuuccucuucugguucagcuucggcuacgucaucacgugcauccugugcaaggccaucuucuaccugcucaucaucguggggacccugggcaagcgcuucaagcaguaccgggagcugaagccccagaccugcaccaucugcgagaccacccccgccaacgcgaucgacgccgagaugcacgaccucaacugcuccuacaacaucugccccuacugcgccagccgccugaccuccgacgggcuggcccggcacgugacgcagugcccgaagcgcaaggagaaggucgaggagaccgagcucuaccugaaccuggagcggauccccuggguggugcgcaagcuccugcaggucagcgagagcaccggcguggcgcugaagcgguccagcuggcucaucgugcugcugguccucuucgccaucucccugagccccgugcaguccgcccccaucagccacgggaagaccaucgagacguaccaggcccgcgaggaguacaccuccaucugccuguucgugcucggcagcauccuguucaucgucuccugccugaugaagggccucguggacagcaucgggaacaucuucuucccgggccuguccaucugcaagaccugcagcaucggguccaucaacggcuucgagaucgagagccacaagugcuacugcucccugcucugcugccccuacugccggcacugcagcgccgaccgcgagauccaccagcugcaccuguccaucugcaagaagcggaagaccgggagcaacgugaugcucgcggccugcaagcgcaugugcuuccgggccacgauggaggucuccaacaaggcccugcugauccgcagcaucaucaacaccaccuucgugguguacauccucauccuggccgucugcguggucagcaccuccgcgguggagauggagagccugcccgccggcacgugggagcgcgaggaggaccucaccaacuucugccaccaggagugccaggugaccgagaccgagugccugugccccuacgaggcccugguccugcggcgcccccucuuccuggacuccaucgugcggggcaugaagaacccccugaacagcacgucccucgagaccagccuguccaucgaggcccccuggggcgccaucaacgugcagagcaccuacaagcccaccgucuccacggcgaacaucgcccugagcugguccagcguggagcaccgcgggaacaagauccucguguccgggcggagcgaguccaucaugaagcuggaggagcgcaccggcaucagcugggaccugggggucgaggacgccuccgagagcaagcuccugaccgugagcgugauggaccugucccagauguacagcccggucuucgaguaccucuccggcgaccgccagguggaggaguggcccaaggcgaccugcaccggcgacugccccgagcggugcgggugcacgaccagcacgugccugcacaaggaguggccccacucccggaacuggcgcugcaacccgaccuggugcuggggcguggggaccggcugcacgugcugcggccuggacgucaaggaccucuucaccgacuacaugaucgugaaguggaagguggaguacaucaagacccgggggaucgucugcguggagcugaccagccaggagcgccagugcucccugaucgaggccggcacccgguucaaccucgggagcgugaccaucacccuguccgagccccgcaacauccagcagaagcugccgcccgagaucaucacgcuccacccgcggaucgaggagggcuucuucgaccugaugcacguccagaaggugcugagcgccuccaccgugugcaagcuccagagcugcacccacgggguccccggcgaccuccagguguaccacgugggcaaccugcugaagggggacaaggucaacggccaccugauccacaagaucgagccccaccugaacaccuccuggaugagcugggacgggugcgaccucgacuacuacugcaacaugggcgacuggccguccugcacguacaccggggugacccagcacaaccacgccagcuucgugaaccugcugaacaucgagaccgacuacacgaaguccuuccacuuccacagcaagcgcgucaccgcccacggcgacacgccccagcucgaccugaaggcccggcccaccuacggcgcgggggagaucaccgugcugguggaggucgccgacauggaguucacccccaagaagaucgagaucuccggccucaaguucgccagccugaccugcaccgggugcuacgccugcagcuccggcaucagcugcaaggugcgcauccacguggacgagccggacgagcugacgguccacgugaaguccgacgaccccgacguggucgccgcgagcuccagccucauggcccggaagcuggaguucgggaccgacuccaccuucaaggccuucagcgccaugcccaagaccucccugugcuucuacaucguggagcgcgaguacugcaagagcugcuccaaggaggacacgcagaagugcgugaacaccaagcucgagcagccccagagcauccugaucgagcacaagggcaccaucaucggcaagcagaacaacacgugcaccgccaaggcguccugcuggcuggagagcgucaaguccuucuucuacgggcucaagaacaugcugagcggcaucuucgggaacuucuucaugggcaucuuccuguuccucgccccguucauccugcugauccucuucuucauguucggguggcgcauccuguucugcuucaagugcugccggcgcacccggggccuguucaaguaccgccaccucaaggacgacgaggagaccggcuaccggcgcaucaucgagcggcugaacaacaagaaggggaagaacaagcugcucgacggcgagcgccuggccgaccggcgcaucgccgagcuguucuccaccaagacccacaucggg

SEQ ID NO: 12087 - RNA, 3495 nt, Artificial Sequence
  derived and/or modified CDS sequence (opt1) from CCHVF(CCHVF 79121)__AB069673.1__Gn-NSm-Gc
gccgagggcgggagcuccgacugcaucagccgcacccagcucgugaagaccgaggucgccgagauccacgaggacuccuacggcgggcccggcgagaagaucacgaucugcaacgggagcaccaucguggaccagggccucggcuccgagcuggggugcuacaccaucaaccgggugcgcagcuacaagcugugcgagaacuccgcgagcggcaaguccugcgagaucgacagcaucccggucaagugcaagcagggguucugccucaagaucacccaggagggccgggggcacgugaagcugucccgcggcacggagaucgugcuggacgucugcgacagcuccugcgagcucaugauccccaagggcaccggggacauccugguggacugcagcggcgggcagcagcacuuccugcagaacaaccucaucgaccugggcugccccaacgugccccugcucggcaagauggccaucuacgucugccggauguccaaccacccgaagaccaccauggccuuccuguucugguucagcuucggguacgugaucacgugcaucgccugccgcgugcuguucuaccuccugaucgccaucggcaccgucgggaagaagcugaagcaguaccgggagcucaagccccagaccugcaucgugugcgaguccgugcccgucaacgcgaucgacgccgagaugcacgagcugaacugcagcuacaacaucugccccuacugcgccucccgccugagcaccgacggccucauccggcacgugacgcagugcccgaagcgccgggagaagguggaggagaccgagcuguuccugaaccucgagcgcauccccuggcugguccggaagcugcuccaggugagcgaguccaccgggauggcccugaagcgcagcugcuggaugaucacccugcucauccugcugcucguguccaucagccccguccaguccgcgcccgugggcaaggagcgggccaucgagacguaccaggcccgcgagaccuacaccggcaucugccuguucgugcuggggagcguccucuucgccguguccuggcugaccaaggcccugaucgacggcaucgggaacagcuucuccccgggccucagcgucugcaagacgugcuccaucgggagcaucaacggcuucgagaucgagucccacaagugcuacugcagccuguucugcugccccuacugccgggcgugcuccagcgacaagaacacccaccgcaugcaccugaacgugugcaagaagcggaagaugggcuccaacgugaugcucgccgucugcaagcgcaugugcuuccgggccaccaucgaggccagcaacaaggcccugcugauccgcuccaucaucaacagcaccuucgugaucugcauccucauccugacgaucugcguggucagcaccuccgcgguggacauggagaaccugcccgccgggaucugggagaaggaggaggaccucaccaacuucugccaccaggagugccaggugaccgagacggagugccugugccccuacgaggccaugguccugcgcaagccgcuguuccucgacagcaccgccaagggcaugaagucccugcugaacagcaccucccucgagaccagccuguccaucgaggcccccuggggcgcgaucaacgugcagagcacguucaagcccaccguguccgccgccaacaucgcccugagcugguccagcgucgagcaccgggggaacaagauccucguguccgggcgcagcgaguccaucaugaagcuggaggagcggaccggcgugagcuggaaccugggcgucgaggacgccuccgagagcaagacccucacggugagcgugauggaccugucccagauguacagccccgucuucgaguaccuguccggggaccgccagguggaggaguggccgaaggcgaccugcaccggcgacugccccgagcggugcgggugcaccagcuccacgugccuccacaaggaguggccccacagccgcaacuggcggugcaaccccaccuggugcuggggcgugggcaccgggugcacgugcugcggccuggacgucaaggacuucuucaccgacuacaugcuggugaaguggaagguggaguacaucaagaccgaggccaucgucugcguggagcucaccucccaggagcgccagugcagccugaucgaggccgggacccgguucaaccugggcccggugaccaucacgcucuccgagccccgcaacguccagcagcggcugccgcccgagaucgugacccugcaccccaagaucgaggagggguucuucgaccucaugcacgugcagaagauccugagcgccuccaccgucugcaagcugcagagcugcacccacggcgugcccggcgacuuccagaucuaccacguggggaaccuccugcgcggcgacaaggucaacgggcacuccauccacaagaucgagccccacuucaacacgagcuggauguccugggacggcugcgaccuggacuacuucugcaacaugggggacuggccgagcugcaccuacaccggcgugacccagcacaaccgggcggccuucaucaacaugcucaacaucgagacggacuacaccaagaccuuccacuuccacuccaagcgcgugaccgcccacggcgacacgccccagcuggaccugaaggcccggcccgccuacggggcgggcgaggucaccgugcucguggaggucgccgaccuggagcugcacaccaagaaccucgaggugagcgggcugaagaucgccucccugaccugcagcggcugcuacgccugcagcuccgggaucagcugcaaggugcgcauccacgucaacgagcccgacgaguucacggugcacgugcgguccagcgacccggacgucguggccgcgggcuccagccucauggcccgcaagaucgaguucggcgccgacuccaccuucaaggccuucagcuccaugcccaaggacagccugugcuucuacaucguggagaaggacuacugcuccagcugcaccgacgacgacacccagaagugcgucaacacgaagcuggaccacccccaguccauccucaucgagcacaaggggaccaucaucggcaagcagaacgacacgugcagcaccaagaccuccugcuggcuggagagcgugaagggguucuucuacggccugaagaacaugcucuccgggaucuucggcaacguguuccugggcaucuuccuguuccucgcccccuucguccugcugaucuucuucuucuucuucggguggcggcuccuguucugccugaagugcugccgccgcacccggggccuccugaaguacaagcaccugaaggacgaggaggaggcgggguacaagaagaucaucgagcgccucaacggcaagaagggcaagagccagcuguucgacggggagcggcuggccgaccgcaagaucgccgagcuguucuccaccaagauccacaucggc

SEQ ID NO: 12088 - RNA, 3495 nt, Artificial Sequence
  derived and/or modified CDS sequence (opt1) from CCHVF(CCHVF 8402)__AB069674.1__Gn-NSm-Gc
agcgaggaguccggcgacgacugcaucagccgcacccagcugcuccggaccgagacggccgagauccacaacgacaacuacgggggccccggggacaagaucaccaucugcaacggcuccaccguggucgaccagcgccuggggagcgagcugggcugcuacaccaucaaccgggugaaguccuucaagcucugcgagaacagcgccacgggcaaguccugcgagaucgacagcaccccggugaagugccgccagggguucugccugaagaucacccaggagggccgggggcacgucaagcugucccgcggcagcgagguggugcucgacgcgugcgacuccagcugcgagaucaugauccccaaggggaccggcgacauccuggucgacugcuccggcgggcagcagcacuuccugaaggacaaccucaucgaccugggcugccccaacaucccccugcucgggaagauggccaucuacaucugccggaugagcaaccacccgaagacgaccauggccuuccuguucugguucuccuucggcuacguggugaccugcauccugugcaaggucaucuucuaccuccugaucguggugggcacccuggggaagaaguucaagcaguaccgcgagcucaagccccagacgugcaccaucugcgagaccacccccgucaacgccaucgacgccgagaugcacgaccugaacugcagcuacaacaucugccccuacugcgcgucccggcugacgagcgacggccucgcccgccacgugaugcagugcccgaagcggaaggagaagaucgaggagaccgagcuguaccugaaccucgagcgcauccccugggugguccggaagcugcuccagguguccgagagcaccgggguggcccugaagcgcagcuccuggcuggucgugcugcucgugcugcugaccgucagccucucccccgugcagagcgcccccaucggccacgggaagacgguggagaccuaccagacccgggagggcuacaccuccaucugccuguucguccugggcagcauccucuucaucguguccugccugaugaaggggcuggucgacagcgugggcaacuccuucuucccggggcucagcaucugcaagacgugcuccaucggcagcgugaacggguucgagaucgagucccacaagugcuacugcagccuguucugcugccccuacugccgccacugcuccgcggaccgggagauccaccgccugcaccucagcaucugcaagaagcggaagaccggcuccaacgucaugcuggccgugugcaagcgcaugugcuuccgggccaccguggaggucagcaacaaggcccugcucauccgcaacaucaucaacaccacguucgugcugugcauccugauccucgccgugugcgucguguccaccagcgcgguggagauggagagccugcccgccggcaccugggagcgcgaggaggaccugaccaacuucugccaccaggagugccaggucacggagaccgagugccugugccccuacgaggcccucgugcugcggaagccgcuguucuccgacagcaucgugaaggggaugaagaaccuccugaacuccaccagccuggagaccucccucagcaucgaggcccccuggggcgccaucaacguccaguccacguucaagcccaccgugagcgcggccaacaucgcccuguccuggagcuccguggagcaccgcgggaacaagauccuggucagcggccgguccgagagcaucaugaagcucgaggagcgcaccgggaucuccugggaccugggcguggaggacgccagcgaguccaagcugcucaccgugagcgucauggaccugagccagauguacucccccguguucgaguaccugagcggcgaccgccagguggaggaguggccgaaggcgaccugcacgggggacugccccgagcggugcggcugcaccuccagcacgugccuccacaaggaguggccccacucccggaacuggcgcugcaaccccaccuggugcuggggcgucgggaccggcugcacgugcugcgggcuggacgugaaggaccuguucaccgacuacauguucaucaaguggaagguggaguacaucaagaccgaggccaucgucugcguggagcucaccagccaggagcggcagugcacccugaucgaggccggcacccgcuucaaccuggggccggugaccaucacgcucuccgagccccggaacauccagcagaagcugccgcccgagaucgucacccugcacccccgcaucgaggagggcuucuucgaccucaugcacgugcagaaggugcugagcgccuccaccgucugcaagcugcagagcugcacccacggggugcccggcgaccuccagguguaccacaucggcaaccugcugaagggggacaaggucaacggccaccucauccacaagaucgagccccacuucaacacguccuggaugagcugggacgggugcgaccuggacuacuacugcaacaugggcgacuggccguccugcaccuacaccggggugacccagcacaaccacgccgccuucgugaacaugcugaacaucgagacggacuacaccaagaacuuccacuuccacagcaagcgggucaccgcgcacggcgacacgccccagcucgaccugaaggcccgccccaccuacggcgccggggagaucaccgugcugguggaggucgccgacauggagcuccacaccaagaagaucgagaucuccggccugaaguucgcgagccugaccugcacggggugcuacgccugcuccagcggcaucuccugcaaggugcggauccacguggacgagcccgacgagcucaccguccacgucaagagcgaggacccggacaucguggccgccagcuccagccugauggcccgcaagcuggaguucgggaccgacuccaccuucaaggcguucagcgccaugcccaagacgucccucugcuucuacaucguggagcgggaguacugcaagagcugcuccaaggaggacacccagaagugcgugaacaccaagcuggagcagccccagagcauccugaucgagcacaagggcaccaucaucggcaagcaguccaacacgugcaccgccaaggccagcugcuggcucgaguccgucaagagcuucuucuacgggcugaagaacaugcuguccggcaucuucgggaacguguucaucggcguguuccucuucuucgcccccuucauccugcugauccucuucuucauguucggguggcgcauccuguucugcuucaagugcugccggcgcacccgcggccuguucaaguaccggcaccucaaggacgacgaggagaccggcuaccgcaagaucaucgagcggcugaacaacaagaaggggaagaacaagcugcucgacggcgagcgccuggcggaccggaagaucgccgagcuguucagcaccaagacgcacaucggg

SEQ ID NO: 12089 - RNA, 3495 nt, Artificial Sequence
  derived and/or modified CDS sequence (opt1) from CCHVF(CCHVF 88166)__AB069675.1__Gn-NSm-Gc
agcgaggaguccggcgacgacugcaucagccgcacccagcugcuccggaccgagacggccgagauccacuccgacaacuacgggggccccggggacaagaucaccaucugcaacggcagcaccguggucgaccagcgccugggguccgagcugggcugcuacaccaucaaccgggucaagagcuucaagcucugcgagaacuccgccacgggcaagagcugcgagaucgacuccaccccggugaagugccgccagggguucugccugaagaucacccaggagggccgggggcacgugaagcugagccgcggcuccgagguggugcucgacgcgugcgacagcuccugcgagaucaugauccccaaggggaccggcgacauccuggucgacugcagcggcgggcagcagcacuuccugaaggacaaccucaucgaccugggcugccccaacaucccccugcucgggaagauggccaucuacaucugccggauguccaaccacccgaagacgaccaugggcuuccuguucugguucagcuucggcuacguggugaccugcauccugugcaaggucaucuucuaccuccugaucgugguggggacccugggcaagaaguucaagcaguaccgcgagcucaagccccagacgugcaccaucugcgagaccacccccgucaacgccaucgacgccgagaugcacgaccugaacugcuccuacaacaucugccccuacugcgccagccggcugacguccgacgggcucgcgcgccacgugaugcagugcccgaagcggaaggagaagaucgaggagaccgagcuguaccugaaccucgagcgcauccccugggugguccggaagcugcuccaggugagcgagagcaccggcguggcccucaagcgcuccagcuggcuggucgugcugcucgugcugcugaccgucucccucagccccgugcaguccgcccccaucgggcacggcaagacgguggagaccuaccagacccgggagggcuacaccagcaucugccuguucguccugggguccauccucuucaucgugagcugccugaugaagggccuggucgacuccguggggaacagcuucuucccgggccucuccaucugcaagacgugcagcaucggguccgugaacggcuucgagaucgagagccacaagugcuacugcucccuguucugcugccccuacugccgccacugcagcgccgaccgggagauccaccgccugcaccucuccaucugcaagaagcggaagaccuggagcaacgucaugcuggcggugugcaagcgcaugugcuuccgggccaccguggaggucuccaacaaggcccugcucauccgcaacaucaucaacaccacguucgugcugugcauccugauccucgccgugugcgucgugagcaccagcgccguggagauggagucccugcccgcgggcaccugggagcgcgaggaggaccugaccaacuucugccaccaggagugccaggucacggagaccgagugccugugccccuacgaggcccucgugcugcggaagccgcuguucagcgacuccaucgugaaggggaugaagaaccuccugaacagcaccucccuggagaccagccucuccaucgaggcccccuggggcgccaucaacguccagagcacguucaagcccaccauguccgccgcgaacaucgcccugagcugguccagcguggagcaccgcgggaacaagauccugguguccggccggagcgaguccaucaugaagcucgaggagcgcaccgggaucagcuggaaccugggcgucgaggacgccuccgagagcaagcugcucaccgugagcgugauggaccugucccagauguacagccccgucuucgaguaccuguccggcgaccgccagguggaggaguggccgaaggcgaccugcacgggggacugccccgagcggugcggcugcaccagcuccacgugccuccacaaggaguggccccacagccggaacuggcgcugcaaccccaccuggugcuggggcguggggaccggcugcacgugcugcgggcuggacgucaaggaccuguucaccgacuacauguucaucaaguggaagguggaguacaucaagaccgaggccaucgugugcgucgagcucaccucccaggagcggcagugcacccugaucgaggccggcacccgcuucaaccuggggccggugaccaucacgcucagcgagccccggaacauccagcagaagcugccgcccgagaucgugacccugcacccccgcaucgaggagggcuucuucgaccucaugcacguccagaaggugcuguccgccagcaccgugugcaagcugcaguccugcacccacgggguccccggcgaccuccagguguaccacaucggcaaccugcugaagggggacaaggugaacggccaccucauccacaagaucgagccccacuucaacacgagcuggauguccugggacgggugcgaccuggacuacuacugcaacaugggcgacuggccgagcugcaccuacaccggggucacccagcacaaccacgccgccuucgugaacaugcugaacaucgagacggacuacaccaagaacuuccacuuccacuccaagcgggugaccgcccacggcgacacgccccagcucgaccugaaggcgcgccccaccuacggcgccggggagaucaccguccugguggagguggccgacauggagcuccacaccaagaagaucgagaucagcggccugaaguucgccucccugaccugcacggggugcuacgcgugcagcuccggcaucagcugcaagguccggauccacguggacgagcccgacgagcucaccgugcacgucaagagcgaggacccggaccugguggccgccuccagcucccugauggcccgcaagcucgaguucgggaccgacagcaccuucaaggccuucuccgcgaugcccaagacgagccugugcuucuacaucguggagcgggaguacugcaaguccugcagcaaggaggacacccagaagugcgucaacaccaagcuggagcagccccaguccauccucaucgagcacaagggcaccaucaucggcaagcagaacaacacgugcaccgccaaggccagcugcuggcuggaguccgucaagagcuucuucuacgggcugaagaacaugcucuccggcaucuucgggaacguguucaucggcguguuccuguucuucgcccccuucauccugcucauccuguucuucauguucggguggcgcauccuguucugcuucaagugcugccggcgcacccgcggccucuucaaguaccggcaccugaaggacgacgaggagaccggcuaccgcaagaucaucgagcggcugaacaacaagaaggggaagaacaagcuccuggacggcgagcgccuggccgaccggaagaucgcggagcuguucagcaccaagacgcacaucggg

SEQ ID NO: 12090 - RNA, 3495 nt, Artificial Sequence
  derived and/or modified CDS sequence (opt1) from CCHVF(CCHVF BA88166)__AF338470.1__Gn-NSm-Gc
agcgaggaguccggcgacgacugcaucagccgcacccagcuccuccggaccgagacggccgagauccacuccgacaacuacgggggccccggggacaagaucaccaucugcaacggcagcaccguggucgaccagcgccugggguccgagcugggcugcuacaccaucaaccgggucaagagcuucaagcucugcgagaacuccgccacgggcaagagcugcgagaucgacuccaccccggugaagugccgccagggguucugccugaagaucacccaggagggccgggggcacgugaagcugagccgcggcuccgagguggugcucgacgcgugcgacagcuccugcgagaucaugauccccaaggggaccggcgacauccuggucgacugcagcggcgggcagcagcacuuccugaaggacaaccucaucgaccugggcugccccaacaucccccugcucgggaagauggccaucuacaucugccggauguccaaccacccgaagacgaccaugggcuuccuguucugguucagcuucggcuacguggugaccugcauccugugcaaggggaucuucuaccuccugaucgucgugggcacccuggggaagaaguucaagcaguaccgcgagcucaagccccagacgugcaccaucugcgagaccacccccgugaacgccaucgacgccgagaugcacgaccugaacugcuccuacaacaucugccccuacugcgccagccggcugacguccgacggccucgcgcgccacgucaugcagugcccgaagcggaaggagaagaucgaggagaccgagcuguaccugaaccucgagcgcauccccuggguggugcggaagcugcugcaggucagcgagagcaccgggguggcccucaagcgcuccagcuggcuggugguccugcucgugcugcugaccgugucccucagccccguccaguccgcccccaucggccacggcaagacgguggagaccuaccagacccgggagggguacaccagcaucugccuguucgugcugggcuccauccucuucaucgucagcugccugaugaaggggcugguggacuccgucggcaacagcuucuucccggggcucuccaucugcaagacgugcagcaucggcuccgugaacggcuucgagaucgagagccacaagugcuacugcucccuguucugcugccccuacugccgccacugcagcgccgaccgggagauccaccgccugcaccucuccaucugcaagaagcggaagaccuggagcaacgugaugcuggcggucugcaagcgcaugugcuuccgggccaccguggagguguccaacaaggcccugcucauccgcaacaucaucaacaccacguucguccugugcauccugauccucgccgugugcguggucagcaccagcgccguggagauggagucccugcccgcggggaccugggagcgcgaggaggaccugaccaacuucugccaccaggagugccaggugacggagaccgagugccugugccccuacgaggcccucguccugcggaagccgcuguaccucgacagcaucgugaagggcaugaagaaccugcugaacuccaccagccucgagaccucccugagcaucgaggcccccuggggcgccaucaacgugcaguccacguucaagcccaccaugagcgccgcgaacaucgcccuguccuggagcuccgucgagcaccgcgggaacaagauccucgugagcgggcgguccgagagcaucaugaagcuggaggagcgcaccggcaucuccuggaaccugggcguggaggacgccagcgaguccaagcuccugaccgucagcgugauggaccugagccagauguacucccccguguucgaguaccucagcggggaccggcaggucgaggaguggccgaaggcgaccugcacgggcgacugccccgagcgcugcgggugcaccuccagcacgugccugcacaaggaguggccccacucccggaacuggcgcugcaaccccaccuggugcuggggcgugggcaccgggugcacgugcugcggccuggacgugaaggaccucuucaccgacuacauguucaucaaguggaaggucgaguacaucaagaccgaggccaucgugugcguggagcugaccagccaggagcggcagugcacccugaucgaggccgggacccgcuucaaccucggcccggucaucaucacccuguccgagccccggaacauccagcagaagcugccgcccgagaucgugacgcuccacccccgcaucgaggagggguucuucgaccugaugcacgugcagaagguccugagcgccuccaccgugugcaagcuccagagcugcacccacggcgugcccggcgaccugcaggucuaccacaucgggaaccugcucaagggcgacaaggugaacgggcaccugauccacaagaucgagccccacuucaacaccuccuggaugagcugggacggcugcgaccuggacuacuacugcaacaugggggacuggccguccugcacguacaccggcgugacccagcacaaccacgccgccuucgucaacaugcucaacaucgagaccgacuacacgaagaacuuccacuuccacagcaagcgggugaccgcccacggcgacacgccccagcuggaccugaaggcgcgccccaccuacggggccggcgagaucaccgugcucgucgagguggccgacauggagcugcacaccaagaagaucgagaucuccgggcugaaguucgccagccugaccugcaccggcugcuacgcgugcuccagcgggaucuccugcaaggugcggauccacgucgacgagcccgacgagcucacggugcacgucaagagcgaggacccggacaucguggccgccagcuccagccugauggcccgcaagcucgaguucggcaccgacuccaccuucaaggccuucagcgcgaugcccaagaccucccugugcuucuacaucguggagcgggaguacugcaagagcugcuccaaggaggacacgcagaagugcgugaacaccaagcuggagcagccccagagcauccucaucgagcacaagggcaccaucaucgggaagcagaacaacacgugcaccgccaaggccuccugcuggcuggagagcgucaaguccuucuucuacggccugaagaacaugcucagcgggaucuucggcaacguguucaucgggguguuccuguucuucgcccccuucauccugcucauccuguucuucauguucggcuggcgcauccuguucugcuucaagugcugccggcgcacccgcggccucuucaaguaccggcaccugaaggacgacgaggagaccggguaccgcaagaucaucgagcggcugaacaacaagaagggcaagaacaagcuccuggacggggagcgccuggccgaccggaagaucgcggagcuguucuccaccaagacccacaucggc

SEQ ID NO: 12091 - RNA, 3495 nt, Artificial Sequence
  derived and/or modified CDS sequence (opt1) from CCHVF(CCHVF BA66019)__AF350448.1__Gn-NSm-Gc
agcgaggaguccggcgacgacugcaucagccgcacccagcugcuccggaccgagacggccgaggugcacggggacaacuacggcgggcccggcgacaagaucaccaucugcaacggguccaccaucgucgaccagcgccugggcagcgagcugggcugcuacaccaucaaccgggugaaguccuucaagcucugcgagaacagcgggacgggcaaguccugcaagaucgacaagcacccggugaagugccgccagggguucugccugaagaucacccaggagggccgggggcacgucaagcugagccgcggcuccgagguggugcucgacgccugcgacagcuccugcgagaucaugauccccaagggcaccggggacauccuggucgacugcagcggcgggcagcagcacuuccugaaggacaaccucguggaccugggcugccccaacaucccccugcucggcaagauggcgaucuacaucugccggauguccaaccacccgaagaccacgauggccuuccuguucugguucagcuucggguacgugaucacgugcaucuucugcaagaucaucuucuaccugcucaucgucgugggcacccuggggaagaaguucaagcaguaccgcgagcugaagccccagaccugcaccaucugcgagaccacccccaccaacgccaucgacgccgagaugcacgaccucaagugcuccuacaacaucugccccuacugcgccagccggcugacguccgacggccuggcgcgccacgugacccagugcccgaagcggaaggagaaggucgaggagaccgagcucuaccugaaccuggagcgcauccccuggaucgugcggaagcuccuccaggugagcgaguccaccggggucgcccugaagcgcagcagcuggcucaucgugcugcuggugcuccugacggucucccugagccccgugcaguccgcccccaucggccacggcaagaccaucgaggccuaccagacccgggagggguacaccagcgugugccucuucaugcugggcgggauccuguucgucguguccugccucaugaagggccugguggacagcgucuccaacagcuucuucccggggcuguccaucugcaagacgugcagcaucggcuccgugaacggcuucgagaucgagagccacaagugcuacugcucccuccugugcugccuguacugccgccacugcagcgcggaccgggagauccaccagcuccaccuguccaucugcaagaagcgccgggccgggggcaacgucaugcuggccgugugcaagcgcaugugccuccgggccaccauggaggugagcaacaagguccuguucauccgcuccaucaucaacaccaccuucgugaucugcauccuggugcucgccgucugcaucgugagcacguccgcgguggagauggagagccugcccgccgggaccugggagcgcgaggaggaccugaccaacuucugccaccaggagugccaggucaccgagacggagugccugugccccuacgaggcccucgugcugcggaagccccuguucagcgacuccaucgugaagggcaugaagaaccuccugaacagcaccucccuggagaccagccucuccaucgaggccccguggggcgccaucaacguccagagcaccuucaagcccacgguguccaccgcgaacaucgcccugagcugguccagcguggagcaccgcgggaacaagauccuggucuccggccggagcgaguccaucaugaagcucgaggagcgcaccgggaucagcugggaccugggcguggaggacgccuccgagagcaagcugcucaccguguccgucauggaccugagccagauguacagccccguguucgaguaccuguccggggaccgccagguggaggaguggcccaaggcgaccugcacgggcgacugcccggaccggugcggcugcaccagcuccacgugccuccacaaggaguggccccacagccggaacuggcgcugcaaccccaccuggugcuggggcgucgggaccgggugcacgugcugcggccuggacgugaaggaccuguucaccgacuacauguucgugaaguggaaggucgaguacaucaagaccgaggccaucgugugcguggagcucaacucccaggagcggcagugcagccugaucgaggccgggacccgcuucaaccugggccccgucaccaucacccucuccgagccgcggaacauccagcagaagcugccgcccgagaucaucacccugcacccccgcaucgaggagggcuucuucgaccucaugcacgugcagaaggugcugagcgccuccacggucugcaagcugcagagcugcacccacggggugcccggcgaccuccagaucuaccacaucgggaaccugcugaagggcgaccgggugaacgggcaccucauccacaagaucgagccccacuucaacaccuccuggaugagcugggacggcugcgaccuggacuacuacugcaacaugggcgacuggcccuccugcaccuacacgggggucacccagcacaaccacgccgccuucgugaaccugcucaacaucgagaccgacuacaccaagaacuuccacuuccacagcaagcgcgugacggcccacggcgacaccccgcagcuggaccugaaggcgcggcccaccuacggggccggcgagaucaccguccucguggagguggccgacauggagcugcacacgaagaagaucgccaucuccgggcugaaguucgcgagccugaccugcaccggcugcuacgccugcuccagcggcaucuccugcaagguccgcauccacguggacgagcccgacgagcugaccgugcacgucaagagcgaggaccccgacaucguggccgccagcuccagccugauggcccggaagcucgaguucgggacggacuccaccuucaaggcguucagcgccaugccgaagaccucccugugcuucuacaucguggagcgcgaguacugcgagagcugcuccaaggaggacacccagaagugcgucaacacgaagcuggagcagccccagagcauccucaucgagcacaagggcaccaucaucgggaagcagaacgacacgugcaccgccaaggccuccugcuggcuggagagcgugaaguccuucuucuacggccugaagaacaugcucagcgggaucuucggcaacguguucaucggcaucuuccuguuccuggcccccuucauccuccugauccuguucuucauguucggguggcggauccucuucugcuucaagugcugccgccgcacccggggccuguucaaguaccgcuaccugaaggacgacgaggaguccggguaccggcgcaucaucgagcggcucaacaacaagaagggcaagaacaagcugcuggacggcgagcgccucgcggaccggcgcaucgccgagcuguucagcaccaagacccacaucggg

SEQ ID NO: 12092 - RNA, 3495 nt, Artificial Sequence
  derived and/or modified CDS sequence (opt1) from CCHVF(CCHVF BA8402)__AF350449.1__Gn-NSm-Gc
agcgaggaguccggcgacgacugcaucagccgcacccagcugcuccggaccgagacggccgagauccacaacgacaacuacgggggccccggggacaagaucaccaucugcaacggcuccaccguggucgaccagcgccuggggagcgagcugggcugcuacaccaucaaccgggugaacuccuucaaccucugcgagaacacggccaccggcaagagcugcgagaucgacuccaccccggugaagugccgccagggguucugccugaagaucacccaggagggccgggggcacgucaagcugagccgcggcuccgagguggugcucgacgcgugcgagagcuccugcgagaucaugauccccaaggggacgggcgacauccuggucgacugcagcggcgggcagcagcacuuccugaaggacaaccucaucgaccugggcugccccaacaucccccugcucgggaagauggccaucuacaucugccggauguccaaccacccgaagaccaccauggccuuccuguucugguucagcuucggcuacguggugaccugcauccugugcaaggucaucuucuaccuccugaucguggugggcacgcuggggaagaaguucaagcaguaccgcgagcucaagccccagaccugcaccaucugcgagaccacgcccgucaacgccaucgacgccgagaugcacgaccugaacugcuccuacaacaucugccccuacugcgcgagccggccgaccuccgacggccuggcccgccacgugaugcagugccccaagcggaaggagaagaucgaggagaccgcccucuaccugaaccuggagcgcauccccugggugguccggaagcuccuccaggugagcgaguccaccgggguggcccugaagcgcagcagcuggcucgucgugcugcuggugcuccugacggucucccugagccccgugcaguccgcgccgaucggccacgggaagaccguggagaccuaccagacccgggagggcuacacgagcaucugccucuucguccugggcuccauccuguucaucgugagcugccucaugaaggggcuggucgacuccgugggcaacagcuucuuccccgggcuguccaucugcaagaccugcagcaucggcuccgugaacggguucgagaucgagagccacaagugcuacugcucccucuucugcugccccuacugccgccacugcagcgccgaccgggagauccaccgccugcaccuguccaucugcaagaagcggaagaccggcagcaacgucaugcucgccgugugcaagcgcaugugcuuccgggccaccguggaggucuccaacaaggcccugcugauccgcaacaucaucaacacgaccuucgugcucugcauccugauccuggcggugugcgucgugagcaccuccgccguggagauggagagccuccccgccggcaccugggagcgcgaggaggaccugacgaacuucugccaccaggagugccaggucaccgagaccgagugccugugcccguacgaggcccuggugcuccggaagccccuguucagcgacuccaucgugaaggggaugaagaaccugcucaacagcaccucccuggagacgagccuguccaucgaggcccccuggggcgcgaucaacguccagagcaccuucaagcccaccguguccgccgccaacaucgcccucagcugguccagcguggagcaccgcgggaacaagauccuggucuccggccggagcgaguccaucaugaagcuggaggagcgcaccgggaucagcugggaccucggcguggaggacgccuccgagagcaagcugcugaccguguccgucauggaccucagccagauguacagcccgguguucgaguaccuguccggcgaccgccagguggaggaguggcccaaggcgacgugcaccggggacugccccgagcggugcggcugcaccagcuccacgugccugcacaaggaguggccccacagccggaacuggcgcugcaacccgaccuggugcuggggcgucgggaccggcugcacgugcugcgggcucgacgugaaggaccuguucaccgacuacauguucaucaaguggaagguggaguacaucaagaccgaggccaucgucugcguggagcugaccucccaggagcggcagugcacccucaucgaggccggcacccgcuucaaccuggggcccgugacgaucacccugagcgagccccggaacauccagcagaagcugcccccggagaucgucacccugcacccccgcaucgaggagggcuucuucgaccugaugcacgugcagaaggugcucuccgccagcaccgucugcaagcugcaguccugcacgcacggggugcccggcgaccuccagguguaccacaucggcaaccugcugaagggggacaaggucaacggccaccugauccacaagaucgagccgcacuucaacaccagcuggauguccugggacgggugcgaccuccacuacuacugcaacaugggcgacuggcccagcugcaccuacaccggggugacgcagcacaaccacgccgcguucgugaacaugcugaacaucgagaccgacuacaccaagaacuuccacuuccacuccaagcgggucaccgcccacggcgacacgccccagcuggaccucaaggcccgccccaccuacggcgccggggagaucaccgugcugguggaggucgcggacauggagcugcacaccaagaagaucgagaucagcggccucaaguucgccucccugacgugcaccgggugcuacgccugcagcuccggcaucagcugcaaggugcggauccacguggacgagccggacgagcugaccguccacgugaaguccgaggaccccgacaucguggccgccagcagcucccucauggcgcgcaagcuggaguucgggaccgacagcacguucaaggccuucuccgccaugcccaagaccagccugugcuucuacaucgucgagcgggaguacugcgaguccugcagcaaggaggacacccagaagugcgugaacaccaagcucgagcagccccaguccauccugaucgagcacaagggcacgaucaucggcaagcagagcaacacgugcaccgccaaggccuccugcuggcuggagagcgugaaguccuucuucuacgggcucaagaacaugcugagcggcaucuucgggaacgucuucaucggcguguuccuguucuucgcgccguucauccuccugauccuguucuucauguucggguggcgcauccucuucugcuucaagugcugccggcgcacccgcggccuguucaaguaccggcaccugaaggacgacgaggagaccggcuaccgcaagaucaucgagcggcucaacaacaagaaggggaagaacaagcugcuggacggcgagcgccucgccgaccggaagaucgccgagcuguucuccaccaagacccacaucggg

SEQ ID NO: 12093 - RNA, 3495 nt, Artificial Sequence
  derived and/or modified CDS sequence (opt1) from CCHVF(CCHVF Matin)__AF467769.2__Gn-NSm-Gc
agcgaggaguccggcgacgacugcaucagccgcacccagcugcuccggaccgagacggccgagauccacuccgacagcuacgggggccccggggacaagaucaccaucugcaacggcuccaccguggucgaccagcgccuggggagcgagcugggcugcuacaccaucaaccgggugaaguccuucaagcucugcgagaacagcgccacgggcaaguccugcgagaucgacagcaccccggugaagugccgccagggguucugccugaagaucacccaggagggccgggggcacgucaagcugucccgcggcagcgagguggugcucgacgcgugcgacuccagcugcgagaucaugauccccaaggggaccggcgacauccuggucgacugcuccggcgggcagcagcacuuccugaaggacaaccucaucgaccugggcugccccaacaucccccugcucgggaagauggccaucuacaucugccggaugagcaaccacccgaagacgaccaugguguuccuguucugguucuccuucggcuacgugaucaccugcauccugugcaaggucaucuucuaccuccugaucguggugggcacccuggggaagaaguucaagcaguaccgcgagcucaagccccagacgugcaccaucugcgagaccacccccgucaacgccaucgacgccgagaugcacgaccugaacugcagcuacaacaucugccccuacugcgccucccggcugacgagcgacggccucgcgcgccacgugaugcagugcccgaagcggaaggagaagaucgaggagaccgagcuguaccugaaccucgagcgcauccccugggugguccggaagcugcugcaggugagcgaguccaccgggguggcccucaagcgcagcuccuggcuggucgugcugcucgugcugcugaccgucagccucucccccgugcagagcgcccccaucggccacgggaagacgguggagaccuaccagauccgggagggcuacaccuccgucugccuguucgugcugggcagcauccucuucaucgucuccugccugaugaaggggcugguggacagcgacggcaacuccuucuucccggggcucagcaucugcaagaccugcuccaucggcagcaucaacggguucgagaucgagucccacaagugcuacugcagccuguucugcugccccuacugccgccacugcuccacggaccgggagauccacaagcugcaccucagcaucugcaagaagcgcaagaccggcuccaacgugaugcuggccgucugcaagcggaugugcuuccgcgcgaccguggaggugagcaacaaggcccugcucauccggagcaucaucaacaccacguucgucgugugcauccugauccuggccgugugcgucguguccaccagcgccguggagauggagucccuccccgccggcaccugggagcgcgaggaggaccugaucaacuucugccaccaggagugccaggucaccgagacggagugccugugccccuacgaggcgcuggugcuccgcaagccgcuguuccuggacagcaucaucaaggggaugaagaaccuccugaacuccaccagccuggagaccucccucagcaucgaggcccccuggggcgccaucaacgugcaguccaccuucaagcccacgaugagcgccgccaacaucgcgcuguccuggagcuccgucgagcaccgggggaacaagauccuggugagcggccgcuccgagagcaucaugaagcucgaggagcggaccgggaucuccugggaccugggcguggaggacgccagcgagagcaagcugcucaccgucuccgugauggaccugagccagauguacucccccguguucgaguaccugagcggcgaccgccaggucgaggaguggccgaaggccaccugcaccggggacugccccgagcggugcggcugcacguccagcaccugccuccacaaggaguggccccacucccgcaacuggcggugcaaccccaccuggugcuggggggugggcaccggcugcacgugcugcgggcuggacgugaaggaccuguucaccgacuacauguucgucaaguggaagguggaguacaucaagaccgaggugaucgucugcguggagcucaccagccaggagcgccagugcucccugaucgaggccggcacgcgguucaaccuggggccggugaccaucacccucagcgagccccgcaacauccagcagaagcugccccccgagaucgucacccugcacccgcggaucgaggagggcuucuucgaccucaugcacgugcagaaggugcuguccgccagcacggucugcaagcugcaguccugcacccacggggugcccggcgaccuccagguguaccacaucggcaaccugcugaagggggacaaggucaacggccaccucauccacaagaucgagccccacuucaacaccagcuggauguccugggacgggugcgaccuggacuacuacugcaacaugggcgacuggccgagcugcuccuacaccggggugacgcagcacaaccacgcggccuucgugaacaugcugagcaucgagaccgacuacaccaagaacuuccacuuccacuccaagcgcgucaccgcccacggcgacacgccccagcucgaccugaaggcccggcccaccuacggcgccggggagaucaccgugcugguggaggucgcggacauggagcuccacaccaagaagaucgagaucagcggccugaaguucgccagccugacgugcaccgggugcuacgccugcuccagcggcaucuccugcaaggugcgcauccacguggacgagcccgacgagcucaccguccacgugaagagcgaggacccggacaucguggccgcguccagcucccugauggcccggaagcuggaguucgggaccgacagcacguucaaggccuucuccgccaugcccaagaccagccucugcuucuacaucgucgagcgcgaguacugcaaguccugcagcaaggaggacacccagaagugcgugaacaccaagcuggagcagccccaguccauccugaucgagcacaagggcacgaucaucggcaagcagaacgacaccugcaccgccaaggcgagcugcuggcucgaguccgugaagagcuucuucuacgggcugaagaacaugcuguccggcaucuucgggaacgucuucaucggcaucuuccucuuccuggcccccuucgcccugcucauccuguucuucauguucggguggcggauccuguucugcuucaagugcugccgccggacccgcggccucuucaaguaccgccaccugaaggacgacgaggagacgggcuaccggaagaucaucgagcgccugaacaacaagaaggggaagaacaagcuccuggacggcgagcggcuggccgaccgcaagaucgccgagcucuucagcaccaagacccacgugggg

SEQ ID NO: 12094 - RNA, 3495 nt, Artificial Sequence
  derived and/or modified CDS sequence (opt1) from CCHVF(CCHVF Baghdad 12)__AJ538197.2__Gn-NSm-Gc
agcgaggaguccggcgacgacugcaucagccgcacccggcugcuccgcaccgagacggccgagauccacggggacuccuacggcgggcccggcgacaagaucaccaucugcaacgggagcaccaucguggaccagcggcugggcuccgagaugggcugcuacaccaucaaccgcgucaagagcuucaagcugugcgagaacuccgccacggggaagagcugcaagaucgacuccaucccggugaagugccggcagggcuacugccucaagaucacccaggaggggcgcggccacgugaagcugagccggggguccgaggucgugcuggacgcgugcgacagcuccugcgaggugaugauccccaagggcaccggcgacauccucgucgacugcagcgggggccagcagcacuuccugaaggacaaccugaucgaccucgggugccccaacaucccccugcugggcaagauggccaucuacaucugccgcauguccaaccacccgaagaccacgauggccuuccucuucugguucagcuucggcuacgugaucaccugcauccugugcaaggccaucuucuaccugcucaucaucguggggacccugggcaagcgguucaagcaguaccgcgagcugaagccccagaccugcacgaucugcgagaccacccccgucaacgccaucgacgcggagaugcacgaccucaacugcuccuacaacaucugccccuacugcgccagccggcugaccuccgacgggcuggcccgccacgugacgcagugcccgaagcggaaggagaagguggaggagaccgagcucuaccugaaccuggagcgcauccccugggucgugcggaagcuccugcaggugagcgagagcaccggcgucgcccugaagcgcuccagcuggcucaucgugcugcuggugcuccuggcggucuccagcucccccgugcagagcgcccccaucggguacggcaagaccaucgagacguaccaggcccgggagggcuacaccuccaucugccuguucgugcucgggagcauccuguucaucgucuccugccugaccaagggccucguggacagcaucgggaacaucuucuucccgggccuguccaucugcaagaccugcagcaucggguccaucaacggcuucgagguggagagccacaagugcuacugcucccugcucugcugccccuacugccgccacugcagcgccgaccgggagauccaccagcugcaccuguccaucugcaagaagcgcaagacgggcagcuccgucaugcucgccgugugcaagcggaugugcuuccgcgcgaccauggaggucagcaacaaggcccugcugauccgcagcaucaucaacaccaccuucguggugugcauccucacgcuggccgucugcgugguguccaccagcgccgucgagauggagucccugcccgccgggaccugggagcgggaggaggaccucaccaacuucugccaccaggagugccaggugacggagaccgagugccugugccccuacgaggcgcuggugcugcgcaagccgcucuuccuggacagcaucgucaagggcaccaagaaccugcucaacuccaccagccuggagacgucccugagcaucgaggcccccuggggggccaucaacgugcaguccaccuacaagcccaccgugagcaccgccaacaucgcccucuccuggagcuccgucgagcaccggggcaacaagauccuggugagcgggcgcuccgagagcaucaugaagcuggaggagcggaccggcaucuccugggaccucggcguggaggacgcgagcgagagcaagcugcugacggucuccgugauggaccucagccagauguacucccccguguucgaguaccugagcggggaccgccaggucgaggaguggccgaaggccaccugcaccggcgacugccccgagcggugcgggugcaccacguccaccugccugcacaaggaguggccccacagccgcaacuggcggugcaaccccaccuggugcuggggcgugggcaccgggugcacgugcugcggccucgacgugaaggaccuguucaccgacuacauguucgucaaguggaagguggaguacaucaagaccgacgccaucgugugcgucgagcugaccucccaggagcgccagugcagccucaucgaggccgggacgcgguucaaccugggcuccgugaccaucacccugagcgagccgcgcaacauccagcagaagcucccccccgagaucaucacccugcacccccggaucgaggagggguucuucgaccugaugcacgugcagaagguccucuccgccagcacggugugcaagcugcaguccugcacccacggcgugccgggcgaccugcaggucuaccacaucgggaaccuccugaagggcgacaaggugaacgggcaccugauccacaagaucgagccccacuucaacaccagcuggauguccugggacggcugcgaccucgacuacuacugcaacaugggggacuggcccagcugcaccuacacgggcgugacccagcacaaccacgcguccuucgucaaccugcugaacaucgagaccgacuacaccaagagcuuccacuuccacuccaagcgcgugacggcccacggcgacaccccgcagcucgaccugaaggugcggcccaccuacggggccggcgagaucaccguccugguggagguggccgacauggagcuccacacgaagaagaucgagaucagcgggcugaaguucgcgagccugaccugcaccggcugcuacgccugcuccagcgggaucuccugcaagguccgcauccacguggacgagcccgacgagcucaccgugcacgucaagagcgacgaccccgacgugguggccgccuccagcucccugauggcccggaagcuggaguucggcacggacagcaccuucaaggcguucuccgccaugccgaagaccagccucugcuucuacaucgucgagcgcgaguacugcaaguccugcagcaaggaggacacccagaagugcgugaacacgaagcuggagcagccccaguccauccugaucgagcacaagggcaccaucaucgggaagcagaacaacaccugcaccgccaagaccagcugcuggcucgaguccgugaagagcuucuucuacggccugaagaacaugcuguccgggaucuucggcaacuucuucauggggaucuuccucuuccuggcccccuucauccugcucauccuguucuucauguucggcuggcggauccuguucugcuucaagugcugccgccgcacgcggggccucuucaaguaccgccaccugaaggacgacgaggagaccggguaccggcgcaucaucgagcggcugaacaacaagaagggcaagaacaagcuccuggacggggagcgccuggccgaccggcgcaucgcggagcucuucagcaccaagacccacaucggc

SEQ ID NO: 12095 - RNA, 3495 nt, Artificial Sequence
  derived and/or modified CDS sequence (opt1) from CCHVF(CCHVF VLG/TI29414)__AY179961.1__Gn-NSm-Gc
agcgaggagcccggcgacgacugcaucucccgcacccagcuccuccgggccgagccggccgagauccacgacgacaacuacgggggccccggggacaagaucaccaucugcaacggcagcacgaucguggaccagcgccugggguccgagcugggcugcuacaccaucaaccgggucaagagcuucaagcucugcgagaacuccgcgaccggcaagaccugcgagaucgacagcacgcccgugaagugccgccagggguucugccugaagaucacccaggagggccgggggcacgugaagcugucccgcggcagcgaggucgugcucgacgccugcgacuccagcugcgaggugaugauccccaaggggaccggcgacauccuggucgacugcuccggcgggcagcagcacuuccugaaggacaaccucaucgaccugggcugcccgcacaucccccugcucgggaagauggccaucuacaucugccggaugagcaaccacccccgcaccacgauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcgccggugaacgccaucgacgccgagaugcacgaccucaacugcuccuacaacaucugccccuacugcgccagccgccugaccuccgacggccuggcgcggcacgucccccagugccccaagcgcaaggagaagguggaggagaccgagcucuaccugaaccuggagcggaucccguggaacgugcgcaagcuccugcaggucagcgaguccacggggguggcccugaagcggagcagcuggcucaucgugcugcugguccuccugaccgugucccugagccccgugcaguccgcccccgucggccacgggaagaccaucgagaccuaccagacgcgcgagggcuucaccagcaucugccucuucaugcugggcuccauccuguuccucgugagcugccuggugaaggggcuggucgacuccgugagcgacuccuucuuccccggccucagcgugugcaagaccugcuccaucgggagcaucaacggcuucgagaucgagucccacaagugcuacugcagccuguucugcugcccguacugccggcacugcuccgccgaccgcgagauccaccagcugcaccucagcaucugcaagaagcggaagaugggguccaacgucaugcuggccgugugcaagcgcaugugcuuccgggcgaccaucgaggccagccgccgcgcccugcucauccgguccaucaucaacacgaccuucgucaucugcauccugacccugaccaucugcguggugagcacgagcgccgucgagauggagaaccuccccuccggcaccugggagcgcgaggaggaccugaccaacuucugccaccaggagugccaggugaccgagacggagugccugugccccuacgaggcccuggugcuccggaagccccuguuccuggacagcaucgucaagggcaugaagaaccuccugaacuccaccaaccuggagaccagccucuccaucgaggcgccguggggcgccaucaacgugcagagcaccuucaagcccacgguguccaccgccaacaucgcccugagcugguccagcgucgagcaccgcgggaacaagauccuggugaccgggcgguccgagagcaucaugaagcucgaggagcgcaccggcguguccugggaccugggggucgaggacgccagcgaguccaagcugcucaccgugagcaucauggaccugucccagauguacagccccguguucgaguaccugagcggcgaccggcaggucgaggaguggcccaaggcgacgugcaccggcgacugcccggagcgcugcgggugcaccuccagcacgugccuccacaaggaguggccccacucccggaacuggcgcugcaaccccaccuggugcugggaggugggcaccgggugcacgugcugcggcuggaacgugaaggaccuguucaccgaccacauguucgucaaguggaagguggaguacaucaagaccgaggccaucgugugcgucgagcugaccagccaggagcggcagugcucccucaucgaggccggcacccgcuucaaccuggggcccgugaccaucacgcugagcgagccgcggaacauccagcagaagcucccgcccgagaucaucacccugcaccccaagguggaggagggcuucuucgaccugaugcacguccagaaggugcucuccgccagcaccgugugcaagcugcaguccugcacccacgggauccccggcgaccugcaggucuaccacaucgggaaccuccugaagggcgaccgcgugaacggccaccugauccacaagaucgagccccacuucaacacgagcuggauguccugggacgggugcgaccucgacuacuacugcaacaugggcgacuggcccagcugcaccuacaccgggaugacccagcacaaccacgccgcguucgugaaccugcugaacaucgagacggacuacaccaagaccuuccacuuccacuccaagcgggucaccgcccacggcgacacgccgcagcucgaccugaaggcccgccccaccuacggggccggcgagaucaccgugcugguggaggucgcggacauggagcuccacaccaagaagguggagaucagcggccugaaguucgccucccuggccugcacggggugcuacgccugcagcuccggcaucagcugcaaggugcggauccacgucgacgagcccgacgagcucaccgugcacgugaaguccaacgaccccgacgucaucgccgcgagcaccagccugauggcccgcaagcuggaguucgggaccgacuccacguucaaggccuucagcgccaugccgaagaccucccucugcuucuacaucgccgagcgggaguacugcaagagcugcuccgaggaggacacccagaagugcguggacaccaagcuggagcagccccagagcauccugaucgagcacaagggcacgaucaucgggaagcagaacgacacgugcaccgcgaaggccuccugcuggcucgagagcgugaaguccuucuucuacggccugaagaacaugcugggcagcgucuucgggaacuucuucaucggcauccuccuguuccuggcccccuucgugcuccuggugcuguucuucauguucggguggaagauccucuucugcuucaagugcugccgccgcacccggggccugcugaaguaccgccuccugaaggacgacgaggagaccggguaccggcgcaucaucgagcggcugaacaacaagaagggcaagaaccgccuccuggacggcgagcggcuggccgaccgcaagaucgccgagcuguucuccaccaagacccacaucggg

SEQ ID NO: 12096 - RNA, 3495 nt, Artificial Sequence
  derived and/or modified CDS sequence (opt1) from CCHVF(CCHVF TADJ/HU8966)__AY179962.1__Gn-NSm-Gc
agcgaggaguccggcgacgacugcaucagccgcacccagcugcuccggaccgagacggccgagauccacggggacgacuacggcgggcccggcgacaagaucaccaucugcaacggguccaccaucguggaccagcgccugggcagcgagcugggcugcuacaccaucaaccgggucaaguccuucaagcucugcgagaacagcgccacggggaagaacugcgagaucgacuccgugccggugaagugccgccagggcuacugccugaagaucacccaggaggggcggggccacgucaagcugagccgcggguccgagguggugcucgacgcgugcgacagcuccugcgaggucaugauccccaagggcaccggcgacaucagcguggacugcuccgggggccagcagcacuuccugaaggacaaccugaucgaccucgggugccccaagaucccccugcugggcaagauggccaucuacaucugccggaugagcaaccacccgaagaccacgauggccuuccucuucugguucuccuucggcuacgugaucacccgcauccugugcaaggccaucuucuaccugcucaucaucgucgggacccugggcaagcgguucaagcaguaccgcgagcugaagccccagaccugcacgaucugcgagaccacccccgccaacgcgaucgacgccgagaugcacgaccucaacugcagcuacaacaucugccccuacugcgccucccggcugaccagcgacgggcuggcccgccacgugacgcagugcccgaagcggaaggagcgcguggaggagaccgagcucuaccugaaccuggagcggauccccuggaucguccgcaagcuccuccagguguccgagagcaccggcguggcgcugaagcggagcuccuggcucaucguccugcugguccucuucaccgugagccugucccccgugcagagcgcccccaucggguacggcaacacgaucgagaccuaccaggcccgcgaggaguacaccuccaucugccuguucgugcucggcagcauccuguucaucguguccugccugaugaaggggcucgucgacagcaucggcaacaucuucuucccggggcugaccaucugcaagacgugcuccaucggcagcaucaacggguucgagaucgagucccacaagugcuacugcagccugcucugcugccccuacugccggcacugcuccgccgaccgcgagauccaccagcugcaccugagcaucugcaagaagcggaagaccggcuccaacgugaugcucgccgugugcaagcgcaugugcuuccgcgcgaccauggaggucagcaacaaggcccugcugauccgguccaucaucaacaccacguucguggucugcauccucauccuggccgugugcaucgugagcaccuccgccgucgagauggagagccugcccgccggcaccugggagcgcgaggaggaccucaccaacuucugccaccaggagugccaggugacggagaccgagugccugugccccuacgaggcgcuggugcugcggcgcccccucuuccuggacagcaucgucaaggggaugaagaacccccugaacuccaccagccucgagaccucccugagcaucgaggcccccuggggcgccaucaacgugcaguccacguacaagcccaccgugagcaccgccaacaucgcccuguccuggagcuccaucgagcaccgggggaacaacauccucgucagcggccgcuccgagagcaucaugaagcuggaggagcggaccgggaucuccggcgaccugggcguggaggacgcgagcgaguccaagcuccugaccgugagcgucauggaccugucccagauguacagcccgguguucgaguaccucagcggggaccgccagguggaggaguggcccaaggccacgugcaccggcgacugccccgagcggugcgggugcaccuccagcacgugccugcacaaggaguggccccacucccgcaacuggcggugcaacccgacguggugcuggggcgucggcaccgggugcacgugcugcggccuggacgugaaggaccucuucaucgacuacauguucgugaaguggaaggucgacuacaucaagaccgaggccaucgugugcguggagcugaccagccaggagcgccagugcucccuggucgaggccgggacccgguucaaccucggccccgugaccaucacccugagcgagccccgcaacauccagcagaagcugcccccggagaucaucacgcuccacccccggaucgaggagggguucuucgaccugaugcacgugcagaagguccuguccgccagcaccgugugcaagcuccaguccugcacccacggcgugcccggcgaccugcaggucuaccacaucgggaaccugcucaagggcgacaaggagaacgggcaccugauccacaagaucgagccgcacuucaacaccagcuggauguccugggacggcugcgaccuggacuacuacugcaacaugggggacuggcccagcugcacguacaccggcgugacccagcacaaccacgcguccuucgugaaccuccugaacaucgagaccgacuacaccaagagcuuccacuuccacuccaagcgcgucaccgcccacggcgacaccccgcagcuggaccucaaggcccggcccaccuacggggccggcgagaucacggugcugguggaggucgcggacauggagcugcacaccaagaagaucgagaucaccgggcucaaguucgccagccugaccugcacgggcugcuacgccugcuccagcgggaucuccugcaaggugcgcauccacguggacgagccggacgagcugaccguccacgucaagagcgacgaccccgacgugguggccgccagcuccagccucauggcgcggaagcuggaguucggcaccgacuccaccuucaaggccuucagcgccaugcccaagacgucccugugcuucuacaucguggagcgcgaguaccgcaagagcugcuccaaggaggacacccagaagugcgugaacaccaagcucgagcagccccagagcauccugaucgagcacaagggcaccaucaucgggaagcagaacaacacgugcaccgccaaggccuccugcuggcuggagagcgucaaguccuucuucuacggccucaagaacaugcugagcgggaucuucggcaacguguucguggggaucuuccuguuccucgcgccguucauccugcugauccucuucuucauguucggcuggcggauccuguccugcuucaagugcugccgccggacccgcggccugcucaagcaccggcaccugaaggacgacgaggagaccggguaccgccggaucaucgagcgccugaacaacaagaagggcaagaacaagcuccuggacggggagcggcuggccgaccgccggaucgccgagcuguucagcaccaagacgcacaucggc

SEQ ID NO: 12097 - RNA, 3495 nt, Artificial Sequence
  derived and/or modified CDS sequence (opt1) from CCHVF(CCHVF Hodzha)__AY223476.1__Gn-NSm-Gc
agcgaggaguccggcgacgacugcaucagccgcacccagcugcuccggaccgagacggccgagauccacggggacgacuacggcgggcccggcgacaagaucaccaucugcaacggguccaccaucguggaccagcgccugggcagcgagcugggcugcuacaccaucaaccgggucaaguccuucaagcucugcaagaacagcgccacggggaaguccugcgagaucgacagcaccccggugaagugccgccagggcuacugccugaagaucacccaggaggggcggggccacgugaagcugucccgcgggagcgaggucgugcucgacgcgugcgacuccagcugcgaggugaugauccccaagggcaccggcgacauccuggucgacugcuccgggggccagcagcacuuccugaaggacaaccucaucgaccuggggugcccccggaucccccugcucggcaagauggccaucuacaucugccgcaugagcaaccacccgaagacgaccauggccuuccuguucugguucuccuucggcuacgugaucacgugcauccugugcaaggccaucuucuaccuccugaucaucguggggacccugggcaagcgguucaagcaguaccgcgagcucaagccccagaccugcaccaucugcgagaccacccccgccaacgcgaucgacgccgagaugcacgaccugaacugcagcuacaacaucugccccuacugcgccucccggcugacgagcgacgggcucgcccgccacgucacccagugcccgaagcggaaggagaagguggaggagaccgagcuguaccugaaccucgagcgcauccccuggaucgugcggaagcugcugcaggucuccgagagcaccggcguggcgcucaagcgcagcuccuggcugaucgugcugcucguccuguucgccgugagccugucccccgugcagagcgcccccaucgggcacggcaagacgaucgagaccuaccaggcccgggaggacuacaccuccaucugccucuucguccugggcagcauccuguucaucguguccugccucaugaaggggcugguggacagcaucggcaacaucuucuucccggggcugaccaucugcaagacgugcuccaucggcagcaucaacggguucgagaucgagucccacaagugcuacugcagccuccugugcugccccuacugccgccacugcuccgccgaccgggagauccaccagcugcaccucagcaucugcaagaagcgcaagaccggcuccaacgucaugcuggcggugugcaagcggaugugcuuccgcgccaccauggaggugagcaacaaggcccugcucauccgcuccaucaucaacaccacguucgucgugugcauccugauccuggccgucugcguggugagcaccuccgccgucgagauggagagccuccccgcgggcaccugggagcgggaggaggaccugaccaacuucugccaccaggagugccaggugacggagaccgagugccugugccccuacgaggcccuggugcuccgccggccgcuguuccuggacagcaucgucaaggggaccaagaaccuccugaacuccaccagccuggagacgucccucagcaucgaggcccccuggggcgccaucaacgugcaguccaccuacaagcccaccgugagcaccgccaacaucgcgcuguccuggagcuccgucgagcaccgcgggaacaagauccuggugagcggccgguccgagagcaucaugaagcucgaggagcgcaccgggaucuccugggaccugggcguggaggacgccagcgaguccaagcugcucacggucagcgugauggaccugucccagauguacagccccguguucgaguaccugagcggcgaccggcaggucgaggaguggccgaaggcgaccugcaccggggacugccccgagcgcugcggcugcaccuccagcacgugccuccacaaggaguggccccacucccggaacuggcgcugcaaccccaccuggugcuggggcguggggaccggcugcacgugcugcgggcuggacgugaaggaccuguucaccgacuacauguucgucaaguggaagguggacuacaucaagaccgaggccaucgugugcgucgagcucaccagccaggagcggcagugcucccugguggaggccggcacccgcuucaaccuggggccggugacgaucacccucagcgagccccggaacauccagcagaagcugccgcccgagaucaucacccugcacccccgcaucgaggagggcuucuucgaccucaugcacguccagaaggugcuguccgccagcaccgugugcaagcugcaguccugcacgcacgggguccccggcgaccuccagguguaccacaucggcaaccugcugaagggggacaaggugaacggccaccucauccacaagaucgagccccacuucaacaccagcuggauguccugggacgggugcgaccuggacuacuacugcaacaugggcgacuggccgagcugcaccuacaccggggucacgcagcacaaccacgccuccuucgugaaccugcucaacaucgagaccgacuacaccaagagcuuccacuuccacuccaagcgggugaccgcccacggcgacacgccccagcuggaccugaaggcccgccccaccuacggcgcgggggagaucaccguccucguggagguggccgacauggagcugcacaccaagaagaucgagaucacgggccugaaguucgccagccugaccugcaccgggugcuacgccugcuccagcggcaucuccugcaagguccggauccacguggacgagcccgacgagcucaccgugcacgucaagagcgacgacccggacgugguggccgcgagcuccagccugauggcccgcaagcucgaguucgggacggacuccaccuucaaggccuucagcgccaugcccaagaccucccugugcuucuacaucgucgagcgggaguacugcaagagcugcuccaaggaggacacccagaagugcgugaacacgaagcuggagcagccccagagcauccucaucgagcgcaagggcaccaucaucggcaagcagaacaacacgugcaccgccaaggcguccugcuggcuggagagcgugaaguccuucuucuacgggcugaagaacaugcucagcggcaucuucgggaacgucuucgugggcaucuuccuguuccuggcccccuucauccuccugauccuguucuucauguucggguggcgcauccucuucugcuucaagugcugccggcgcacccggggccuguucaaguacaagcaccugaaggacgacgaggagaccggcuaccgccggaucaucgagcgccucaacaacaagaaggggaagaacaagcugcuggacggcgagcggcucgccgaccgccggaucgccgagcuguucuccaccaagacccacaucggg

SEQ ID NO: 12098 - RNA, 3495 nt, Artificial Sequence
  derived and/or modified CDS sequence (opt1) from CCHVF(CCHVF Kosovo/9553/2001)__AY675511.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucgcccggaugagcaaccaccccaagaccaccauggccuuccuguucugguucucccugggcuacgugaucacgugcauccucugcaaggcccuguucuacagccugaucaucaucggcacccucgggaagaagaucaagcaguaccgcgagcugaagccccagaccugcaccaucugcgagaccgcgcccgugaacgccaucgacgccgagaugcacgaccugaacugcuccuacaacaucugcccguacugcgccagccggcucacguccgacggccuggcgcgccacgucaagcagugccccaagcggaaggagaagguggaggagaccgagcuguaccucaaccuggagcgcauccccugggugguccggaagcugcuccaggugagcgaguccaccgggguggcccugaagcgcagcagcuggcugaucguccuccuggugcugcucaccgugucccugagccccguccaguccgccccggugggccacgggaagacgaucgagaccuaccagacccgggagggcuucaccagcaucugccuguucaugcucggcuccauccuguucaucgugagcugccuggucaaggggcucguggacuccgugagcgacuccuucuuccccggccugagcgucugcaagacgugcuccaucgggagcaucaacggcuucgagaucgagucccacaagugcuacugcagccuguucugcugccccuacugccgccacugcuccgccgaccgggagauccaccagcuccaccugagcaucugcaagaagcgcaagaccggguccaacgugaugcuggccgucugcaagcggaugugcuuccgcgcgaccaucgaggccagccggcgcgcccuccugauccgcuccaucaucaacaccacguucgugaucugcauccugacccucaccaucugcguggccagcaccagcgccgucgagauggagacgcugcccgcggccaccugggagcgggaggaggaccugaccaacuucugccaccaggagugccaggugccggagaccgagugccugugccccuacgaggcccucgugcugcgcaagccccuguuccucgacuccaucgucaagggcaugaagaaccugcugaacagcacgucccucgagaccagccuguccaucgaggcccccuggggcgccaucaacgugcagagcaccuucaagccgaccguguccaccgcgaacaucgcccugagcugguccagcgucgagcaccgggggaacaagauccucgugacgggccgcuccgagagcaucaugaagcuggaggagcggaccgggguguccugggaccugggcgucgaggacgccagcgaguccaagcuccugaccgugagcaucauggaccugucccagauguacagccccguguucgaguaccucagcggggaccgccaggucgaggaguggcccaaggcgaccugcacgggcgacugccccgagcggugcggcugcaccuccagcacgugccugcacaaggaguggccgcacucccgcaacuggcggugcaaccccaccuggugcuggggcguggggaccgggugcacgugcugcggcguggacgucaaggaccuguucaccgaccacauguucgugaaguggaagguggaguacaucaagaccgaggccaucgucugcguggagcucaccagccaggagcgccagugcucccugaucgaggccggcacccgguucaaccuggggcccgugaccaucacccucagcgagccccgcaacauccagcagaagcugccgcccgagaucaucacgcugcaccccaagaucgaggagggcuucuucgaccucaugcacguccagaaggugcuguccgccagcaccgugugcaagcugcaguccugcacccacgggaucccgggcgaccuccaggucuaccacaucgggaaccugcugaagggcgaccgggugaacggccaccucauccacaagaucgagccccacuucaacaccagcuggauguccugggacgggugcgaccuggacuacuacugcaacaugggcgacuggcccagcugcacguacaccggggugacccagcacaaccacgccgccuucgucaaccugcucaacaucgagaccgacuacacgaagaccuuccacuuccacuccaagcgcgugaccgcgcacggcgacacgccccagcuggaccugaaggcccggccgaccuacggggccggcgagaucaccgugcucgucgagguggccgacauggagcugcacaccaagaagguggagaucagcggccugaaguucgccucccucgcgugcaccgggugcuacgccugcagcuccggcaucagcugcaagguccgcauccacguggacgagcccgacgagcugacggugcacgucaaguccagcgaccccgacgugguggccgccagcaccucccugauggcccggaagcucgaguucgggaccgacagcaccuucaaggcguucuccgccaugcccaagacgagccugugcuucuacaucgucgagaaggaguacugcaaguccugcagcgaggacgacaccaagaagugcguggacaccaagcuggagcagccgcaguccauccucaucgagcaccgcggcaccaucaucgggaagcccaacgacacgugccccgccaagaccagcugcuggcuggaguccgucaagagcuucuucuacggccugaagaacaugcucggcuccguguucgggaacuucuucaucggcauccugcuguuccucgcccccuucuuccuguggaugcugagcuucauguucggguggaagauccucuucugcuucaagugcugccggcgcacccgcggccuguucaaguaccggcaccugaaggacgacgaggagaccggguaccgccggaucaucgagcgccucaacaacaagaagggcaagaaccggcugcuggacggcgagcgccucgccgaccggaagaucgcggagcuguucuccaccaagacgcacaucggg

SEQ ID NO: 12099 - RNA, 3495 nt, Artificial Sequence
  derived and/or modified CDS sequence (opt1) from CCHVF(CCHVF SPU41/84)__AY900142.1__Gn-NSm-Gc
agcgaggaguccagcgacgacugcaucucccgcacccagcugcuccggaccgagacggccgagauccacggcgacaacuacgggggccccggggacaagaucaccaucugcaacggcagcaccguggucgaccagcgccugggguccgagcugggcugcuacaccaucaaccgggugaagacguucaagcucugcgagaacagcgccaccggcaaguccugcgagaucgacagcgugccggucaagugccgccagggguacugccugaagaucacccaggagggccgggggcacgugaagcugucccgcggcagcgaggugguccucgacgcgugcgacaccuccugcgaggugaugauccccaaggggacgggcgacauccugguggacugcagcggcgggcagcagcacuuccugaaggacaaccucaucgaccugggcugccccaagaucccccugcucgggaagauggccaucuacaucugccggauguccaaccacccgaagaccaccauggccuuccuguucugguucagcuucggcuacgucaucacgugcaucaucugcaaggugaucuucuaccugcucaucaucgugggcacccuggggaagcgcuucaagcaguaccgggagcugaagccccagaccugcaccaucugcgagaccacgcccgucaacgccaucgacgccgagaugcacgaccucaacugcuccuacaacaucugccccuacugcgcgagccgccugaccuccgacggccuggcccggcacgugacccagugcccgaagcgcaaggagaagguggaggagaccgagcucuaccugaaccuggagcggauccccugggucgugcgcaagcuccuccaggugagcgaguccacgggggucgcccugaagcggagcagcuggcucguggugcugcugguccuccugaccgugucccugagccccgugcaguccgcccccaucagccacggcaagaccgucgaggcguaccgcgcccgggagggguacaccuccaugugccucuucgugcugggcagcguccuguuccucguguccugccugaugaagggccugguggacagcgucgggaacacguucuucccgggccucuccaucugcaagaccugcagcaucuccagcaucaacggguucgagaucgagucccaccgcugcuacugcagccuguucugcugccccuacugccggcacugcuccgccaacaaggagauccaccagcugcaccucagcaucugcaagaagcgcaaggccggcuccaacgugaugcuggccgugugcaagcggaugugcuuccgcgcgaccauggaggucagcaaccgcgcccuguucauccgguccaucaucaacaccacguucgugcucugcauccugauccuggccgccugcguggucagcaccagcgccguggagauggagucccuccccgcggggaccugggagcgcgaggaggaccugaccaacuucugccaccaggagugccagguggccgacacggagugccugugccccuacgaggcccugguccuccggcgcccgcuguuccuggacagcaucgugaagggcaugaagaaccuccugaacuccaccagccuggagaccucccucagcaucgaggcccccuggggcgccaucaacgugcaguccaccuacaagcccacggucagcaccgcgaacaucgcccuguccuggagcuccguggagcaccgggggaacaagauccuggugagcggccgcuccgagagcaucaugaagcucgaggagcggaccgggaucuccugggaccugggcgucgaggacgccagcgaguccaagcugcucaccgugagcgugauggaccugagccagauguacucccccgucuucgaguaccugagcggggaccgccagguggaggaguggccgaaggcgaccugcacgggcgacugccccgagcggugcggcugcaccuccagcacgugccuccacaaggaguggccccacucccgcaacuggcggugcaaccccaccuggugcuggggcguggggaccgggugcacgugcugcggccuggacgucaaggaccuguucaccgacuacauguucgugaaguggaagguggaguacaucaagaccgaggccaucgucugcguggagcucaccagccaggagcgccagugcucccugaucgaggccggcacccgguucaaccuggggccggugaccaucacccucagcgagccccgcaacauccagcagaagcugccgcccgagaucaucacgcugcacccccggaucgaggagggcuucuucgaccucaugcacguccagaaggugcuguccgccagcaccgugugcaagcugcaguccugcacccacgggguccccggcgaccuccagguguaccacaucgggaaccugcugaagggcgacaaggugaacggccaccucguccacaagaucgagccccacuucaacaccagcuggauguccugggacgggugcgaccuggacuacuacugcaacaugggcgacuggccgagcugcacguacaccggggugacccagcacaaccacgccuccuucgugaacaugcugaacaucgagaccgacuacacgaagaacuuccacuuccacagcaagcgcgucaccgcccacggcgacacgccccagcucgaccugaaggcgcggcccaccuacggggccggcgagaucaccgugcugguggaggucgccgacauggagcuccacaccaagaagaucgagaucuccggccugaaguucaccagccugaccugcacggggugcuacgccugcuccagcggcaucagcugcaaggugcgcauccacguggacgagcccgacgagcucaccguccacgugaaguccgaggacccggacguggucgccgcgagcuccagccugauggcccggaagcuggaguucgggaccgacuccaccuucaaggccuucagcgccaugcccaagacgucccucugcuucuacaucguggagcgcgaguacugcaagagcugcuccgaggaggacacccagaagugcgugaacaccaagcuggagcagccccagagcauccugaucgagcgcaagggcaccaucaucgggaagcagaacaacacgugcaaggccaaggcgggcugcuggcucgaguccgucaagagcuucuucuacggccugaagaacaugcuguccgggaucuucggcaacguguucaucgggaucuuccucuuccuggcccccuucauccugcucauccuguucuucauguucggcuggcggauccuguucugcuucaagugcugccgccggacccgcggccucuucaaguaccggcaccugaaggacgacgaggagaccggguaccgcaagaucaucgagcggcugaacaacaagaagggcaagaacaagcuccuggacggggagcgccuggccgaccggcgcaucgccgagcuguucagcaccaagacccacaucggc

SEQ ID NO: 12100 - RNA, 3495 nt, Artificial Sequence
  derived and/or modified CDS sequence (opt1) from CCHVF(CCHVF UG3010)__AY900143.1__Gn-NSm-Gc
gccgagggcgugagcaacgacugcgucucccgcacccagcugaucaagaccgagguggccgagauccacgaggacagcuacgggggccccggggagaagaucacgaucugcaacggcuccaccaucguggaccagcggcucgggagcgagcugggcugcuacaccaucaaccgcgucaagaccuacaagcugugcgagaacuccgcgacggagaagggcugcgagaucgacagcgugccggugaagugcaagcagggguucugccucaaggucacccaggagggccgggggcacgugaagcugucccgcggcaccgagaucgugcuggacgucugcgacaccagcugcgagcucaugauccccaaggggacgggcgacauccugguggacugcuccggcgggcagcagcacuuccugcaggacaaccucaucgaccugggcugccccaacgugccccugcucgggaagauggccaucuacaucugccggaugagcaaccacccgaagaccaccauggccuuccuguucugguucuccuucggcuacgucaucacgugcaucgugugcaaggugcuguucuaccuccugaucgucaucggcacccugagcaagaagcucaagcaguaccgcgagcugaagccccagaccugcaucgugugcgaguccacccccgugaacgccaucgacgccgagaugcacgagcugaacugcaacuacaacaucugccccuacugcgcgagccggcucaccuccgacgggcugguccgccacgugaaccagugcccgaagcggaaggagaagguggaggagacggagcuguaccucaaccuggagcgcauccccuggcugguccggcgccuccuccaggugagcgaguccaccggcauggcccugaagcggagcugcuggaugaccacccuccugauccugcucguggucucccugagccccgugcagagcgcccccgucgggcagggcaaggccguggagguguaccgcguccgggaguccuacacgagcaucugccuguucgugcucggguccgugcuguucgcggucagcuggcugaucaagggccucaucgacggcaucgggaacuccuucuucccgggccugagcgugugcaagaccugcuccaucgggagcaucaacggcuucgagaucgagucccacaagugcuacugcagccuguucugcugccccuacugccgcgccugcuccagcgacaagaucacccaccggaugcaccucaacgugugcaagaagcgcaaggccggguccaacgucaugcuggccgugugcaagcggaugugcuucaaggccaccguggaggcgagcaacacggcccugcucauccgcggcaucaucaacuccaccuucgucaucugcgugcugauccuggugaucugcgucgugagcaccuccgccguggacauggagaaccuccccgccggcaucugggagcgggaggaggaccugaccaacuucugccaccaggagugccaggucacggagaccgagugccugugccccuacgaggcccugauccuccgcaagccgcuguaccuggacagcaucgcgaaggggaugaagucccuccugaacagcaccaaccuggagaccagccucuccaucgaggcccccuggggcgccaucaacgugcagagcacguucaagcccaccguguccgccgccaacaucgcgcugagcugguccagcgucgagcaccgcgggaacaagauccugguguccggccggagcgaguccaucaugaagcucgaggagcgcaccgggaucagcuggucccugggcguggaggacgccagcgaguccaagacccugacggucagcgugauggaccucucccagauguacagccccguguucgaguaccuguccggcgaccggcaggucgaggaguggccgaaggcgaccugcaccggggacugccaggagcgcugcggcugcaccagcagcacgugccugcacaaggaguggccccacucccggaacuggcgcugcaaccccaccuggugcuggggcguggggaccggcugcacgugcugcgggcucgacgugcgggaccuguucaccgacuacaugauggucaaguggaagguggaguacgugaagaccgaggccaucaugugcgucgagcugaccagccaggagcgccagugcucccucaucgaggccggcacccgguucaaccuggggcccgugaccaucacgcugagcgagccgcgcaacauccagcagcggcuccccuccgagaucgugacccugcaccccaagaucgaggagggcuucuucgaccugaugcacguccagaaggugcucagcgccuccaccgugugcaagcugcagagcugcacccacgggguccccggcgaccuccagguguaccacgugggcaaccugcugaagggggacaaggucaacggccacuccauccacaagaucgagagccacuucaacacguccuggaugagcugggacgggugcgaccuggacuacuucugcaacaugggcgacuggccguccugcaccuacaccggggugacccagcacaaccgcgccgccuucaucaacaugcucaacaucgagacggacuacaccaagaccuuccacuuccacagcaagcgggugaccgcccacggcgacacgccccagcuggaccugaaggcgcgccccaccuacggcgccggggaggucaccgugcucguggaggucgccgaccuggagcugcacaccaagaagaucgagguguccggccucaaguucgccagccugacgugcuccgggugcuacgccugcagcuccggcaucagcugcaaggugcggauccacgucaacgagccggacgaguucaccgugcacgucaagagcuccgaccccgacgugguggcggccgggagcucccugauggcccgcaagaucgaguucggcgccgacagcaccuucaaggccuucuccagcaugcccaagaacucccucugcuucuacaucgucgagcgggacuacugcagcuccugcaccaacgacgacacgcagaagugcguggacaccaagcuggagcacccccagagcauccugaucgagcacaagggcaccaucaucgggaagcagaacgacacgugcuccaccaagaccagcugcuggcucgaguccgucaagagcuucuucuacggccugaagaacaugcucgggggcaucuucgggaacguguuccugggcaucuuccuguuccuggcgccguucgcccuccugaucuucuucuucuucuucggcuggcgccugcuguucugccugaagugcugccggcgcacccgcgggcugcucaaguacaagcagcugaaggacgaggaggaggccggcuacaagaagaucaucgagcggcugaacgacaagaaggggaagucccgccucuucgacggcgagcggcuggccgaccgcaagaucgccgagcuguucagcaccaagacgcacaucggc

SEQ ID NO: 12101 - RNA, 3495 nt, Artificial Sequence
  derived and/or modified CDS sequence (opt1) from CCHVF(CCHVF Hy13)__AY900145.1__Gn-NSm-Gc
agcgaggaguccggcgacgacugcaucagccgcacccagcugucccggaccgagacggccgagauccacagcgacaacuacgggggccccggggacaagaucaccaucugcaacggcuccaccaucguggaccagcgccucgggagcgagcugggcugcuacaccaucaaccgggucaaguccuucaagcugugcgagaacagcgccacgggcaaguccugcgagaucgacagcaccccgaucaagugccgccagggguucugccucaagaucacccaggagggccgggggcacgugaagcugucccgcggcagcgaggugguccuggacgcgugcgacuccagcugcgagaucaugauccccaaggggaccggcgacauccucguggacugcuccggcgggcagcagcacuuccugaaggacaaccugaucgaccucggcugccccaacaucccccugcuggggaagauggccaucuacaucugccggaugagcaaccacccgaagacgaccauggccuuccucuucugguucuccuucggcuacgugaucacgugcauccugugcaaggucaucuucuaccugcucaucguggugggcacccuggggaagaaguucaagcaguaccgcgagcugaagccccagaccugcaccaucugcgagaccacccccgucaacgccaucgacgccgagaugcacgaccucaacugcagcuacaacaucugccccuacugcgcgucccggcugacgagcgacggccuggcccgccacgugaugcagugcccgaagcggaaggagaagguggaggagaccgagcucuaccugaaccuggagcgcauccccugggucgugcggaagcuccuccaggugagcgaguccaccggggucgcccugaagcgcagcuccuggcucguggugcugcugguccuccugaccgugagccugucccccgugcagagcgcccccaucggccacgggaagacggucgagaccuaccagacccgggagggcuacaccuccaucugccucuucgugcugggcagcauccuguucaucguguccugccucaugaaggggcuggucgacagcgugggcaacuccuucuucccggggagcuccaucugcaagacgugcagcaucggcuccaucaacggguucgagaucgagagccacaagugcuacugcucccuguucugcugccccuacugccgccacugcagcgcggaccgggagauccacaagcuccaccuguccaucugcaagaagcgcaagaccggcagcaacgucaugcuggccgugugcaagcggaugugcuuccgcgccaccguggaggucagcaacaaggcccuccugauccggaacaucaucaacaccacguucguggugugcauccugauccucgccgucugcgugguguccaccagcgcggucgagauggagucccugcccgccggcaccugggagcgcgaggaggaccugaccaacuucugccaccaggagugccaggccacggagaccgagugccucugccccuacgaggcccuggugcugcgcaagccgcuguucagcgacuccaucgugaaggggaugaagaaccuccugaacagcaccucccuggagaccagccucuccaucgaggcccccuggggcgcgaucaacguccagagcacguucaagcccaccguguccgccgccaacaucgcccugagcugguccagcguggagcaccgggggaacaagauccuggucuccggccgcagcgaguccaucaugaagcucgaggagcggaccgggaucagcugggaccugggcguggaggacgccagcgaguccaagcugcucaccgugagcaucauggaccugucccagauguacagccccgucuucgaguaccuguccggcgaccgccagguggaggaguggccgaaggcgaccugcacgggggacugccccgagcggugcggcugcaccagcuccacgugccuccacaaggaguggccccacagccgcaacuggcggugcaaccccaccuggugcuggggcguggggaccggcugcacgugcugcgggcuggacgucaaggaccuguucaccgaccacauguucgugaaguggaagguggaguacaucaagaccgaggccaucgucugcguggagcucaccucccaggagcgccagugcagccugaucgaggccggcacccgguucaaccuggggccggugaccaucacccucuccgagccccgcaacauccagcagaagcugccgcccgagaucgucacgcugcacccccggaucgaggagggcuucuucgaccucaugcacgugaagaaggugcugagcgccuccaccgucugcaagcugcagagcugcacccacggggugcccggcgaccuccagguguaccacaucggcaaccugcugaagggggacaaggucaacggccaccucauccacaagaucgagccccacuucaacaccuccuggaugagcugggacgggugcgaccuggacuacuacugcaacaugggcgacuggccguccugcagcuacacgggggugacccagcacaaccacgccgcguucgugaacaugcugaacaucgagaccgacuacaccaagaucuuccacuuccacuccaagcgcgucacggcccacggcgacacgccccagcucgaccugaaggcccggcccaccuacggcgccggggagaucaccgugcugguggaggucgcggacauggagcuccacaccaagaagaucgagaucagcggccugaaguucgccagccugaccugcaccgggugcuacgccugcuccagcggcaucuccugcaaggugcgcauccacguggacgagcccgacgagcucaccguccacgucaagagcgaggacccggacaucguggccgccuccagcucccugauggcgcggaagcuggaguucgggacggacagcaccuucaaggccuucuccgccaugcccaagaccagccucugcuucuacaucguggagcgcgaguacugcaaguccugcagcaaggaggacacccagaagugcgugaacacgaagcuggagcagccccaguccauccugaucgagcacaagggcaccaucaucggcaagcagaacgacacgugcaccagcaaggccgggugcuggcucgaguccgucaagagcuucuucuacggccugaagaacaugcuguccgggaucuucggcaacguguucaucgggaucuuccucuuccuggcccccuucauccugcucauccuguucuucauguucggcuggcggauccuguucugcuucaagugcugccgccggacccgcggccucuucaaguaccgccaccugaaggacgacgaggagaccggguaccggaagaucaucgagcgccugaacaacaagaagggcaagaacaagcuccuggacggggagcggcuggcggaccgcaagaucgccgagcuguucagcaccaagacccacaucggc

SEQ ID NO: 12102 - RNA, 3495 nt, Artificial Sequence
  derived and/or modified CDS sequence (opt1) from CCHVF(CCHVF Semunya)__DQ094832.1__Gn-NSm-Gc
gccgagggcgugagcaacgacugcgugucccgcacccagcugaucaagaccgagguggccgagauccacgaggacagcuacgggggccccggggagaagaucacgaucugcaacggcuccaccaucguggaccagcggcucgggagcgagcugggcugcuacaccaucaaccgcgucaagaccuacaagcugugcgagaacuccgcgacggagaagggcugcgagaucgacagcgugccggugaagugcaagcagggguucugccucaaggucacccaggagggccgggggcacgugaagcugucccgcggcaccgagaucgugcuggacgucugcgacaccagcugcgagcucaugauccccaaggggacgggcgacauccugguggacugcuccggcgggcagcagcacuuccugcaggacaaccucaucgaccugggcugccccaacgugccccugcucgggaagauggccaucuacaucugccggaugagcaaccacccgaagaccaccauggccuuccuguucugguucuccuucggcuacgucaucacgugcguggugugcaagguccuguucuaccuccugaucgugaucggcacccuggggaagaagcucaagcaguaccgcgagcugaagccccagaccugcaucgugugcgagagcauccccgucaacgccaucgacgccgagaugcacgagcugaacugcaacuacaacaucugccccuacugcgcgucccggcucaccagcgacggccuggugcgccacgugacccagugcccgaagcggaaggagaaggucgaggagacggagcuguaccucaaccuggagcgcauccccuggcuggugcggcgccuccuccagguguccgagagcaccgggauggcccugaagcgguccugcuggaugaccacccuccugauccugcucgucgugagccugucccccguccagagcgcccccgugggccaggagaaggccaucgagguguaccagguccgcgagagcuacacguccaucugccuguucgugcucgggagcgugcuguucgcggucuccuggcuggugaagggccucaucgacggcaucgggaacagcuucuucccgggccuguccgugugcaagaccugcagcaucggguccaucaacggcuucgagaucgagagccacaagugcuacugcucccuguucugcugccccuacugccgggccugcagcuccgacaagaucacccaccgcaugcaccucaacaucugcaagcggcgcaaggucgggagcaacgugaugcuggccgugugcaagcggaugugcuucaaggccaccgucgaggccuccaacagcgcgcugcucauccgcuccaucaucaacagcacguucgugaucugcgugcugauccuggucaucugcgugguguccaccagcgccgucgacauggagaaccuccccgccggcaucugggagcgggaggaggaccugaccaacuucugccaccaggagugccaggugaccgagacggagugccugugccccuacgaggcccugauccuccgcaagccgcuguuccuggacuccaucgccaagggcaagaagucccuccugaacagcaccaaccuggagaccagccucagcaucgaggcgcccuggggcgccaucaacgugcaguccaccuucaagcccacggucagcgccgccaacaucgcccuguccuggagcuccguggagcaccgcgggaacaagauccuggugagcgggcgguccgagagcaucaugaagcucgaggagcgcaccggcaucuccuggagccugggggucgaggacgcguccgagagcaagacccugaccguguccgugauggaccucagccagauguacucccccgucuucgaguaccugagcggcgaccgccagguggaggaguggccgaaggccacgugcaccggcgacugccccgagcggugcgggugcaccagcuccacgugccugcacaaggaguggccccacagccggaacuggcgcugcaaccccaccuggugcuggggcguggggaccggcugcacgugcugcggccucgacguccgggaccuguucaccgacuacaugauggugaaguggaagguggaguacgucaagaccgaggccaucaugugcguggagcugaccucccaggagcgccagugcagccucaucgaggccgggacccgguucaaccugggcccggugaccaucacccuguccgagccccgcaacguccagcagcggcuccccagcgagaucgugacgcugcaccccaagaucgaggagggguucuucgaccugaugcacgugcagaagguccucuucugcaaguacucccugcaggccaccagcugcacccacggcgugccgggggaccuccagguguaccacgucggcaaccugcugaagggcgacaaggugaacgggcacuccauccacaagaucgagagccacuucaacaccuccuggaugagcugggacggcugcgaccuggacuacuucugcaacaugggggacuggcccuccugcacguacaccggcgugacccagcacaaccgcgcggccuucgucaacaugcucaacaucgagaccgacuacacgaagaccuuccacuuccacagcaagcgggugaccgcccacggggacacgccccagcuggaccugaaggcccgcccgaccuacggcgcgggcgaggugaccguccucguggagguggccgaccuggagcugcacaccaagaagaucgaggucuccgggcucaaguucgccagccugaccugcuccggcugcuacgccugcagcuccgggaucagcugcaaggugcggauccacgucaacgagcccgacgaguucacggugcacgucaagagcaacgaccccgacgugguggccgcgggcuccagccugauggcccgcaagaucgaguucggggccgacuccaccuucaaggccuucagcuccaugcccaagaacagccucugcuucuacaucguggagcgggacuacugcuccagcugcaccgacgacgacacccagaagugcgucaacaucaagcuggagcacccgcaguccauccugaucgagcacaagggcacgaucaucggcaagcagaacgacacgugccccaccaagaccagcugcuggcucgaguccgucaagagcuucuucuacgggcugaagaacaugcugggcgggaucuucggcaacguguuccucgggaucuuccuguuccuggcccccuucgcgcuccugauccuguucuucuucuucggcuggcgccuccuguucugccugaagugcugccggcgcacccgcggccuccugaaguacaagcagcugaaggacgaggaggaggccggguacaagaagaucaucgagcggcucaacgacaagaagggcaagucccgccuguucgacggggagcggcuggccgaccgcaagaucgccaagcuguucagcaccaagacccacaucggc

SEQ ID NO: 12103 - RNA, 3495 nt, Artificial Sequence
  derived and/or modified CDS sequence (opt1) from CCHVF(CCHVF SPU128/81/7)__DQ157174.1__Gn-NSm-Gc
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggucaaguccuucaagcucugcgagaacagcgccacgggcaaguccugcgagaucgagagcgugcccgugaagugccgccagggguacugccugcggaucacccaggagggccgcgggcacgucaagcugucccggggcagcgagguggugcucgacgcgugcgacaccuccugcgagaucaugauccccaaggggaccggcgacauccuggucgacugcagcggcgggcagcagcacuuccugaaggacaaccucaucgaccugggcugccccaagaucccgcugcucgggaagauggccaucuacaucugccgcauguccaaccaccccaagacgaccauggccuuccuguucugguucagcuucggcuacgugaucacgugcauccugugcaaggccaucuucuaccuccugaucaucaucggcacccuggggaagcgguucaagcaguaccgcgagcucaagccccagaccugcaccaucugcgagaccacccccgugaacgccaucgacgcggagaugcacgaccugaacugcuccuacaacaucugcccguacugcgccagccggcugacguccgacggccucgcccgccacgucacccagugccccaagcggaaggagaagguggaggagaccgagcuguaccugaaccucgagcgcauccccugggugguccggaagcugcuccaggugagcgaguccaccgggguggcccucaagcgcagcagcuggcugaucguccugcucgugcuguucacggugucccugagccccguccaguccgcgccgaucggccacgggaagaccaucgaggccuaccgggcccgcgagggcuacaccagcaucugccucuucgugcugggcuccauccuguucaucgugagcugccucaugaaggggcuggucgacuccgugggcaacagcuucuuccccgggcuguccaucugcaagaccugcagcaucuccagcaucaacggcuucgagaucgagucccacaagugcuacugcagccucuucugcugccccuacugccggcacugcuccgccgacaaggagauccacaagcugcaccugagcaucugcaagaagcgcaagacgggguccaacgugaugcucgccgucugcaagcggaugugcuuccgcgcgaccauggaggugagcaaccgcgcccuguucauccgguccaucaucaacaccaccuucguccugugcauccucauccuggccgugugcguggucagcacgagcgccguggagauggagaaccugcccgccggcaccugggagcgcgaggaggaccucaccaacuucugccaccaggagugccaggugaccgagacggagugccugugcccguacgaggcgcugguccugcggaagccccucuuccuggacuccaucgugaagggcaugaagaaccugcucaacagcaccucccuggagaccagccuguccaucgaggcccccuggggcgccaucaacgugcagagcaccuacaagcccacggucuccaccgccaacaucgcccucagcugguccagcguggagcaccgcgggaacaagauccugguguccgggcggagcgaguccaucaugaagcuggaggagcgcaccggcaucagcugggaccucggggucgaggacgcguccgagagcaagcugcugaccguguccgugauggaccucagccagauguacagcccggucuucgaguaccuguccggcgaccgccagguggaggaguggcccaaggcgaccugcacgggcgacugccccgagcggugcgggugcaccagcuccacgugccugcacaaggaguggccccacagccggaacuggcgcugcaacccgaccuggugcuggggcguggggaccggcugcacgugcugcggccucgacgucaaggaccuguucaccgacuacauguucgugaaguggaagguggaguacaucaagaccgaggccaucgucugcguggagcugaccucccaggagcggcagugcagccucaucgaggccgggacccgcuucaaccugggccccgugaccaucacccuguccgagccccggaacauccagcagaagcugcccccggagaucaucacgcugcacccccgcaucgaggagggguucuucgaccugaugcacguccagaaggugcucagcgccuccaccgugugcaagcugcagagcugcacccacggcguccccggggaccuccagguguaccacaucggcaaccugcugaagggcgacaaggugaacgggcaccugauccacaagaucgagccgcacuucaacaccuccuggaugagcugggacggcugcgaccucgacuacuacugcaacaugggggacuggcccuccugcacguacaccggcgucacccagcacaaccacgccagcuucgugaaccugcugaacaucgagaccgacuacacgaagaacuuccacuuccacuccaagcgggugaccgcccacggggacacgccccagcucgaccugaaggcccgccccaccuacggcgccggcgagaucaccguccugguggagguggcggacauggagcuccacaccaagaagaucgagaucagcgggcugaaguucgccucccugaccugcaccggcugcuacgccugcagcuccgggaucagcugcaagguccggauccacguggacgagccggacgagcucacggugcacgucaagagcgacgaccccgacgugguggccgccuccagcucccugauggcgcgcaagcuggaguucggcaccgacagcaccuucaaggccuucuccgccaugcccaagaccagccucugcuucuacaucgucgagcgggagcacugcaaguccugcagcgaggaggacacgaagaagugcgugaacaccaagcuggagcagccccaguccauccugaucgagcacaaggggaccaucaucggcaagcagaacagcacgugcaccgccaaggccuccugcuggcucgagagcgugaaguccuucuucuacggccugaagaacaugcugagcgggaucuucggcaacgucuucaucgggaucuuccucuuccugggcccguucauccugcucauccuguucuucauguucggguggcgcauccuguucugcuucaagugcugccgccggacccgcggccuccugaaguaccggcaccugaaggaggacgaggagaccggcuaccgccggaucaucgagcgccucaacaacaagaaggggaagaacaagcugcuggacggcgagcggcucgcggaccgccggaucgccgagcuguucuccaccaagacccacaucggg

SEQ ID NO: 12104 - RNA, 3495 nt, Artificial Sequence
  derived and/or modified CDS sequence (opt1) from CCHVF(CCHVF ROS/HUVLV-100)__DQ206448.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugaccgugucccugagcccggugcaguccgcccccgucggccacgggaagacgaucgagaccuaccagacccgcgagggcuucaccagcaucugccucuucaugcugggcuccauccuguuccucgugagcugccuggugaaggggcuggucgacuccgugagcgacuccuucuuccccggccucagcgugugcaagacgugcuccaucgggagcaucaacggcuucgagaucgagucccacaagugcuacugcagccuguucugcugccccuacugccggcacugcuccgccgaccgcgagauccaccagcugcaccucagcaucugcaagaagcggaagaccggguccaacgucaugcuggccgugugcaagcgcaugugcuuccgggccaccaucgaggcgagccgccgcgcccugcucauccgguccaucaucaacaccacguucgucaucugcauccugacccugaccaucugcguggugagcaccagcgccgucgagauggagaaccucccguccggcacgugggagcgcgaggaggaccugaccaacuucugccaccaggagugccaggugaccgagaccgagugccugugccccuacgaggcccuggugcuccggaagccccuguuccuggacagcaucgucaagggcaugaagaaccuccugaacuccacgagccuggagaccucccucagcaucgaggcccccuggggcgcgaucaacgugcaguccaccuucaagccgaccgugagcaccgccaacaucgcccuguccuggagcuccgucgagcaccgcgggaacaagauccuggugacggggcggagcgaguccaucaugaagcucgaggagcgcaccggcgugagcugggaccugggggucgaggacgccuccgagagcaagcugcucaccguguccaucauggaccugagccagauguacagccccguguucgaguaccuguccggcgaccggcaggucgaggaguggcccaaggcgaccugcacgggcgacugccccgagcgcugcgggugcaccagcuccacgugccuccacaaggaguggccgcacagccggaacuggcgcugcaaccccaccuggugcuggggcguggggaccggcugcacgugcugcggcguggacgucaaggaccuguucaccgaccacauguucgugaaguggaagguggaguacaucaagaccgaggccaucgucugcguggagcugaccucccaggagcggcagugcagccucaucgaggccgggacccgcuucaaccugggccccgugaccaucacccuguccgagccccggaacauccagcagaagcucccgcccgagaucaucacgcugcaccccaaggucgaggagggguucuucgaccugaugcacgugcagaaggugcucagcgccuccaccgucugcaagcugcagagcugcacccacggcaucccgggggaccuccagguguaccacaucggcaaccuccugaagggcgaccgcgugaacgggcaccugauccacaagaucgagccccacuucaacaccuccuggaugagcugggacggcugcgaccucgacuacuacugcaacaugggggacuggcccuccugcacguacaccggcgucacccagcacaaccacgccgccuucgugaaccugcugaacaucgagaccgacuacacgaagaccuuccacuuccacagcaagcgggugaccgcgcacggggacacgccccagcucgaccugaaggcccgcccgaccuacggcgccggcgagaucaccguccugguggagguggccgacauggagcuccacaccaagaaggucgagaucuccgggcugaaguucgcgagccuggccugcaccggcugcuacgccugcuccagcgggaucuccugcaaggugcggauccacguggacgagcccgacgagcucacgguccacgucaagagcagcgaccccgacgugguggccgccuccaccagccugauggcgcgcaagcuggaguucggcaccgacuccaccuucaaggccuucagcgccaugcccaagacgucccucugcuucuacaucguggagcgggaguacugcaagagcugcuccgaggaggacacccagaagugcguggacaccaagcuggagcagccgcagagcauccugaucgagcacaaggggaccaucaucggcaagcagaacgacacgugcaccgccaaggccuccugcuggcucgagagcgucaaguccuucuucuacggccugaagaacaugcuggggagcguguucggcaacuucuucaucgggauccuccuguuccuggcgcccuucgugcuccugguccuguucuucauguucggcuggaagauccucuucugcuucaagugcugccgccgcacccgggggcugcugaaguaccgccuccugaaggacgacgaggagaccggcuaccggcgcaucaucgagcggcugaacaacaagaagggcaagaaccgccuccuggacggggagcggcuggccgaccgcaagaucgccgagcuguucuccaccaagacgcacaucggc

SEQ ID NO: 12105 - RNA, 3495 nt, Artificial Sequence
  derived and/or modified CDS sequence (opt1) from CCHVF(CCHVF AP92)__DQ211625.1__Gn-NSm-Gc
agcgagggcggggacggcgggugcaucucccgcacccagcugaucaagaccgagacggccgaggugcacggcgacgacuacgggggccccggcgagaagaucaccaucugcaacgggagcaccaucgucgaccagcggcucggcuccgagcuggggugcuacaccaucaaccgcaucaagagcuucaagcugugcgagaacuccgcccagggcaagaacugcgagaucgacagcgcgccggugcagugccggcagggguacugccucaagaucucccaggagggccgcggccacgugaagcugagccggggguccgagaucguccuggacgugugcgacacgagcugcgagaucaugauccccaagggcaccggggacauccucguggacugcuccggcggccagcagcacuuccugcagagcaaccuggucgaccucgggugccccaacaucccccugcugggcaagauggccaucuacaucugccgcauguccaaccacccgaagaccaccauggccuuccucuucugguucagcuucggguacgugaucacgugcauccugugcaagacccuguucuacauccucaucaucaucggcacccuggggaagaagcugaagcaguaccgggagcucaagccccagaccugcacgaucugcgaguccgugcccgucaacgccaucgacgccgagaugcacgaccugaacugcagcuacaacaucugccccuacugcgcgucccgccugaccagcgagggccucacccggcacgugaaccagugcccgaagcgcaaggagaagguggaggagaccgagcuguaccugaaccucgagcggauccccuggaucguccgcaagcugcugcagguguccgagagcacgggcguggcccucaagcggagcuccuggaugaucguccugcugauccuccugaucgugagcaugucccccgugcagagcgcccccaucucccaggagcgcaccgucgcccuguaccagagccgggaggacuacauggggaucugccucgugaucaugggcuccgugcugcuggcggucagccuccuggugcgcgggcugaucgacuccaucagcuccaccuucuucccgggccucagcgugugccggaccugccacaucggguccaucaacggcuucgagaucgagagccacaagugcuacugcggccugcugugcugccccuacugccgcgccugcuccacggaccaggacgcccaccaguuccaccucagcgucugcaagaagcggaaggccggguccaacgugaugcuggccgucugcaagcgcaugugcuucaaggcgaucaucgaggccagcaacaaggugcuguucauccggaacgugaucaacaccaccuucgucgugugcauccucgugauggucgccugcaucgccuccagcgccgcgguggagauggagaaccugcccgccggcaccugggagcgcgaggaggagcugacgaacuucugccaccaggagugccaggugaccgagaccgagugccucugccccuacgagagcuucauccugcgcaagccgcuguuccuggacuccaucgccaagggggucaagaaccuccugaacagcaccucccuggagacgagccucuccaucgaggcccccuggggcgccaucaacgcgcagagcaccuacaagcccaccgccuccagcgccaacaucgcccugaccugguccagcguggagcaccgggggaacaagauccugguguccggccgcagcgaguccaucaugaagcucgaggagcggacgggcaucagcuggaaccugggggucgaggacgccuccgagagccgcacccugaccaucuccgugauggaccucagccagauguacagccccguguucgaguaccuguccggcgaccggcaggucgaggaguggccgaaggcgaccugcacggggaacugccccgagcgcugcggcugcaccagcuccaccugccuguacaaggaguggccccacagccggaacuggcgcugcaaccccaccuggugcuggggcguggggaccggcugcacgugcugcgggcucgacgugaaggagcuguucaccgaccacaugcuggucaaguggaagguggaguacaucaagaccgaggccaucgugugcgucgagcucaccucccaggagcggcagugcagccugaucgaggccggcacgcgcuucucccuggggccggugaccaucacccucagcgagccccggaacauccagcagaagcugccccccgagcugaucacccuccacccgaagaucgaggacggcuacuucgaccugaugcacgugcagaaggucauguccgccagcacggugugcaagcugcaguccugcacccacggcgugcccggggaccuccagaucuaccacgucggcaaccugcugaagggggaccgcgugaacggccaccucauccacaagguggagccccaccugaacaccagcuggauguccugggacgggugcgaccuggacuacuucugcaacaugggcgacuggccgagcugcaccuacacgggcgucacccagcacaaccacgcggccuucgccaaccuccugaacaucgagaccgacuacaccaagacguuccacuuccacuccaagcgggugaccgcccacggggacaccccccagcuggaccucaaggcccgcccccgguacggcgcgggggagaucaccgugcuggucgagguggccgacauggagcugcacacgaagaagguggaggucaccggccucaaguucgccagccugaccugcuccgggugcuacgccugcagcuccggcaucagcugcaaggugcgcauccacguggacgagcccgacgagcugaccguccacgugaagagcuccgacccggacaucguggccgcgagcuccagccucauggcccggaagaucgaguucggcgucgacuccacguucaaggccuucagcuccaugcccaaggacagccugugcuucuacaucguggagcgcgacuacugcaacuccugcaagaacgaggagacccagcggugcgugaacgccaagcuggagcagccccagagcauccucaucgagcacaccgggaccaucaucggcaagcagaacgacacgugcgggucccgcaccagcugcuggcuggacuccuucaagagcuucuucuacggccugaaguccaugcucagcgggaucuucggcaacgucuuccugggcaucuuccuguuccucgcccccuucgcgcugcugcucuucuucuucuucuucggguggcgcauccuguucugcuucaagugcugccggcgcacccggggccuguucaaguaccgccacaucaaggacgacgaggaggugggguacaagaagaucaucgagcggcucaacaacaagaagggcaagcaccgccugcuggacggcgagcggcucgccgaccgcaagaucgccgagcuguucuccaccaagacgcacaucggg

SEQ ID NO: 12106 - RNA, 3495 nt, Artificial Sequence
  derived and/or modified CDS sequence (opt1) from CCHVF(CCHVF ArD8194)__DQ211626.1__Gn-NSm-Gc
gccgagggcgggagcaacgacugcgugucccgcacccagcuggucaagaccgagguggccgagauccacgaggacagcuacggcgggcccggcgagaagaucacgaucugcaacggguccaccaucguggaccagcggcucggcagcgagcugggcugcuacaccaucaaccgcguccggaccuacaagcugugcgagaacuccgcgacggagaaguccugcgagaucgacagcgugccggugaagugcaagcagggguucugccucaagaucacccaggagggccgcgggcacgucaagcugagccggggcaccgagaucgugcuggacgugugcgacaccuccugcgagcucaugauccccaaggggacgggcgacauccuggucgacugcagcggcgggcagcagcacuuccugcaggacaaccucaucgaccugggcugccccaacaucccccugcucgggcgcaccgccaucuacgugugccggauguccaaccacccgaagaccaccauggccuuccuguucugguucagcuucggcuacgugaucacgugcgucgugugcaaggugcuguucuaccuccugaucgucaucggcacccuggggaagcgccucaagcaguaccgggagcugaagccccagaccugcaucgugugcgaguccauccccgugaacgccaucgacgccgagaugcacgaccugaacugcaacuacaacaucugccccuacugcgcgagccgccucaccuccgacggccugguccggcacgugacgcagugcccgaagcgcaaggagaagguggaggagaccgagcuguaccucaaccuggagcggauccccuggcugguccgcaagcuccuccaggugagcgaguccaccgggguggcccugaagcggagcugcuggaugaucacccuccugauccugcucacggucuccaugagccccgugcagagcgcccccgucggccacaagcgcgccguggagguguaccagaugcgggaguccuacaccgggaucugccuguucguccugggcagcgugcuguucgcgguguccuggcuggucaaggcccugaucgacagcaucggcaacuccuucuucccggggcucagcaucugcaagaccugcuccaucggcagcaucaacggguucgagaucgagucccacaagugcuacugcagccuguucugcugccccuacugccgcgccugcuccagcgacaagaucacccaccggaugcaccugaacgugugcaagaagcgcaaggugggcuccaacgucaugcucgccgugugcaagcggaugugcuucaaggccacgaucgaggcgagcaaccgcgccaccuucauccgcaacaucaucaacuccaccuucgugaucugcauccugauccuggucaucugcguggugagcaccuccgccgucgacauggagaaccuccccgccgggaucugggagaaggaggaggaccugacgaacuucugccaccaggagugccaggugaccgagaccgagugccugugccccuacgaggcccucaugcugcggaagccgcuguuccuggaccgcaucgcgaagggcaugaagucccuccugaacagcaccagccuggagacgagccucuccaucgaggcccccuggggcgccaucaacgugcagagcaccuucaagcccaccgucuccgccgccaacaucgcgcugagcugguccagcguggagcacaaggggaacaagauccugguguccggccggagcgaguccaucaugaagcucgaggagcgcaccgggaucagcuggugccugggcgucgaggacgccuccgagagcaagacgcugaccguguccgugauggaccucagccagauguacucccccgucuucgaguaccugagcggggaccgccagguggaggaguggccgaaggcgaccugcaccggcgacugccccgagcggugcggcugcaccuccagcacgugccugcacaaggaguggccccacagccggaacuggcgcugcaaccccaccuggugcuggggcguggggaccgggugcacgugcugcggccucgacgucaaggaccuguucaccgacuacaugcuggugaaguggaagguggaguacaucaagaccgaggccaucaucugcgucgagcucaccucccaggagcggcagugcagccugaucgaggccggcacccgcuucaaccuggggccggugacgaucacccucuccgagccccggaacgugcagcagcgccugccgcccgagaucaucacccugcaccccaagaucgaggagggcuucuucgaccucaugcacguccagaaggugaugagcgccuccaccgugugcaagcugcagagcugcacgcacgggguccccggcgaccuccagguguaccacguggggaaccuccugaagggcgacaaggucaacggccacuccauccacaagaucgagagccaccugaacaccuccuggaugagcugggacgggugcgaccucgacuacuucugcaacaugggcgacuggcccuccugcaccuacaccggggugacgcagcacaaccacgccgccuucaucaacaugcugaacaucgagaccgacuacaccaagaccuuccacuuccacagcaagcgggugacggcccacggcgacaccccgcagcuggaccucaaggcgcgccccgccuacggggccggcgagaucaccguccugguggagguggccgaccuggagcuccacaccaagaagaucgaggucuccggccugaaguucgccagccuguccugcagcgggugcuacgcgugcuccagcggcaucuccugcaaggugcggauccacgugaacgagcccgacgaguucacgguccacgucaagagcaacgaccccgacgugguggccgccgggagcucccucauggcccgcaagaucgagagcggcgccgacuccaccuucaaggcguucagcuccaugccgaagaacagccugugcuucuacaucguggagcgggacuacugcuccagcugcaccgacgacgacacccagaagugcgucgacaucaagcuggagcacccccaguccauccucaucgagcacaaggggacgaucaucggcaagcagaacgacacgugccccaccaagaccagcugcuggcuggaguccaucaagagcuucuucuacggccugaagaacaugcucuccgggaucuucggcaacguguuccuggggaugcugcuguuccuggcccccuucauccugcucauccuguucuucuucuucggcuggcgccugcuguucugccugaagugcugccggcgcacccgcaagcugcucaaguacaagcaccuccgggacgaggaggagagcggguacaagaagaucaucgagcgccugaacgacaagaagggcaagucccgccucuucgacggcgagcggcuggccgaccggaagaucgccgagcuguucagcaccaagacccacaucggg

SEQ ID NO: 12107 - RNA, 3495 nt, Artificial Sequence
  derived and/or modified CDS sequence (opt1) from CCHVF(CCHVF ArD15786)__DQ211627.1__Gn-NSm-Gc
gccgagggcgggagcaacgacugcgugucccgcacccagcuggucaagaccgaggugacggagauccacgaggacagcuacggcgggcccggcgagaagaucaccaucugcaacggguccaccaucguggaccagcggcucggcagcgagcugggcugcuacaccaucaaccgcguccggacguacaagcugugcgagaacuccgccaccgagaagagcugcgagaucgacuccgugccggugaagugcaagcagggguucugccucaagaucacccaggagggccgcgggcacgucaagcugagccggggcaccgagaucgugcuggacgugugcgacacguccugcgagcucaugauccccaaggggaccggcgacauccuggucgacugcagcggcgggcagcagcacuuccugcaggacaaccucaucgaccugggcugccccaacaucccccugcucgggcagaccgcgaucuacgugugccgcauguccaaccacccgaagaccacgauggccuuccuguucugguucagcuucggcuacgugaucaccugcgucgugugcaaggugcuguucuaccuccugaucgucaucggcacccuggggaagcggcucaagcaguaccgcgagcugaagccccagaccugcaucgugugcgaguccauccccgugaacgccaucgacgccgagaugcacgaccugaacugcaacuacaacaucugccccuacugcgccagccggcucacguccgacggccugguccgccacgugacccagugcccgaagcggaaggagaagguggaggagaccgagcuguaccucaaccuggagcgcauccccuggcugguccggaagcuccugcaggugagcgaguccaccgggguggcgcugaagcgcagcugcuggaucaucacgcuccugauccugcucaccgucuccaugagccccgugcagagcgcccccgucggccacaagcgggccguggagguguaccagauccgcgaguccuacaccgggaucugccuguucguccugggcggcgugcucuucgccgugagcuggcuggucaaggcgcugaucgacuccaucgggaacagcuucuucccgggccucuccaucugcaagaccugcagcaucggguccaucaacggcuucgagaucgagagccacaagugcuacugcucccugcugugcugccccuacugccgggccugcagcuccgacaagaucacgcaccgcaugcaccucaacgugugcaagaagcggaagguggggagcaacgucaugcuggccgugugcaagcgcaugugcuucaaggccaccaucgaggccaacaaccgggcgaccuucauccgcaacaucaucaacuccaccuucgugaucugcauccugauccucgucaucugcguggugagcacguccgccgucgacauggagaaccugcccgccggcaucugggagaaggaggaggaccugaccaacuucugccaccaggagugccaggugaccgagaccgagugccucugccccuacgaggcccugaugcugcgcaagccgcugagccucgacuccaucgccaagggcaugaagagccugcugaacuccacgagccucgagaccagccuguccaucgaggcgcccuggggggccaucaacgugcagagcaccuucaagcccaccaucuccgccgccaacaucgcccugagcugguccagcgucgagcacaagggcaacaagauccucguguccgggcggagcgaguccaucaugaagcuggaggagcgcacgggcaucagcuggugccuggggguggaggacgcguccgagagcaagacccucaccgucuccgugauggaccugagccagauguacucccccguguucgaguaccugagcggcgaccggcaggucgaggaguggccgaaggccaccugcaccggcgacugccccgagcgcugcgggugcacguccagcaccugccuccacaaggaguggccccacagccggaacuggcgcugcaaccccaccuggugcuggggcguggggaccggcugcacgugcugcggccuggacgugaaggaccuguucaccgacuacaugcucgucaaguggaagguggaguacaucaagaccgaggccaucaucugcguggagcugaccucccaggagcggcagugcagccugaucgaggccgggacgcgcuucaaccucggcccggucaccaucacccuguccgagccccggaacgugcagcagcgccugccccccgagaucaucacccuccacccgaagaucgaggagggguucuucgaccugaugcacgugcagaaggucaugagcgccuccacggugugcaagcugcagagcugcacccacggcgugcccggggaccuccaggucuaccacgugggcaaccugcugaagggcgacaaggugaacgggcacuccauccacaagaucgagagccaccucaacaccuccuggaugagcugggacggcugcgaccuggacuacuucugcaacaugggggacuggcccuccugcaccuacacgggcgucacccagcacaaccgggcggccuucaucaacaugcugaacaucgagaccgacuacaccaagacguuccacuuccacagcaagcgcgugaccgcccacggggacaccccgcagcucgaccugaaggcccggcccaccuacggcgcgggcgagaucacggugcuggucgagguggccgaccucgagcugcacaccaagaagaucgagguguccgggcugaaguucgccagccucaccugcuccggcugcuacgccugcagcuccgggaucagcugcaagguccgcauccacgugaacgagcccgacgaguucaccgugcacgucaaguccaacgaccccgacgugguggccgcgggcagcagccugauggcccggaagaucgaguccggggccgacagcacguucaaggccuucuccagcaugccgaagaacucccugugcuucuacaucgucgagcgcgacuacugcagcuccugcaccgacgacgacacccagaagugcguggacaucaagcucgagcacccccagagcauccugaucgagcacaagggcaccaucaucggcaagcagaacgacacgugccccaccaagaccuccugcuggcuggagagcaucaaguccuucuucuacgggcucaagaacaugcugagcggcaucuucgggaacaucuuccugggcaugcuccuguuccuggcccccuucguccuccugauccuguucuucuucuucggguggcggcuccuguucugccugaagugcugccgccggacccgcaagcuccugaaguacaagcaccugcgcgacgaggaggaguccggcuacaagaagaucaucgagcggcucaacgacaagaagggcaagagccgccuguucgacggggagcggcuggcggaccgcaagaucgccgagcucuucuccacgaagacccacgugggc

SEQ ID NO: 12108 - RNA, 3495 nt, Artificial Sequence
  derived and/or modified CDS sequence (opt1) from CCHVF(CCHVF ArD39554)__DQ211628.1__Gn-NSm-Gc
agcgaguccaacaacaacgacugcgugagccgcacccagcugaucaagaccgagaacgccgagauccacggcgacgacuacgggggccccggggagaagaucacgaucugcaacggcuccaccaucgucgagcagcggcucgggagcgagcugggcugcuacaccaucaaccgcaucaaguccuucaagcugugcgagaacagcgccuccggcaaggggugcgagaucgacagcaccccggugaagugcaagcagggcuucugccucaagaucacgcaggaggggcggggccacgugaagcugucccgcgggagcgagaucauccuggacgucugcgacuccagcugcgagaugaugauccccaagggcuccggcgacauccucguggacugcagcgggggccagcagcacuuccugcaggacaaccugguggaccucgggugccccaacgucccccugcugggcaagauggcgaucuacaucugccggauguccaaccacccgaagaccaccauggccuuccucuucugguucagcuucggcuacgugaucaccugcaucuucugcaaggugaucuucuacguccugaucaucaucgggacgcugggcaagcgcaucaagcaguaccgggagcucaagccccagaccugcaccaucugcgaggccacccccgugaacgccaucgacgccgagaugcacgaccugaacugcuccuacaacaucugccccuacugcgcgagccgccugacguccgaggggcucgugcggcacgucacccagugcccgaagcgcaaggagaagaucgaggagaccgagcuguaccugaaccucgagcggauccccugguucgugcgcaagcugcugcaggugagcgagagcaccggcgucgcccucaagcgguccagcuggcuggugacgcugcucgugcugcugaccgucucccucagccccgugcaguccgcccccaucgggcaggagcgcaccguggucaccuaccaggugcgggagagcuacacgggcaugugccuguucauccugggcuccgugcucuucgccaucagcuggcugaccaaggggcuggucgacuccgugggcaacaucuucuucccggggcucagcgucugcaagaccugcuccaucggcagcaucaacggguucgagaucgagucccacaagugcuacugcagccuguucugcugccccuacugccgcuacugcuccgcggaccggggcgcccaccagagccaccuguccgugugcaagaagcgcaagaccggcagcaacgugaugcucgccgucugcaagcggaugugcuuccgcgccacgcugaagguguccagcgaggcccugaucauccggagcaucaucaacaccaccuucguggucugcauccucauccugguggugugcgucguguccaccagcgcgguggagauggagaaccugcccgccgggacgugggagaaggaggaggaccucaccaacuucugccaccaggagugccaggucaccgagaccgagugccugugccccuacgaggccuucgugcugcgcaagccgcucuuccuggacuccacggccaagagcaugaagucccugcugaacagcaccucccucgagaccagccuguccaucgaggcccccuggggcgcgaucaacgugcagagcaccuucaagcccacggccuccaccgccaacaucgcccugagcugguccagcgucgagcaccgcgggaacaagauccucgugaccggccgguccgagagcaucaugaagcuggaggagcgcaccgggaucuccuggaaccugggcguggaggacgccagcgagagcaagacccucacggucuccgugauggaccugagccagauguacuccaccguguucgaguaccugagcggcgaccggcaggucgaggaguggcccaaggcgaccugcaccggggacugcccggagcgcugcggcugcacguccagcaccugccuccacaaggccuggccccacucccggaacuggcgcugcaaccccaccuggugcuggggggugggcaccggcugcacgugcugcgggcuggacgugaagaaccuguucaccgacuacaugcucaucaaguggaaggucgaguucaucaagaccgaggccaucgugugcguggagcugaccagccaggagcggcagugcucccugaucgaggccggcacgcgcuucaaccucgggcccgucaccaucacccugagcgagccgcggaacauccagcagaagcugccccccgagcucgugacccugcacccccgcguggaggagggcuucuucgaccugaugcacguccagaaggugcucuccgccagcacggugugcaagcugcaguccugcacccacggggucccgggcgaccugcagguguaccacgugggcaaccuccugaagggggacaagaucaacggcaacagcuuccacaagaucgagcccaaccugaacaccuccuggaugagcugggacgggugcgaccucgacuacuacugcaacaugggcgacuggcccuccugcaccuacacgggggucacccagcacaaccacgcggccuucgugaaccugcugaacaucgagaccgacuacaccaagaacuuccacuuccacagcaagcgggugacggcccacggcgagaccccgcagcucgaccugaaggcccgccccaaguacggcgcgggggaggucaccgugcugguggaggucgccgacauggagcuccacaccaagaagaucgagaucuccggccugaaguucgccagccugacgugcaccgggugcuacgccugcagcuccggcaucagcugcaaggugcggcuccacguggacgagcccgacgagcugaccguccacgugaaguccgacgaccccgacguggucgccgcgagcuccagccugauggcccgcaagaucgaguucgggaccgacuccacguucaaggccuucagcuccaugccgaaggacaagcucugcuucuacaucguggagcgggacuacugcagcuccugcagcaaggaggacacccagaagugcgugaacgccaagcuggagcagccccaguccauccugaucgagcacaagggcaccaucaucggcaagcagaacgacaccugcacggucaaggccagcugcuggcucgaguccgugaagagcuucuucuacgggcugaagaacaugcugggcgggaucuucggcaacgucauccucgggaucaucauguuccuggcgcccuucgcccugcuccugcuguucuuccucuucggcuggcgcauccuguucugccugcggugcugccgccggacccgcggccucuucaaguacaagcacaucaaggacgacgaggaguccggguacaagcgcaucaucgagcggcugaacaacaagaagggcaagaacaagcuguucgacggggagcgccucgccgacaagaagaucgccgagcuguucagcaccaagacccacaucggc

SEQ ID NO: 12109 - RNA, 3495 nt, Artificial Sequence
  derived and/or modified CDS sequence (opt1) from CCHVF(CCHVF C-68031)__DQ211629.1__Gn-NSm-Gc
agcgaggaguccggcgacgacugcaucagccgcacccagcugucccggaccgagacggccgagauccacagcgacaacuacgggggccccggggacaagaucaccaucugcaacggcuccaccaucguggaccagcgccucgggagcgagcugggcugcuacaccaucaaccgggucaaguccuucaagcugugcgagaacagcgccacgggcaaguccugcgagaucgacagcaccccgaucaagugccgccagggguucugccucaagaucacccaggagggccgggggcacgugaagcugucccgcggcagcgaggugguccuggacgcgugcgacuccagcugcgagaucaugauccccaaggggaccggcgacauccucguggacugcuccggcgggcagcagcacuuccugaaggacaaccugaucgaccucggcugccccaacaucccccugcuggggaagauggccaucuacaucugccggaugagcaaccacccgaagacgaccauggccuuccucuucugguucuccuucggcuacgugaucacgugcauccugugcaaggucaucuucuaccugcucaucguggugggcacccuggggaagaaguucaagcaguaccgcgagcugaagccccagaccugcaccaucugcgagaccacccccgucaacgccaucgacgccgagaugcacgaccucaacugcagcuacaacaucugccccuacugcgcgucccggcugacgagcgacggccuggcccgccacgugaugcagugcccgaagcggaaggagaagguggaggagaccgagcucuaccugaaccuggagcgcauccccugggucgugcggaagcuccuccaggugagcgaguccaccggggucgcccugaagcgcagcuccuggcucguggugcugcugguccuccugaccgugagccugucccccgugcagagcgcccccaucggccacgggaagacggucgagaccuaccagacccgggagggcuacaccuccaucugccucuucgugcugggcagcauccuguucaucguguccugccucaugaaggggcuggucgacagcgugggcaacuccuucuucccggggcugagcaucugcaagacgugcuccaucggcagcaucaacggguucgagaccgagucccacaagugcuacugcagccucuucugcugccccuacugccgccacugcuccgcggaccgggagauccacaagcugcaccugagcaucugcaagaagcgcaagaccggcuccaacgucaugcucgccgugugcaagcggaugugcuuccgcgccaccguggaggucagcaacaaggcccugcugauccggaacaucaucaacacgaccuucguggugugcauccucauccuggccgucugcguggugagcaccuccgcggucgagauggagagccugcccgccggcaccugggagcgcgaggaggaccucacgaacuucugccaccaggagugccaggugaccgagaccgagugccugugccccuacgaggcccuggugcugcgcaagccccucuucuccgacagcaucgucaaggggaugaagaaccugcugaacuccaccagccucgagacgucccugagcaucgaggcccccuggggcgccaucaacgugcaguccaccuucaagcccaccgugagcgcggccaacaucgcccuguccuggagcuccgucgagcaccgggggaacaagauccucgugagcggccgcuccgagagcaucaugaagcuggaggagcggaccgggaucuccugggaccugggcguggaggacgccagcgagagcaagcuccugaccgucuccaucauggaccugagccagauguacucccccguguucgaguaccucagcggcgaccgccagguggaggaguggccgaaggccacgugcaccggggacugccccgagcggugcggcugcaccuccagcacgugccugcacaaggaguggccccacucccgcaacuggcggugcaaccccaccuggugcuggggcgucgggaccggcugcacgugcugcgggcuggacgugaaggaccucuucaccgacuacauguucgugaaguggaaggucgaguacaucaagaccgaggcgaucgugugcguggagcugaccagccaggagcgccagugcucccugaucgaggccggcacccgguucaaccucgggccggucaccaucacgcugagcgagccccgcaacauccagcagaagcugccgcccgagaucgugacccuccacccgcggaucgaggagggcuucuucgaccugaugcacgugaagaagguccuguccgccagcaccgugugcaagcuccaguccugcacccacggggugcccggcgaccugcaggucuaccacaucggcaaccugcucaagggggacaaggugaacggccaccugauccacaagaucgagccccacuucaacacgagcuggauguccugggacgggugcgaccuggacuacuacugcaacaugggcgacuggccgagcugcuccuacaccggggugacccagcacaaccacgccgccuucgucaacaugcucaacaucgagaccgacuacacgaagaucuuccacuuccacagcaagcgcgugaccgcgcacggcgacacgccccagcuggaccugaaggcccggcccaccuacggcgccggggagaucaccgugcucgucgagguggccgacauggagcugcacaccaagaagaucgagaucuccggccugaaguucgcgagccugaccugcaccgggugcuacgccugcagcuccggcaucagcugcaaggugcgcauccacgucgacgagcccgacgagcugacggugcacgugaaguccgaggacccggacaucgucgccgccagcuccagccugauggcccggaagcucgaguucgggaccgacuccaccuucaaggcguucagcgccaugcccaagaccucccugugcuucuacaucguggagcgcgaguacugcaagagcugcuccaaggaggacacgcagaagugcgugaacaccaagcuggagcagccccagagcauccucaucgagcacaagggcaccaucaucggcaagcagaacgacacgugcaccuccaaggccgggugcuggcuggagagcgucaaguccuucuucuacggccugaagaacaugcucagcgggaucuucggcaacguguucaucgggaucuuccuguuccuggcccccuucauccuccugauccuguucuucauguucggcuggcggauccucuucugcuucaagugcugccgccggacccgcggccuguucaaguaccgccaccugaaggacgacgaggagaccggguaccggaagaucaucgagcgccucaacaacaagaagggcaagaacaagcugcuggacggggagcggcucgccgaccgcaagaucgcggagcuguucuccaccaagacccacaucggc

SEQ ID NO: 12110 - RNA, 3495 nt, Artificial Sequence
  derived and/or modified CDS sequence (opt1) from CCHVF(CCHVF Drosdov)__DQ211630.1__Gn-NSm-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgugaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaagugcuccuacaacaucugcccguacugcgccagccggcugacguccgacggccuggcccgccacgucacccagugccccaagcggaaggagaagguggaggagaccgagcucuaccugaaccuggagcgcauccccuggaucgugcggaagcuccugcaggucagcgaguccaccgggguggcgcugaagcgcagcagcuggcucaucgugcugcugguccuccugacggugucccugagccccgugcaguccgccccggucggccacgggaagaccaucgagaccuaccagacccgggagggcuucacgagcaucugccucuucaugcugggcuccauccuguucaucgugagcugccucgugaaggggcuggucgacuccgugagcgacuccuucuuccccggccugagcgugugcaagaccugcuccaucgggagcaucaacggcuucgagaucgagucccacaagugcuacugcagccucuucugcugccccuacugccgccacuacuccgccgaccgggagauccaccagcugcaccugagcaucugcaagaagcgcaagaccggguccaacgucaugcucgccgugugcaagcggaugugcuucaaggccaccaucgaggcgagccgccgggcccugcugauccgcuccaucaucaacacgaccuucgucaucugcauccucauccuggccaucugcguggugagcaccagcgccgucgagauggagaaccugcccgccggcaccugggagcgcgaggaggaccucacgaacuucugccaccaggagugccaggugaccgagaccgagugccugugcccguacgaggcgcuggugcugcggaagccccucuuccuggacuccaccgucaagggcaugaagaaccugcucaacagcacgucccuggagaccagccuguccaucgaggcccccuggggcgccaucaacgugcagagcaccuucaagcccaccguguccaccgccaacaucgcccucagcugguccagcgucgagcaccgcgggaacaagauccuggugacggggcgguccgagagcaucaugaagcuggaggagcgcaccggcguguccugggaccucggggucgaggacgcgagcgaguccaagcugcugaccgugagcaucauggaccucucccagauguacagcccgguguucgaguaccugagcggcgaccggcaggucgaggaguggcccaaggcgaccugcacgggcgacugccccgagcgcugcgggugcaccuccagcacgugccugcacaaggaguggccccacucccggaacuggcgcugcaacccgaccuggugcuggggcguggggaccggcugcacgugcugcggcguggacgucaaggaccucuucaccgaccacauguucgugaaguggaagguggaguacaugaagaccgaggccaucgucugcguggagcugaccagccaggagcggcagugcucccugaucgaggccgggacccgcuucaaccucggccccgugaccaucacccugagcgagccccggaacauccagcagaagcugcccccggagaucaucacgcuccaccccaagaucgaggagggguucuucgaccugaugcacguccagaaggugcuguccgccagcaccgugugcaagcuccaguccugcacccacggcauccccggggaccugcagaucuaccacaucggcaaccugcucaagggcgaccgcgucaacgggcaccugauccacaagaucgagccgcacuucaacaccagcuggauguccugggacggcugcgaccuggacuacuacugcaacauggggaacuggcccagcugcacguacaccggcgugacccagcacaaccacgccgccuucgugaaccuccugaacaucgagaccgacuacacgaagaccuuccacuuccacuccaagcgggucaccgcccacggggacacgccccagcuggaccucaaggcccgccccaccuacggcgcgggcgagaucaccgugcugguggaggucgccgacauggagcugcacaccaagaagguggagaucagcgggcucaaguucgccucccuggugugcaccggcugcuacgccugcagcuccgggaucagcugcaagguccggauccacguggacgagccggacgagcugacggugcacgucaaguccagcgaccccgacgugguggccgcgagcaccucccucauggcccgcaagcuggaguucggcaccgacagcaucuucaaggccuucuccgccaugcccaagaccagccugugcuucuacaucgucgagcgggaguacugcaaguccugcagcgaggacgacacgaagaagugcguggacaccaagcucgagcagccccaguccauccugaucgagcacaaggggaccaucaucggcaagcagaacgacacgugcaccgccaaggcgagcugcuggcuggaguccgucaagagcuucuucuacggccucaagaacaugcugggguccguguucggcaacuucuucguggggauccuccucuuccuggccccguucgugcugcucguccuguucuucauguucggcuggaagauccuguucugcuucaagugcugccgccggacccgcggccucuucaaguaccgccaccugaaggacgacgaggagaccggguaccggcgcaucaucgagcggcugaacagcaagaagggcaagaaccgccuccuggacggggagcggcuggccgaccgcaagaucgccgagcuguucuccaccaagacccacaucggc

SEQ ID NO: 12111 - RNA, 3495 nt, Artificial Sequence
  derived and/or modified CDS sequence (opt1) from CCHVF(CCHVF Kashmanov)__DQ211631.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugaccgugucccugagcccggugcaguccgcccccgucggccacgggaagacgaucgagaccuaccagacccgcgagggcuucaccagcaucugccucuucaugcugggcuccauccuguuccucgugagcugccuggugaaggggcuggucgacuccgugagcgacuccuucuuccccggccucagcgugugcaagacgugcaccaucggguccaucaacggcuucgagaucgagagccacaagugcuacugcucccuguucugcugccccuacugccggcacugcagcgccgaccgcgagauccaccagcugcaccucuccaucugcaagaagcggaagaccgggagcaacgucaugcuggccgugugcaagcgcaugugcuuccgggccaccaucgaggcgucccgccgcgcccugcucauccggagcaucaucaacacgaccuucgucaucugcauccugacccugaccaucugcgugguguccacgagcgccgucgagauggagaaccucccgagcggcaccugggagcgcgaggaggaccugaccaacuucugccaccaggagugccaggugaccgagacggagugccugugccccuacgaggcccuggugcuccggaagccccuguuccuggacuccaucgucaagggcaugaagaacagccucaacuccaccagccuggagaccucccugagcaucgaggcccccuggggcgcgaucaacgugcaguccaccuucaagccgaccgugagcacggccaacaucgcccucuccuggagcuccgucgagcaccgcgggaacaagauccuggugaccgggcggagcgaguccaucaugaagcuggaggagcgcaccggcgugagcugggaccucggggucgaggacgccuccgagagcaagcugcugaccguguccaucauggaccucagccagauguacagccccguguucgaguaccuguccggcgaccggcaggucgaggaguggcccaaggccacgugcaccggcgacugccccgagcgcugcgggugcaccagcuccacgugccugcacaaggaguggccgcacagccggaacuggcgcugcaaccccaccuggugcuggggcguggggaccggcugcacgugcugcggcguggacgucaaggaccucuucaccgaccacauguucgugaaguggaagguggaguacaucaagaccgaggcgaucgucugcguggagcugaccucccaggagcggcagugcagccugaucgaggccgggacccgcuucaaccucggccccgugaccaucacgcuguccgagccccggaacauccagcagaagcugccgcccgagaucaucacccuccaccccaaggucgaggagggguucuucgaccugaugcacgugcagaaggugcugagcgccuccaccgucugcaagcuccagagcugcacccacggcaucccgggggaccuccagguguaccacaucggcaaccugcucaagggcgaccgcaucaacgggcaccugauccacaagaucgagccccacuucaacacguccuggaugagcugggacggcugcgaccuggacuacuacugcaacaugggggacuggcccuccugcaccuacaccggcgugacccagcacaaccacgccgccuucgucaaccuccugaacaucgagacggacuacaccaagaccuuccacuuccacagcaagcgggugaccgcgcacggggacacgccccagcuggaccucaaggcccgcccgaccuacggcgccggcgagaucaccgugcuggucgagguggccgacauggagcugcacaccaagaagguggagaucuccgggcucaaguucgcgagccuggccugcacgggcugcuacgccugcuccagcgggaucuccugcaagguccggauccacguggacgagcccgacgagcugaccgugcacgucaagagcagcgaccccgacgugguggccgccuccaccagccucauggcgcgcaagcuggaguucggcaccgacuccacguucaaggccuucagcgccaugcccaagaccucccugugcuucuacaucgucgagcgggaguacugcaagagcugcuccgaggaggacacccagaagugcguggacaccaagcucgagcagccgcagagcauccugaucgagcacaaggggaccaucaucggcaagcagaacgacacgugcaccgccaaggccuccugcuggcuggagagcgugaaguccuucuucuacggccucaagaacaugcuggggagcgucuucggcaacuucuucaucgggauccugcuguuccuggcgcccuucgugcugcucgugcuguucuucauguucggcuggaagauccuguucugcuucaagugcugccgccgcacccgggggcuccugaaguaccgccaccugaaggacgacgaggagaccggcuaccggcgcaucaucgagcggcucaacaacaagaagggcaagaaccgccugcuggacggggagcggcucgccgaccgcaagaucgccgagcuguucuccacgaagacccacaucggc

SEQ ID NO: 12112 - RNA, 3495 nt, Artificial Sequence
  derived and/or modified CDS sequence (opt1) from CCHVF(CCHVF Oman)__DQ211632.1__Gn-NSm-Gc
agcgaggaguccggcgaggacugcaucagccgcacccagcugcuccggaccgagacggccgagauccacggggacaacuacggcgggcccggcgacaagaucaccaucugcaacggguccaccaucguggaccagcgccugggcagcgagcugggcugcuacaccaucaaccgggucaaguccuucaagcucugcgagaacagcgccacggggaaguccugcgagaucgacaacaccccggugaagugcaagcagggcuucugccugaagaucacccaggaggggcgcggccacgugaagcugagccgggacuccgaggucgugcucgacgcgugcgacagcuccugcgagaucaugauccccaaggggaccggcgacauccugguggacugcagcggcgggcagcagcacuuccugaaggacaaccucaucgaccugggcugccccaacaucccccugcucgggaagauggccaucuacaucugccgcauguccaaccacccgaagacgaccauggccuuccuguucugguucagcuucggcuacgucaucacgugcauccugugcaaggugaucuucuaccuccugaucguggucggcacccuggggaagaaguucaagcaguaccgggagcucaagccccagaccugcaccaucugcgagaccacccccgugaacgccaucgacgccgagaugcacgaccugaacugcuccuacaacaucugccccuacugcgcgagccgccugacguccgacggccucgcccggcacgugaugcagugcccgaagcgcaaggagaagaucgaggagaccgagcuguaccugaaccucgagcggauccccugggucgugcgcaagcugcuccaggugagcgaguccaccggggucgcccucaagcggagcagcuggcugaucgugcugcucgugcugcugaccgucucccucagccccgugcaguccgcccccaucggccacgggaagacgaucgagaccuaccagacccgcgagggcuacaccagcaucugccuguucgugcugggcuccauccucuucaucgucagccaccugaugaaggggcugguggacuccgugggcaacagcuucuucccggggcucuccaucugcaagacgugcagcaucggcuccaucaacggguucgagaucgagagccacaagugcuucugcucccuguucugcugccccuacugccggcacugcagcgcggacaaggagauccacaagcugcaccucuccaucugcaagaagcgcaaggccggcagcaacgucaugcuggccgugugcaagcggaugugcuuccgcgccaccauggaggucuccaacaaggcccugcucauccggagcgugaucaacaccaccuucguggucugcauccugauccuggcggugugcguggucuccacgagcgccguggagauggagagccuccccgccggcaccugggagcgcgaggaggaccugaccaacuucugccaccaggagugccaggugaccgagacggagugccugugccccuacgaggcccugguccuccggaagccgcuguuccuggacuccaucgccaaggggaugaagaaccuccugaacagcaccucccuggagaccagccucuccaucgaggcgcccuggggcgccaucaacgugcagagcaccuucaagcccacgguguccaccgccaacaucgcccugagcugguccagcgucgagcaccgcgggaacaagauccugguguccggccgcagcgaguccaucaugaagcucgaggagcggaccgggaucagcugggaccugggcguggaggacgccuccgagagcaagcugcucaccgucuccgugauggaccugagccagauguacagccccguguucgaguaccuguccggcgaccgccaggucgaggaguggccgaaggcgaccugcacgggggacugccccgagcggugcggcugcaccagcuccacgugccuccacaaggaguggccccacagccgcaacuggcggugcaaccccaccuggugcuggggcguggggaccggcugcacgugcugcgggcuggacgugaaggaccuguucaccgacuacauguucgucaaguggaagguggaguacaucaagaccgaggccaucgugugcgucgagcucaccucccaggagcgccagugcagccugaucgaggccggcacccgguucaaccuggggccggugaccaucacccucuccgagccccgcaacauccagcagaagcugccgcccgagaucgugacgcugcacccccggaucgaggagggcuucuucgaccucaugcacguccagaaggugcugagcgccuccaccgugugcaagcugcagagcugcacccacgggguccccggcgaccuccagguguaccacaucggcaaccugcugaagggggacaaggugaacggccaccucauccacaaggucgagccccacuucaacaccuccuggaugagcugggacgggugcgaccuggacuacuacugcaacaugggcgacuggccguccugcacguacaccggggugacccagcacaaccacgccgcguucgugaaccugcucaacaucgagaccgacuacacgaagaacuuccacuuccacagcaagcgcgucaccgcccacggcgacacgccccagcuggaccugaaggcccggcccaacuacggcgccggggaggugaccgugcucgucgagguggcggacauggagcugcacaccaagaagaucgagaucuccggccugaaguucgccagccugaccugcaccgggugcuacgccugcuccagcggcaucuccugcaaggugcgcauccacgucgacgagcccgacgagcugaccgugcacgucaagagcgaggacccggacaucguggccgccagcuccagccugauggcgcggaagcucgaguucgggacggacuccaccuucaaggccuucagcgccaugcccaagaccucccugugcuucuacaucguggagcgcgaguacugcaagagcugcuccaaggaggacacccagaagugcgugaacgccaagcuggagcggccccagagcauccucaucgagcacaagggcacgaucaucggcaagcagaacgacacgugcaccgccaaggcguccugcuggcuggagagcgucaaguccuucuucuacgggcugaagaacaugcucagcggcaucuucgggaacguguucaucggcaucuuccuguuccuggcccccuucauccuccugauccuguucuucauguucggguggcgcauccucuucugcuucaagugcugccggcgcacccggggccuguucaaguaccgccaccugaaggacgacgaggagaccggcuaccgcaagaucaucgagcggcucaacaacaagaaggggaagaacaagcugcuggacggcgagcgccucgccgaccggaagaucgccgagcuguucuccaccaagacccacaucggg

SEQ ID NO: 12113 - RNA, 3495 nt, Artificial Sequence
  derived and/or modified CDS sequence (opt1) from CCHVF(CCHVF SPU97/85)__DQ211633.1__Gn-NSm-Gc
agcgaggaguccgacggcgacugcaucagccgcacccagcugcuccggaccgagacggccgagauccacuccgacaacuacgggggccccggggacaagaucaccaucugcaacggcagcaccaucguggaccagcgccugggguccgagcugggcugcuacaccaucaaccgggucaagagcuucaagcucugcgagaacuccgccacgggcaagagcugcgagaucgacuccaccccggugaagugccgccagggguucugccugaagaucacccaggagggccgggggcacgugaagcugagccgcggcuccgagaucguccucgacgcgugcgacagcuccugcgagaucaugauccccaaggggaccggcgacauccugguggacugcagcggcgggcagcagcacuuccugaaggacaaccucaucgaccugggcugccccaacaucccccugcucgggcggauggccaucuacaucugccgcauguccaaccacccgaagacgaccauggccuuccuguucugguucagcuucggcuacgugaucacgugcauccugugcaaggucaucuucuaccuccugaucguggccggcaccguggggaagaaguucaagcaguaccgggagcugcgcccccagaccugcaccaucugcgagaccacccccgucaacgccaucgacgcggagaugcacgaccucaacugcuccuacaacaucugccccuacugcgccagccggcugacguccgacggccuggcccgccacgugaugcagugcccgaagcggaaggagaagaucgaggagaccgagcucuaccugaaccuggagcgcauccccugggugguccggaagcuccuccaggugagcgagagcaccgggguggcccugaagcgcuccagcuggcugaccguccugcuggugcuccugaucgugucccugagccccguccaguccgcgcccaucggccacgggaagacgaucgagaccuaccaggcccgggagggcuacaccagcuucugccucuucauccugggcuccauccuguucaucgugagcugccucgugaaggggcugaucgacuccgucggcaacagcuucuucccggggcuguccaucugcaagaccugcagcaucggcuccgugaacggguucgagaucgagagccacaagugcuacugcucccucuucugcugccccuacugccgccacugcagcgccgaccgggagauccacaagcugcaccuguccaucugcaagaagcgcaagacgggcagcaacgugaugcucgccgucugcaagcggaugugcuuccgcgccaccaucgagguguccaaccgcgcgcugcugauccggagcaucaucaacaccaccuucgccgucugcauccucacgcuggccgugugcguggucagcaccuccgccguggagauggagagccugcccgccggcaccugggagcgcgaggaggaccucaccaacuucugccaccaggagugccaggugacggagaccgagugccugugccccuacgaggcgcugguccugcggaagccccucuuccuggacuccaucgugaaggggaagaagaaccugcucaacagcaccucccuggagaccagccuguccaucgaggcccccuggggcgccaucaacgugcagagcacguucaagcccaccgucuccgccgccaacaucgcgcucagcugguccagcguggagcaccgcgggaacaagauccugguguccggccggagcgaguccaucaugaagcuggaggagcgcaccgggaucagcugggaccucggcgucgaggacgccuccgagagcaagcugcugaccgugagcgugauggaccucucccagauguacagccccgucuucgaguaccuguccggcgaccgccagguggaggaguggccgaaggcgaccugcacgggggacugccccgagcggugcggcugcaccagcuccacgugccugcacaaggaguggccccacagccggaacuggcgcugcaaccccaccuggugcuggggcguggggaccggcugcacgugcugcgggcucgacgucaaggaccuguucaccgacuacauguucgugaaguggaagguggaguacaucaagaccgaggccaucgucugcguggagcugaccucccaggagcggcagugcagccucaucgaggccggcacccgcuucaaccuggggccggugaccaucacccuguccgagccccggaacauccagcagaagcucccgcccgagaucaucacgcugcacccgcgcaucgaggagggcuucuucgaccugaugcacguccagaaggugcucagcgccuccaccgugugcaagcugcagagcugcacccacgggguccccggcgaccuccagguguaccacaucggcaaccugcugaagggggacaaggugaacggccaccugauccacaagaucgagccccacuucaacaccuccuggaugagcugggacgggugcgaccucgacuacuacugcaacaugggcgacuggccguccugcacguacaccggggucacccagcacaaccacgccgccuucgugaaccugcugaacaucgagaccgacuacacgaagaacuuccacuuccacagcaagcgggugaccgcccacggcgacacgccccagcucgaccugaaggcgcgccccaccuacggcgccggggaggucaccgugcugguggaggucgccgacauggagcuccacaccaagaagaucgagaucuccggccugaaguucgccagccuguccugcaccgggugcuacgccugcagcagcggcaucuccugcaaggugcggauccacguggacgagcccgacgagcucaccguccacgucaagagcgaggacccggacaucguggcggccggguccagccugauggcccgcaagcuggaguucggcgccgacuccacguucaaggccuucagcgcgaugcccaagaccucccucugcuucuacaucguggagcgggaguacugcaagagcugcucccgcgaggacacccagaagugcgugaacaccaagcuggagcgcccccagagcauccugaucgagcacaagggcacgaucaucgggaagcagaacgacacgugcaccgccaaggccuccugcuggcucgagagcgugaaguccuucuucuacggccucaagagcaugcuguccgggaucuucggcaacgucuucaucgggaucuuccuguucaucgcccccuucgugcugcugauccucuucuucauguucggcuggcggauccuguucugcuucaagugcugccgccggacccgcggccuguucaaguaccggcaccucaaggacgacgaggagaccggguaccgcaagaucaucgagcggcugaacaacaagaagggcaagaacaagcugcucgacggggagcgccuggccgaccggaagaucgcggagcuguucagcaccaagucccacaucggc

SEQ ID NO: 12114 - RNA, 3495 nt, Artificial Sequence
  derived and/or modified CDS sequence (opt1) from CCHVF(CCHVF SPU103/87)__DQ211634.1__Gn-NSm-Gc
agcgaggaguccagcgacgacugcaucucccgcacccagcugcuccggaccgagacggccgagauccacggcgacaacuacgggggccccggggacaagaucaccaucugcaacggcagcaccaucguggaccagcgccugggguccgagcugggcugcuacaccaucaaccgggucaagacguucaagcucugcgagaacagcgccaccggcaaguccugcgagaucgacagcgugccggugaagugccgccagggguacugccugaagaucacccaggagggccgggggcacgucaagcugucccgcggcagcgagguggugcucgacgcgugcgacaccuccugcgaggucaugauccccaaggggacgggcgacauccugguggacugcagcggcgggcagcagcacuuccugaaggacaaccucaucgaccugggcugccccaagaucccccugcucgggaagauggccaucuacaucugccggauguccaaccacccgaagaccaccauggccuuccuguucugguucagcuucggcuacgugaucacgugcguccugugcaaggccaucuucuaccuccugaucaucgugggcacccuggggaagcgccucaagcaguaccgggagcugaagccccagaccugcaccaucugcgagaccacgcccgugaacgccaucgacgcggagaugcacgaccugaacugcuccuacaacaucugccccuacugcgccagccgccucaccuccgacggccuggcccggcacgucacccagugcccgaagcgcaaggagaagguggaggagaccgagcuguaccucaaccuggagcggauccccugggugguccgccggcugcuccaggugagcgaguccacggggguggcccugaagcgcagcagcuggcugaucguccuccuggugcuguucaccgugucccucagccccguccaguccgcgcccaucagccacggcaagaccguggaggccuaccaggcccgggagggguacaccggcaugugccuguucgugcugggcuccauccucuuccuggucagcugccugaugaaggggcucguggacuccgucggcaacacguucuucccggggcugagcaucugcaagaccugcuccaucagcuccaucaacggcuucgagaucgagagccaccgcugcuacugcucccuguucugcugccccuacugccggcacugcagcgccaacaaggagauccaccagcuccaccuguccaucugcaagaagcgcaagaccgggagcaacgugaugcuggccgugugcaagcggaugugcuuccgcgcgaccauggaggucuccaaccgcgcccucuucauccggagcaucaucaacacgaccuucgugcugugcauccugauccucgccgugugcgucguguccaccagcgccguggagauggagagccugcccgccggcaccugggagcgcgaggaggaccugacgaacuucugccaccaggagugccaggucaccgacaccgagugccugugccccuacgaggcgcucgugcugcggcgcccgcuguuccucgacaacaucgugaagggcaugaagaaccugcugaacuccaccagccucgagacgucccugagcaucgaggcccccuggggcgccaucaacguccaguccaccuacaagcccaccgugagcaccgccaacaucgcccuguccuggagcuccguggagcaccgggggaacaagauccucgucagcgggcgcuccgagagcaucaugaagcuggaggagcggaccggcaucuccugggaccuggggguggaggacgcgagcgaguccaagcuccugacggugagcgucauggaccugucccagauguacagccccguguucgaguaccucagcggcgaccgccagguggaggaguggccgaaggcgaccugcaccggcgacugccccgagcggugcgggugcaccuccagcacgugccugcacaaggaguggccccacucccgcaacuggcggugcaaccccaccuggugcuggggcgucgggaccggcugcacgugcugcggccuggacgugaaggaccucuucaccgacuacauguucgugaaguggaagaucgaguacaucaagaccgaggccaucgucugcguggagcugaccagccaggagcgccagugcucccugaucgaggccgggacccgguucaaccucggcccggugacgaucacccugagcgagccccgcaacauccagcagaagcugcccuccgagaucaucacccuccacccccggaucgaggagggguucuucgaccugaugcacguccagaaggugcugagcgccuccaccgugugcaagcuccagagcugcacgcacggcgucccgggggaccuccagguguaccacaucggcaaccugcugaagggcgacaaggugaacgggcaccugguccacaagaucgagccccacuucaacaccuccuggaugagcugggacggcugcgaccuggacuacuacugcaacaugggggacuggcccuccugcaccuacaccggcgugacgcagcacaaccacgccagcuucgugaaccuccugaacaucgagaccgacuacaccaagaacuuccacuuccacuccaagcgcgucaccgcccacggggacacgccgcagcuggaccucaaggcccggcccaccuacggcgccggcgagaucaccgugcugguggaggucgcggacauggagcugcacaccaagaagaucgagaucagcgggcucaaguucacgucccugaccugcaccggcugcuacgccugcagcuccgggaucagcugcaaggugcgcauccacguggacgagcccgacgagcugaccguccacgucaagagcgacgaccccgacgugguggccgccuccagcucccucauggcccggaagcuggaguucggcacggacagcaccuucaaggcguucuccgccaugccgaagaccagccugugcuucuacaucguggagcgcgaguacugcaaguccugcagcgaggaggacacccagaagugcgugaacacgaagcucgagcagccccaguccauccugaucgagcacaaggggaccaucaucggcaagcagaacaacacgugcaaggcccgcgccggcugcuggcuggagagcgucaaguccuucuucuacgggcucaagaacaugcugagcggcaucuucgggaacguguucaucggcaucuuccuguuccucgcccccuucauccugcugauccucuucuucauguucggguggcggauccuguucugcuucaagugcugccgccggacccgcggccuguucaaguaccggcaccucaaggacgacgaggagaccggcuaccgcaagaucaucgagcggcugaacaacaagaaggggaagaacaagcugcucgacggcgagcgccuggcggaccggcgcaucgccgagcuguucuccaccaagacccacaucggg

SEQ ID NO: 12115 - RNA, 3495 nt, Artificial Sequence
  derived and/or modified CDS sequence (opt1) from CCHVF(CCHVF SPU415/85)__DQ211635.1__Gn-NSm-Gc
agcgaggaguccgacggcgacugcaucagccgcacccagcugcuccggaccgagacgaccgagauccacuccgacaacuacgggggccccggggacaagaucaccaucugcaacggcagcaccaucguggaccagcgccugggguccgagcugggcugcuacacgaucaaccgggucaagagcuucaagcucugcgagaacuccgccaccggcaagagcugcgagaucgacuccaccccggugaagugccgccagggguucugccugaagaucacccaggagggccgggggcacgugaagcugagccgcggcuccgagaucguccucgacgccugcgacagcaacugcgagaucaugauccccaaggggacgggcgacauccugguggacugcuccggcgggcagcagcacuuccugaaggacaaccucaucgaccugggcugccccaacaucccccugcucgggaagauggcgaucuacaucugccggaugagcaaccacccgaagaccaccauggccuuccuguucugguucuccuucggcuacgugaucacgugcauccugugcaaggucaucuucuaccuccugaucguggccggcaccguggggaagaaguucaagcaguaccgcgagcugcggccccagaccugcaccaucugcgagaccauccccgucaacgccaucgacgccgagaugcacgaccucaacugcagcuacaacaucugccccuacugcgcgucccgccugacgagcgacggccuggcccggcacgugaugcagugcccgaagcgcaaggagaagguggaggagaccgagcucuaccugaaccuggagcggauccccugggucgugcgcaagcuccuccagguguccgagagcaccggggucgcccugaagcggagcuccuggcugaccgugcugcuggugcuccugaucgucagccugucccccgugcagagcgcccccaucggccacgggaagacgaucgagaccuaccaggcgcgcgagggcuacaccuccuucugccucuucauccugggcagcauccuguucguggucuccugccucgugaaggggcugaucgacagcgugggcaacuccuucuucccggggcugagcaucugcaagaccugcuccaucggcagcaucaacggguucgagaucgagucccacaagugcuacugcagccucuucugcugccccuacugccggcacugcuccgccgaccgcgagauccacaagcugcaccugagcaucugcaagaagcggaagacgggcuccaacgucaugcucgccgugugcaagcgcaugugcuuccgggccaccaucgaggucagcaaccgcgcccugcugauccgcaacaucaucaacaccaccuucguggugugcauccucacgcuggcggucugcgugguguccaccagcgccgucgagauggagagccugcccgccggcaccugggagaaggaggaggaccucaccaacuucugccaccaggagugccaggugacggagaccgagugccugugccccuacgaggcccuggugcugcggaagccccucuuccuggacuccaucgucaaggggaugaagaaccugcucaacagcaccucccuggagaccagccuguccaucgaggcccccuggggcgcgaucaacgugcagagcacguucaagcccaccguguccgccgccaacaucgcccucagcugguccagcgucgagcaccgcgggaacaagauccugguguccggccggagcgaguccaucaugaagcuggaggagcgcaccgggaucagcugggaccucggcguggaggacgccuccgagagcaagcugcugaccgucuccgugauggaccucagccagauguacagccccguguucgaguaccuguccggcgaccggcaggucgaggaguggccgaaggcgaccugcacgggggacugccccgagcgcugcggcugcaccagcuccacgugccugcacaaggaguggccccacagccggaacuggcgcugcaaccccaccuggugcuggggcguggggaccggcugcacgugcugcgggcucgacgugaaggaccuguucaccgacuacauguucgucaaguggaagguggaguacaucaagaccgaggccaucgugugcgucgagcugaccucccaggagcggcagugcagccucaucgaggccggcacccgcuucaaccuggggccggugaccaucacccuguccgagccccggaacauccagcagaagcucccgcccgagaucaucacgcugcacccgcgcaucgaggagggcuucuucgaccugaugcacgugcagcggguccucagcgccuccaccgugugcaagcugcagagcugcacccacggggugcccggcgaccugcaggucuaccacaucggcaaccuccugaagggggacaaggugaacggccaccugauccacaagaucgagccccacuucaacaccuccuggaugagcugggacgggugcgaccucgacuacuacugcaacaugggcgacuggccguccugcacguacaccggggugacccagcacaaccacgccgcguucgucaaccugcugaacaucgagaccgacuacacgaagaacuuccacuuccacagcaagcgcgugaccgcccacggcgacacgccccagcucgaccugaaggcccggcccaccuacggcgccggggaggugaccguccugguggagguggcggacauggagcuccacaccaagaagaucgagaucuccggccugaaguucgccagccugaccugcaccgggugcuacgccugcuccagcggcaucuccugcaaggucaagauccacguggacgagcccgacgagcucacggugcacgucaagagcgaggacccggacaucguggccgccgggagcucccugauggcgcgcaagcuggaguucggcgccgacagcaccuucaaggccuucuccgccaugcccaagaccagccucugcuucuacaucguggagcgggaguacugcaaguccugcagccgcgaggacacccggaagugcgucaacacgaagcuggaccgcccccaguccauccugaucgagcacaagggcaccaucaucgggaagcagaacaacacgugcaccgccaaggcgagcugcuggcucgaguccgucaagagcuucuucuacggccugaagaacaugcuguccgggaucuucggcaacguguucaucgggaucuuccucuucaucgcccccuucgugcugcugauccucuucuucauguucggcuggcgcauccuguucugcuucaagugcugccggcgcacccggggccuguucaaguaccgccaccucaaggacgacgaggagaccggguaccggaagaucaucgagcgccugaacaacaagaagggcaagaacaagcugcucgacggggagcggcuggccgaccgcaagaucgccgagcuguucagcaccaagucccacaucggc

SEQ ID NO: 12116 - RNA, 3495 nt, Artificial Sequence
  derived and/or modified CDS sequence (opt1) from CCHVF(CCHVF Turkey200310849)__DQ211636.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagguggacagcacccccgugaagugccgccagggguucugccugaagaucacccaggagggccgggggcacgucaagcugucccgcggcagcgagguggugcucgacgcgugcgacuccagcugcgaggucaugauccccaaggggacgggcgacauccugguggacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucagcugcaaggcccuguucuacucccucaucaucaucggcacccuggggaagaagaucaagcaguaccgggagcugaagccccagaccugcaccaucugcgagaccgcccccgucaacgcgaucgacgccgagaugcacgaccucaacugcagcuacaacaucugcccguacugcgccucccgccugacgagcgacggccuggcccggcacgugacccagugccccaagcgcaaggagaagguggaggagaccgagcucuaccugaaccuggagcggauccccuggaucguccgcaagcuccuccagguguccgagagcaccgggguggcgcugaagcggagcuccuggcugaucguccugcuggugcuccugacggugagccugucccccguccagagcgccccggugggccacgggaagaccaucgagaucuaccagacccgcgagggcuucgccuccaucugccucuucaugcugggcagcauccuguucaucguguccugccucgucaaggggcugguggacagcguguccgacagcuucuuccccggccuguccgucugcaagaccugcagcaucggguccgugaacggcuucgagaucgagagccacaagugcuacugcucccucuucugcugccccuacugccggcacugcagcgccgaccgcgagauccaccagcugcaccuguccaucugcaagaagcggaagacggggagcaacgucaugcucgccgugugcaagcgcaugugcuuccgggcgaccaucgaggccucccgccgcgcccugcugauccggagcaucaucaacaccaccuucgugaucugcauccucacgcugaccaucugcgucgugagcaccuccgccguggagauggagaaccugcccgccggcaccugggagcgcgaggaggaccucacgaacuucugccaccaggagugccaggucaccgagaccgagugccugugcccguacgaggcgcuggugcugcggaagccccucuuccuggacagcaucgugaagggcaugaagaaccugcucaacuccaccagccuggagacgucccugagcaucgaggcccccuggggcgccaucaacguccaguccaccuucaagcccgccgugagcaccgccaacaucgcgcucuccuggagcuccguggagcaccgcgggaacaagauccuggucaccgggcggagcgaguccaucaugaagcuggaggagcgcaccggcgugagcugggaccucgggguggaggacgccuccgagagcaagcugcugacggucuccaucauggaccucagccagauguacagcccgguguucgaguaccuguccggcgaccgccagguggaggaguggcccaaggcgaccugcaccggcgacugccccgagcggugcgggugcaccagcuccacgugccugcacaaggaguggccccacagccggaacuggcgcugcaacccgaccuggugcuggggcgucgggaccggcugcacgugcugcggcguggacgugaaggaccucuucaccgaccacauguucgucaaguggaagguggaguacaucaagaccgaggccaucgugugcgucgagcugaccucccaggagcggcagugcagccugaucgaggccgggacccgcuucaaccucggccccgugacgaucacccuguccgagccccggaacauccagcagaagcugcccccggagaucaucacccuccaccccaagaucgaggagggguucuucgaccugaugcacgugcagaagguccugagcgccuccaccgugugcaagcuccagagcugcacgcacggcauccccggggaccuccagguguaccacaucggcaaccugcugaagggcgaccgcgucaacgggcaccugauccacaagaucgagucccacuucaacaccagcuggauguccugggacggcugcgaccuggacuacuacugcaacaugggggacuggccgagcugcaccuacaccggcgugacgcagcacaaccacgccgccuucgugaaccuccugaacaucgagaccgacuacaccaagaccuuccacuuccacuccaagcgggucacggcccacggggacacgccccagcuggaccucaaggcgcgccccaccuacggcgccggcgagaucaccgugcugguggaggucgccgacauggagcugcacaccaagaagguggagaucagcgggcucaaguucgccucccuggccugcaccggcugcuacgcgugcagcuccgggaucagcugcaaggugcggauccacgucgacgagcccgacgagcugaccgugcacgucaagagcuccgacccggacgugguggccgccagcaccucccucauggcccgcaagcuggaguucggcacggacagcaccuucaaggccuucuccgcgaugcccaagaccagccugugcuucuacaucguggagcgggaguacugcaaguccugcagcgaggacgacacccagaagugcgucgacacgcgccucgagcagccccaguccauccugaucgagcacaaggggaccaucaucggcaagcagaacgacacgugcaccgccaaggccagcugcuggcuggaguccgucaagagcuucuucuacggccucaagaacaugcugggguccguguucggcaaccuguucaucgggauccuccuguuccuggcccccuucgugcuccuggugcuguucuucauguucggcuggaagauccucuucugcuucaagugcugccgccggacccgcgggcuguucaaguaccggcaccugaaggacgacgaggagaccggcuaccgccggaucaucgagcgccucaacagcaagaagggcaagaaccggcugcuggacggggaccgccucgccgaccggaagaucgcggagcuguucuccaccaagacccacaucggc

SEQ ID NO: 12117 - RNA, 3495 nt, Artificial Sequence
  derived and/or modified CDS sequence (opt1) from CCHVF(CCHVF Iran-52)__DQ446215.1__Gn-NSm-Gc
agcgaggaguccggcgacgacugcaucagccgcacccagcugcuccggaccgagacggccgaggugcacggggacaacuacggcgggcccggcgacaagaucaccaucugcaacggguccaccgucguggaccagcgccugggcagcgagcugggcugcuacaccaucaaccgggugcgcuccuucaagcucugcgagaacagcgccacggggaaguccugcgagaucgacagcaucccggucaagugcaagcagggcuacugccugaagaucacccaggaggggcggggccacgugaagcugucccgcgggagcgaggugguccucgacgugugcgacuccagcugcgaggugaugauccccaagggcaccggcgacauccuggucgacugcuccgggggccagcagcacuuccugaaggacaaccucguggaccuggggugccccaagaucccccugcucggcaagauggcgaucuacaucugccggaugagcaaccacccgaagaccacgauggccuuccuguucugguucuccuucggcuacgugaucacgugcauccugugcaaggccaucuucuuccuccugaucaucuucgggacccugggcaagcgcuucaagcaguaccgggagcucaagccccagaccugcaccaucugcgagaccacccccgucaacgccaucgacgccgagaugcacgaccugaacugcagcuacaacaucugccccuacugcgcgucccgccugaccagcgacgggcucgcccggcacgugacgcagugcccgcgccggaaggagaagguggaggagaccgagcuguaccugaaccucgagcgcauccccugggucgugcggaagcugcuccagguguccgagagcaccggcaccguccugaagcgcagcuccuggcugaucgugcugcucgugcuguucacggucagccugucccccgugcagagcgcccccaucgggcacggcaagaccaucgagaccuaccgggugcgcgaggaguacaccuccaucugccucuucguccugggcagcauccuguucaucguguccuuccucaugaaggggcuggucgacggcguggggaacaucuucuucccgggccugagcgugugcaagacgugcuccaucgggagcaucaacggcuucgagaucgagucccacaagugcuacugcagccucuucugcugccccuacugccggcacugcuccgccgacggcgagauccaccagcugcaccugagcaucugcaagaagcgcaagaccggguccaacgucaugcucgcggugugcaagcggaugugcuuccgcgccaccauggaggugagcaacaaggcccuguucauccgcuccaucaucaacaccacguucgucgugugcauccugauccucgccgugugcgucgugagcaccuccgccguggagauggagagccugcccgcgggcaccugggagcgggaggaggaccugaccaacuucugccaccaggagugccaggucacggagaccgagugccucugccccuacgaggcccuggugcugcgccggccgcuguuccucgacagcaucgugaaggggaugaagaaccugcugaacuccaccagccucgagaccucccugagcaucgaggcccccuggggcgccaucaacguccaguccacguacaagcccaccgugagcaccgccaacaucgcgcuguccuggagcuccguggagcaccgcgggaacaagguccucgugagcggccgguccgagagcaucaugaagcuggaggagcgcaccggcaucuccugggaccuggggguggaggacgccagcgaguccaagcuccugaccgucagcgugauggaccugucccagauguacagccccguguucgaguaccucagcggcgaccggcaggucgaggaguggccgaaggccacgugcaccggggacugccccgagcgcugcggcugcaccuccagcacgugccugcacaaggaguggccccacucccggaacuggcgcugcaaccccaccuggugcuggggcguggggaccggcugcacgugcugcgggcuggacgugaaggaccucuucaccgacuacauguucgucaaguggaagguggaguacaucaagaccgaggccaucgugugcgucgagcugaccagccaggagcggcagugcucccugaucgaggccggcacccgcuucaaccucgggagcgugaccaucacgcuguccgagccgcggaacauccagcagaagcugccgcccgagaucaucacccuccaccccaagaucgaggagggcuucuucgaccugaugcacgugcagaagguccugagcgcguccaccgugugcaagcuccagagcugcacccacggcgugcccggggaccugcaggucuaccacaucggcaaccugcucaagggggaccgcgugaacggccaccugauccacaagaucgagcagcacuucaacacguccuggaugagcugggacgggugcgaccuggacuacuacugcaacaugggcgacuggcccuccugcaccuacaccggcgugacccagcacaaccacgccagcuucgucaaccuccugaacaucgagacggacuacaccaagaccuuccacuuccacuccaagcgggugaccgcccacggggacacgccccagcuggaccucaaggcccgcccgaccuacggcgccggggagaucaccgugcuggucgagguggcggacauggagcugcacaccaagaagaucgagaucagcggccucaaguucgccgggcugacgugcaccggcugcuacgccugcuccagcggcaucuccugcaaggugcggauccacgucgaggagcccgacgagcugaccgugcacgucaagagcgacgaccccgacgugguggccgcgagcuccagccucauggcccgcaagcuggaguucgggaccgacuccacguucaaggccuucagcgccaugcccaagaccucccugugcuucuacaucguggagcgggaguacugcaagagcugcuccaaggaggacacccagaagugcgucaacaccaagcucgagcagccgcagagcauccugaucgagcacaagggcacgaucaucgggaagcagaacaacacgugcaccgccaaggcguccugcuggcuggagagcgugaaguccuucuucuacggccucaagaacaugcucgggggcaucuucggcaacgucuucaucgggaucuucaccuuccugacccccuucauccugcugauccuguucuucauguucggcuggcgcauccucuucugcuucaagugcugccgccggacccgcgggcuguucaaguaccggcaccugaaggacgacgaggagaccggcuaccgcaagaucaucgagcggcucaacaacaagaagggcaagaaccgccugcuggacggggagcggcucgccgaccgcaagaucgccgagcuguucagcaccaagacccacaucggc

SEQ ID NO: 12118 - RNA, 3495 nt, Artificial Sequence
  derived and/or modified CDS sequence (opt1) from CCHVF(CCHVF Iran-53)__DQ446216.1__Gn-NSm-Gc
agcgaggaguccggcgacgacugcaucagccgcacccagcugcuccggaccgagacggccgaggugcacggggacaacuacggcgggcccggcgacaagaucaccaucugcaacggguccaccgucguggaccagcgccugggcagcgagcugggcugcuacaccaucaaccgggugcgcuccuucaagcucugcgagaacagcgccacggggaaguccugcgagaucgacagcaucccggucaagugcaagcagggcuacugccugaagaucacccaggaggggcggggccacgugaagcugucccgcgggagcgaggugguccucgacgugugcgacuccagcugcgaggugaugauccccaagggcaccggcgacauccuggucgacugcuccgggggccagcagcacuuccugaaggacaaccucguggaccuggggugccccaagaucccccugcucggcaagauggcgaucuacaucugccggaugagcaaccacccgaagaccacgauggccuuccuguucugguucuccuucggcuacgugaucacgugcauccugugcaaggccaucuucuuccuccugaucaucuucgggacccugggcaagcgcuucaagcaguaccgggagcucaagccccagaccugcaccaucugcgagaccacccccgucaacgccaucgacgccgagaugcacgaccugaacugcagcuacaacaucugccccuacugcgcgucccgccugaccagcgacgggcucgcccggcacgugacgcagugcccgcgccggaaggagaagguggaggagaccgagcuguaccugaaccucgagcgcauccccugggucgugcggaagcugcuccagguguccgagagcaccggcaccguccugaagcgcagcuccuggcugaucgugcugcucgugcuguucacggucagccugucccccgugcagagcgcccccaucgggcacggcaagaccaucgagaccuaccgggugcgcgaggaguacaccuccaucugccucuucguccugggcagcauccuguucaucguguccuuccucaugaaggggcuggucgacggcguggggaacaucuucuucccgggccugagcgugugcaagacgugcuccaucgggagcaucaacggcuucgagaucgagucccacaagugcuacugcagccucuucugcugccccuacugccggcacugcuccgccgacggcgagauccaccagcugcaccugagcaucugcaagaagcgcaagaccggguccaacgucaugcucgcggugugcaagcggaugugcuuccgcgccaccauggaggugagcaacaaggcccuguucauccgcuccaucaucaacaccacguucgucgugugcauccugauccucgccgugugcgucgugagcaccuccgccguggagauggagagccugcccgcgggcaccugggagcgggaggaggaccugaccaacuucugccaccaggagugccaggucacggagaccgagugccucugccccuacgaggcccuggugcugcgccggccgcuguuccucgacagcaucgugaaggggaugaagaaccugcugaacuccaccagccucgagaccucccugagcaucgaggcccccuggggcgccaucaacguccaguccacguacaagcccaccgugagcaccgccaacaucgcgcuguccuggagcuccguggagcaccgcgggaacaagguccucgugagcggccgguccgagagcaucaugaagcuggaggagcgcaccggcaucuccugggaccuggggguggaggacgccagcgaguccaagcuccugaccgucagcgugauggaccugucccagauguacagccccguguucgaguaccucagcggcgaccggcaggucgaggaguggccgaaggccacgugcaccggggacugccccgagcgcugcggcugcaccuccagcacgugccugcacaaggaguggccccacucccggaacuggcgcugcaaccccaccuggugcuggggcguggggaccggcugcacgugcugcgggcuggacgugaaggaccucuucaccgacuacauguucgucaaguggaagguggaguacaucaagaccgaggccaucgugugcgucgagcugaccagccaggagcggcagugcucccugaucgaggccggcacccgcuucaaccucgggagcgugaccaucacgcuguccgagccgcggaacauccagcagaagcugccgcccgagaucaucacccuccaccccaagaucgaggagggcuucuucgaccugaugcacgugcagaagguccugagcgcguccaccgugugcaagcuccagagcugcacccacggcgugcccggggaccugcaggucuaccacaucggcaaccugcucaagggggaccgcgugaacggccaccugauccacaagaucgagcagcacuucaacacguccuggaugagcugggacgggugcgaccuggacuacuacugcaacaugggcgacuggcccuccugcaccuacaccggcgugacccagcacaaccacgccagcuucgucaaccuccugaacaucgagacggacuacaccaagaccuuccacuuccacuccaagcgggugaccgcccacggggacacgccccagcuggaccucaaggcccgcccgaccuacggcgccggggaggugaccguccugguggagguggcggacauggagcugcacaccaagaagaucgagaucagcggccucaaguucgccgggcugacgugcaccggcugcuacgccugcuccagcggcaucuccugcaagguccggauccacguggacgagcccgacgagcugaccgugcacgucaagagcgacgaccccgacgugguggccgcgagcuccagccucauggcccgcaagcuggaguucgggaccgacuccacguucaaggccuucagcgccaugcccaagaccucccugugcuucuacaucgucgagcgggaguacugcaagagcugcuccaaggaggacacccagaagugcgugaacaccaagcucgagcagccgcagagcauccugaucgagcacaagggcacgaucaucgggaagcagaacaacacgugcaccgccaaggcguccugcuggcuggagagcgucaaguccuucuucuacggccucaagaacaugcucgggggcaucuucggcaacguguucaucgggaucuucaccuuccugacccccuucauccugcugauccuguucuucauguucggcuggcgcauccucuucugcuucaagugcugccgccggacccgcgggcuguucaaguaccggcaccugaaggacgacgaggagaccggcuaccgcaagaucaucgagcggcucaacaacaagaagggcaagaaccgccugcuggacggggagcggcucgccgaccgcaagaucgccgagcuguucagcaccaagacccacaucggc

SEQ ID NO: 12119 - RNA, 3495 nt, Artificial Sequence
  derived and/or modified CDS sequence (opt1) from CCHVF(CCHVF Kosova Hoti)__EU037902.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccagaagggccgggggcacgugaagcugucccgcggcagcgaggucgugcucgacgcgugcgacuccaacugcgaggugaugauccccaaggggacgggcgacauccuggucgacugcagcggcgggcagcagcacuuccugaaggacaaccucaucgaccugggcugcccccacaucccgcugcucgggaagauggccaucuacaucugccggauguccaaccaccccaagaccaccauggccuuccuguucugguucagcuucggcuacgugaucacgugcaucuucugcaaggcccuguucuacucccucaucaucaucggcacccuggggaagaagaucaagcaguaccgcgagcugaagccccagaccugcaccaucugcgagaccgcccccgugaacgcgaucgacgccgagaugcacgaccucaacugcagcuacaacaucugcccguacugcgccucccggcugacgagcgacggccuggcccgccacgucaagcagugccccaagcggaaggagaagguggaggagaccgagcucuaccugaaccuggagcgcauccccugggugguccggaagcuccuccagguguccgagagcaccgggguggcgcugaagcgcuccagcuggcucaucguccugcuggugcuccugaccgugagccugucccccguccagagcgccccggugggccacgggaagacgaucgagaccuaccagacccgggagggcuucaccuccaucugccucuucaugcugggcagcauccuguucaucguguccugccucgucaaggggcugguggacagcguguccgacagcuucuuccccggccuguccgucugcaagacgugcagcaucggguccaucaacggcuucgagaucgagagccacaagugcuacugcucccucuucugcugccccuacugccgccacugcagcgccgaccgggagauccaccagcugcaccugaacaucugcaagaagcgcaagaccggguccaacgugaugcucgccgucugcaagcggaugugcuuccgcgccaccaucgaggcgagccggcgcgcccugcugauccgcuccaucaucaacaccacguucgugaucugcauccucacccugaccaucugcguggucagcaccuccgccguggagauggagaaccugcccgccggcacgugggagcgggaggaggaccucaccaacuucugccaccaggagugccaggugaccgagaccgagugccugugcccguacgaggcccugguccugcgcaagccccucuuccuggacagcaucgugaagggcaugaagaaccugcucaacagcacgucccuggagaccagccuguccaucgaggcgcccuggggcgccaucaacgugcagagcaccuucaagcccaccgucuccaccgccaacaucgcccucagcugguccagcguggagcaccgggggaacaagauccuggugacggggcgcuccgagagcaucaugaagcuggaggagcggaccggcaucuccugggaccucggggucgaggacgccagcgaguccaagcugcugaccgugagcaucauggaccucucccagauguacagcccgguguucgaguaccuguccggcgaccgccaggucgaggaguggcccaaggcgaccugcacgggcgacugcccccagcggugcgggugcaccagcagcacgugccugcacaaggaguggccccacucccgcaacuggcggugcaacccgaccuggugcuggggcguggggaccggcugcacgugcugcggcguggacgucaaggaccucuucaccgaccacauguucgugaaguggaagguggaguacaucaagaccgaggccaucgucugcguggagcugaccagccaggagcgccagugcucccugaucgaggccgggacccgguucaaccucggccccgugaccaucacccugagcgagccccgcaacauccagcagaagcugcccccggagaucaucacgcuccaccccaagaucgaggagggguucuucgaccugaugcacguccagaaggugcuguccgccagcaccgugugcaagcuccaguccugcacccacggcauccccggggaccugcaggucuaccacaucggcaaccugcucaagggcgaccgggugaacgggcaccugauccacaagaucgagccgcacuucaacaccagcuggauguccugggacggcugcgaccuggacuacuacugcaacaugggggacuggcccagcugcacguacaccggcgugacccagcacaaccacgccgcguucgucaaccuccugaacaucgagaccgacuacacgaagaccuuccacuuccacuccaagcgcgugaccgcccacggggacacgccccagcuggaccucaaggcccggcccaccuacggcgccggcgagaucaccgugcuggucgagguggcggacauggagcugcacaccaagaagguggagaucagcgggcucaaguucgccucccuggccugcaccggcugcuacgccugcagcuccgggaucagcugcaagguccgcauccacguggacgagccggacgagcugacggugcacgucaaguccagcgaccccgacgugguggccgcgggcaccucccucauggcccggaagcuggaguucgggaccgacagcaccuucaaggccuucagcgccaugcccaagacgucccugugcuucuacaucgucgagaaggaguacugcaagagcugcuccgaggacgacaccaagaagugcguggacaccaagcucgagcagccccagagcauccugaucgagcaccgcggcaccaucaucggcaagcagaacgacacgugcaccgccaaggcguccugcuggcuggagagcgugaaguccuucuucuacgggcucaagaacaugcugggcagcgucuucgggaacuucuucaucggcauccuccuguuccuggccccguucgugcugcucgugcuguucuucauguucggguggaagauccuguucugcuucaagugcugccggcgcacccgcggccucuucaaguaccggcaccugaaggacgacgaggagaccggcuaccgccggaucaucgagcgccugaacaacaagaaggggaagaaccggcuccuggacggcgagcgccuggccgaccggaagaucgccgagcuguucuccaccaagacgcacaucggg

SEQ ID NO: 12120 - RNA, 3495 nt, Artificial Sequence
  derived and/or modified CDS sequence (opt1) from CCHVF(CCHVF YL04057)__FJ562094.1__Gn-NSm-Gc
gccgagggcgggagcuccgacugcaucagccgcacccagcuggugaagaccgaggucgccgagauccacgaggacuccuacggcgggcccggcgagaagaucacgaucugcaacgggagcaccaucguggaccagcggcucggccgcgagcugggcugcuacaccaucaaccgggugcgcuccuacaagcugugcgagaacagcgcguccggcaagagcugcgagaucgacuccaucccggucaagugcaagcagggguucugccucaagaucacccaggaggggcggggccacgugaagcugagccgcgggacggagaucgugcuggacgucugcgacuccagcugcgagcucaugauccccaagggcaccggcgacauccugguggacugcuccgggggccagcagcacuuccugcagaacaaccucaucgaccuggggugccccaacgugccccugcucggcaagauggccaucuacgucugccggaugagcaaccacccgaagaccaccauggccuuccuguucugguucuccuucggcuacgugaucacgugcaucgccugccgcgugcuguucuaccuccugaucgccaucgggaccgucggcaagaagcugaagcaguaccgggagcucaagccccagaccugcaucgugugcgagagcgugcccgucaacgcgaucgacgccgagaugcacgagcugaacugcuccuacaacaucugccccuacugcgccagccgccuguccaccgacgggcucauccggcacgugacgcagugcccgaagcgccgggagaagguggaggagaccgagcuguuccugaaccucgagcgcauccccuggcugguccggaagcugcuccaggugagcgagagcaccggcauggcccugaagcgcuccugcuggaugaucacccugcucauccugcugcucgugagcaucucccccguccagagcgcgcccguggggaaggagcgggccaucgagacguaccaggcccgcgagaccuacaccggcaucugccuguucgugcugggcuccguccucuucgccgugagcuggcugaccaaggcccugaucgacgggaucggcaacuccuucuucccggggcucagcgucugcaagacgugcuccaucggcagcaucaacggguucgagaucgagucccacaagugcuacugcagccuguucugcugccccuacugccgggcgugcuccagcgacaagaacacccaccgcaugcaccugaacgugugcaagaagcggaagaugggcuccaacgugaugcucgccgucugcaagcgcaugugcuuccgcgccaccaucgaggccagcaacaaggcccugcugauccgguccaucaucaacagcaccuucgugaucugcauccucauccugacgaucugcguggucuccaccagcgcgguggacauggagaaccugcccgccggcaucugggagaaggaggaggaccucaccaacuucugccaccaggagugccaggugaccgagacggagugccugugccccuacgaggccaugguccugcgcaagccgcuguuccucgacagcaucgccaaggggaagaagucccugcugaacagcaccucccucgagaccagccuguccaucgaggcccccuggggcgcgaucaacgugcagagcaccuucaagcccacgguguccgccgccaacaucgcccugagcugguccagcgucgagcaccgggggaacaagauccucguguccggccgcagcgaguccaucaugaagcuggaggagcggaccggggugagcuggaaccugggcgucgaggacgccuccgagagcaagacccucaccguguccgugauggaccugagccagauguacagccccgucuucgaguaccuguccggcgaccgccagguggaggaguggccgaaggcgacgugcaccggggacugccccgagcggugcggcugcaccagcuccacgugccuccacaaggaguggccccacagccgcaacuggcggugcucccccaccuggugcuggggcguggggaccggcugcacgugcugcgggcuggacgucaaggacuucuucaccgacuacaugcuggugaaguggaagguggaguacaucaagaccgaggccaucgucugcguggagcucaccagccaggagcgccagugcucccugaucgaggccggcacccgguucaaccuggggccggugaccaucacccucagcgagccccgcaacguccagcagcggcugccgcccgagaucgugacgcugcaccccaagaucgaggagggcuucuucgaccucaugcacgugcagaagauccuguccgccagcaccgucugcaagcugcaguccugcacccacggggugcccggcgacuuccagguguaccacgucggcaaccuccugcgcggggacaaggugaacggccacagcauccacaagaucgagccccacuucaacaccuccuggaugagcugggacgggugcgaccuggacuacuucugcaacaugggcgacuggccguccugcacguacaccggggugacccagcacaaccgggcggccuucaucaacaugcucaacaucgagaccgacuacacgaagaccuuccacuuccacagcaagcgcgucaccgcccacggcgacacgccccagcuggaccugaaggcccggcccgccuacggcgcgggggaggugaccgugcucgucgagguggccgaccuggagcugcacaccaagaagcucgagguguccggccugaagaucgccagccugaccugcuccgggugcuacgccugcagcagcggcaucuccugcaagguccgcauccacgugaacgagcccgacgaguucaccgugcacguccggagcuccgacccggacgugguggccgcggggagcucccucauggcccgcaagaucgaguucggcgccgacagcacguucaaggccuucuccagcaugcccaaggacucccugugcuucuacaucgucgagaaggacuacugcagcuccugcaccgacgacgacacccagaagugcgugaacaccaagcuggaccacccccagagcauccucaucgagcacaagggcacgaucaucgggaagcagaacgacacgugcuccaccaagaccagcugcuggcuggaguccgugaagggcuucuucuacgggcugaagaacaugcucagcggcaucuucgggaacgucuuccugggcauccuccuguuccuggcccccuucgugcugcucaucuucuucuucuucuucggcuggcgccugcuguucugccucaagugcugccggcgcacccgggggcugcugaaguacaagcaccucaaggacgaggaggaggcgggcuacaagaagaucaucgagcgccugaacgggaagaagggcaagucccagcuguucgacggcgagcggcucgccgaccgcaagaucgccgagcuguucagcaccaagauccacaucggg

SEQ ID NO: 12121 - RNA, 3495 nt, Artificial Sequence
  derived and/or modified CDS sequence (opt1) from CCHVF(CCHVF V42/81)__GU477490.1__Gn-NSm-Gc
agcaaggagcccggcgacgacugcaucucccgcacccagcugaugcggaccgagacggccgagauccacgacgacaacuacgggggcccgggggacaagaucaccaucugcaacggcagcaccaucguggaccagcgccucggguccgagcugggcugcuacaccaucaaccgggucaagagcuucaagcugugcgagaacuccgccacgggcaaggcgugcgagguggacagcacccccgugaagugccgccagggguucugccucaagaucacccaggagggccgggggcacgucaagcugucccgcggcagcgagguggugcuggacgccugcgacuccagcugcgaggucaugauccccaaggggaccggcgacauccucguggacugcuccggcgggcagcagcacuuccugaaggacaaccugaucgaccucgagugcccccacaucccgcugcugggcaagcucgccaucuacaucugccggaugagcaaccacccccgcacgaccauggccuuccuguucugguucggguucggcuacgugaucacgugcauccugugcaaggcccucuucuacucccugaucaucaucggcacccuggggaagaagaucaagcaguaccgggagcucaagccccagaccugcaccaucugcgagaccgcgcccgucaacgccaucgacgccgagaugcacgaccugaacugcagcuacaacaucugcccguacugcgccucccgccugaccagcgacggccucgcgcggcacgugacgcagugccccaagcgcaaggagaagguggaggagaccgagcuguaccugaaccucgagcggauccccuggaucguccgcaagcugcuccagguguccgagagcaccggggugguccucaagcgguccagcuggcugaucgugcugcucgugcugcugaccgucagccucucccccgugcagagcgccccggugggccacgggaagacgaucgagaccuaccagacccgcgagggcuucaccuccaucugccuguucaugcugggcagcauccucuucaucgucuccugcaucgugaaggggcugguggacagcgucuccgacagcuucuuccccggccuguccgugugcaagacgugcagcaucuccagcaucaacggguucgagaucgagucccacaagugcuacugcagccucuucugcugccccuacugccggcacugcuccgccgaccgcgagauccaccagcugcaccugagcaucugccggaagcgccggaccggcuccaacgucaugcucgccgugugcaagcgcaugugcuuccgcgccaccaucgaggugagccggcgcgcgcugcugauccgguccaucaucaacaccacguucgucaucugcauccucacccugaccaucugcguggugagcaccagcgccgucgagauggagaaccugcccgccgggacgugggagcgcgaggaggaccucaccaacuucugccaccaggagugccaggugaccgagaccgagugccugugcccguacgaggcccuggugcugcggaagccccucuuccuggacuccaucgucaagggcaagaagaaccugcucaacagcacgucccuggagaccagccuguccaucgaggcccccuggggcgcgaucaacauccagagcaccuucaagcccaccguguccgccgccaacaucgcccucagcugguccagcguggagcaccgcgggaacaagauccuggucuccggccggagcgaguccaucaugaagcuggaggagcgcaccggggugagcuggaaccucggcguggaggacgccuccgagagcaagcugcugacggucuccaucauggaccucagccagauguacagcccgguguucgaguaccuguccggggaccgccagguggaggaguggcccaaggcgaccugcaccggcgacugccccgagcggugcggcugcaccagcuccacgugccugcacaaggaguggccccacagccggaacuggcgcugcaacccgaccuggugcuggggcgucgggaccgggugcacgugcugcggcguggacgugaaggaccucuucaucgaccacauguucgucaaguggaagguggaguacaucaagaccgaggccaucgugugcgucgagcugaccucccaggagcggcagugcagccugaucgaggccggcacccgcuucaaccucgggcccgugaccaucacgcuguccgagccccggaacauccagcagaagcugcccccggagaucaucacccuccaccccaagaucgaggagggcuucuucgaccugaugcacgugcagaagguccugagcgccuccaccgugugcaagcuccagagcugcacccacgggauccccggcgaccuccagguguaccacaucgggaaccugcucaagggcgaccgcgucaacggccaccugauccacaagaucgagccgcacuucaacacguccuggaugagcugggacgggugcgaccuggacuacuacugcaacaugggcgacuggcccuccugcaccuacaccggggugacccagcacaaccacgccgcguucgugaaccuccugaacaucgagacggacuacaccaagaccuuccacuuccacagcaagcgggucaccgcccacggcgagacgccccagcuggaccucaaggcccgccccgccuacggggcgggcgagaucaccgugcugguggaggucgccgacauggagcugcacaccaagaagguggagaucuccggccucaaguucgccagccuggccugcaccgggugcuacgccugcuccagcggcaucuccugcaaggugcggauccacgucgacgagccggacgagcugacggugcacgucaagagcaacgaccccgacgugguggcggccagcaccucccucauggcccgcaagcuggagagcgggaccgacuccaccuucaaggccuucagcgccaugcccaagacgucccugugcuucuacaucguggagcgcgaguacugcaagagcugcuccgaggacgacacccagaagugcgucgagaccaagcucgagcagccccagagcauccugaucgagcacaagggcaccaucaucgggaagcagaacgacacgugcaccgcgaaggccuccugcuggcuggagagcgugaaguccuucuucuacggccucaagaacaugcugggcagcguguucgggaacuucuucaucggcauccugcuguuccuggccccguucguccugcucgugcuguucuucauguucggguggaagauccuguucugcuucaagugcugccggcgcacccggggccucuucaaguaccgccaccugaaggaggacgaggagaccggguaccggcgcaucaucgagcggcugaacuccaagaagggcaagaaccgccuccuggacggcgagcggcuggccgaccgcaagaucgccgagcuguucagcaccaagacgcacaucggg

SEQ ID NO: 12122 - RNA, 3495 nt, Artificial Sequence
  derived and/or modified CDS sequence (opt1) from CCHVF(CCHVF 79121M18)__GU477493.1__Gn-NSm-Gc
gccgagggcgggagcuccgacugcaucagccgcacccagcucgugaagaccgaggucgccgagauccacgaggacuccuacggcgggcccggcgagaagaucacgaucugcaacgggagcaccaucguggaccagggccucggcuccgagcuggggugcuacaccaucaaccgggugcgcagcuacaagcugugcgagaacuccgcgagcggcaaguccugcgagaucgacagcaucccggucaagugcaagcagggguucugccucaagaucacccaggagggccgggggcacgugaagcugucccgcggcacggagaucgugcuggacgucugcgacagcuccugcgagcucaugauccccaagggcaccggggacauccugguggacugcagcggcgggcagcagcacuuccugcagaacaaccucaucgaccugggcugccccaacgugccccugcucggcaagauggccaucuacgucugccggauguccaaccacccgaagaccaccauggccuuccuguucugguucagcuucggguacgugaucacgugcaucgccugccgcgugcuguucuaccuccugaucgccaucggcaccgucgggaagaagcugaagcaguaccgggagcucaagccccagaccugcaucgugugcgaguccgugcccgucaacgcgaucgacgccgagaugcacgagcugaacugcagcuacaacaucugccccuacugcgccucccgccugagcaccgacggccucauccggcacgugacgcagugcccgaagcgccgggagaagguggaggagaccgagcuguuccugaaccucgagcgcauccccuggcugguccggaagcugcuccaggugagcgaguccaccgggauggcccugaagcgcagcugcuggaugaucacccugcucauccugcugcucguguccaucagccccguccaguccgcgcccgugggcaaggagcgggccaucgagacguaccaggcccgcgagaccuacaccggcaucugccuguucgugcuggggagcguccucuucgccguguccuggcugaccaaggcccugaucgacggcaucgggaacagcuucuccccgggccucagcgucugcaagacgugcuccaucgggagcaucaacggcuucgagaucgagucccacaagugcuacugcagccuguucugcugccccuacugccgggcgugcuccagcgacaagaacacccaccgcaugcaccugaacgugugcaagaagcggaagaugggcuccaacgugaugcucgccgucugcaagcgcaugugcuuccgggccaccaucgaggccagcaacaaggcccugcugauccgcuccaucaucaacagcaccuucgugaucugcauccucauccugacgaucugcguggucagcaccuccgcgguggacauggagaaccugcccgccgggaucugggagaaggaggaggaccucaccaacuucugccaccaggagugccaggugaccgagacggagugccugugccccuacgaggccaugguccugcgcaagccgcuguuccucgacagcaccgccaagggcaugaagucccugcugaacagcaccucccucgagaccagccuguccaucgaggcccccuggggcgcgaucaacgugcagagcacguucaagcccaccguguccgccgccaacaucgcccugagcugguccagcgucgagcaccgggggaacaagauccucguguccgggcgcagcgaguccaucaugaagcuggaggagcggaccggcgugagcuggaaccugggcgucgaggacgccuccgagagcaagacccucacggugagcgugauggaccugucccagauguacagccccgucuucgaguaccuguccggggaccgccagguggaggaguggccgaaggcgaccugcaccggcgacugccccgagcggugcgggugcaccagcuccacgugccuccacaaggaguggccccacagccgcaacuggcggugcaaccccaccuggugcuggggcgugggcaccgggugcacgugcugcggccuggacgucaaggacuucuucaccgacuacaugcuggugaaguggaagguggaguacaucaagaccgaggccaucgucugcguggagcucaccucccaggagcgccagugcagccugaucgaggccgggacccgguucaaccugggcccggugaccaucacgcucuccgagccccgcaacguccagcagcggcugccgcccgagaucgugacccugcaccccaagaucgaggagggguucuucgaccucaugcacgugcagaagauccugagcgccuccaccgucugcaagcugcagagcugcacccacggcgugcccggcgacuuccagaucuaccacguggggaaccuccugcgcggcgacaaggucaacgggcacuccauccacaagaucgagccccacuucaacacgagcuggauguccugggacggcugcgaccuggacuacuucugcaacaugggggacuggccgagcugcaccuacaccggcgugacccagcacaaccgggcggccuucaucaacaugcucaacaucgagacggacuacaccaagaccuuccacuuccacuccaagcgcgugaccgcccacggcgacacgccccagcuggaccugaaggcccggcccgccuacggggcgggcgaggucaccgugcucguggaggucgccgaccuggagcugcacaccaagaagcucgaggugagcgggcugaagaucgccucccugaccugcagcggcugcuacgccugcagcuccgggaucagcugcaaggugcgcauccacgucaacgagcccgacgaguucacggugcacgugcgguccagcgacccggacgucguggccgcgggcuccagccucauggcccgcaagaucgaguucggcgccgacuccaccuucaaggccuucagcuccaugcccaaggacagccugugcuucuacaucguggagaaggacuacugcuccagcugcaccgacgacgacacccagaagugcgucaacacgaagcuggaccacccccaguccauccucaucgagcacaaggggaccaucaucggcaagcagaacgacacgugcagcaccaagaccuccugcuggcuggagagcgugaagggguucuucuacggccugaagaacaugcucuccgggaucuucggcaacguguuccugggcaucuuccuguuccucgcccccuucguccugcugaucuucuucuucuucuucggguggcggcuccuguucugccugaagugcugccgccgcacccggggccuccugaaguacaagcaccugaaggacgaggaggaggcgggguacaagaagaucaucgagcgccucaacggcaagaagggcaagagccagcuguucgacggggagcggcuggccgaccgcaagaucgccgagcuguucuccaccaagauccacaucggc

SEQ ID NO: 12123 - RNA, 3495 nt, Artificial Sequence
  derived and/or modified CDS sequence (opt1) from CCHVF(CCHVF Afg09-2990)__HM452306.1__Gn-NSm-Gc
agcgaggaguccggcgacgacugcaucagccgcacccagcugcuccggaccgagacggccgaggugcacggggacaacuacggcgggcccggcgacaagaucaccaucugcaacggguccaccgucguggaccagcgccugggcagcgagcugggcugcuacaccaucaaccgggugcgcuccuucaagcucugcgagaacagcgccacggggaaguccugcgagaucgacagcaucccggucaagugcaagcagggcuacugccugaagaucacccaggaggggcggggccacgugaagcugucccgcgggagcgaggugguccucgacgugugcgacuccagcugcgaggugaugauccccaagggcaccggcgacauccuggucgacugcuccgggggccagcagcacuaccugaaggacaaccucguggaccuggggugccccaagaucccccugcucggcaagauggcgaucuacaucugccggaugagcaaccacccgaagaccacgauggccuuccuguucugguucuccuucggcuacgugaucacgugcauccugugcaaggccaucuucuuccuccugaucaucuucgggacccugggcaagcgcuucaagcaguaccgggagcucaagccccagaccugcaccaucugcgagaccacccccgucaacgccaucgacgccgagaugcacgaccugaacugcagcuacaacaucugccccuacugcgcgucccgccugaccagcgacgggcucgcccggcacgugacgcagugcccgcgccggaaggagaagguggaggagaccgagcuguaccugaaccucgagcgcauccccugggucgugcggaagcugcuccagguguccgagagcaccggcaccguccugaagcgcagcuccuggcugaucgugcugcucgugcuguucacggucagccugucccccgugcagagcgcccccaucgggcacggcaagaccaucgagaccuaccgggugcgcgaggaguacaccuccaucugccucuucguccugggcagcauccuguucaucguguccuuccucaugaaggggcuggucgacggcguggggaacaucuucuucccgggccugagcgugugcaagacgugcuccaucgggagcaucaacggcuucgagaucgagucccacaagugcuacugcagccucuucugcugccccuacugccggcacugcuccgccgacggcgagauccaccagcugcaccugagcaucugcaagaagcgcaagaccggguccaacgucaugcucgcggugugcaagcggaugugcuuccgcgccaccauggaggugagcaacaaggcccuguucauccgcuccaucaucaacaccacguucgucgugugcauccugauccucgccgugugcgucgugagcaccuccgccguggagauggagagccugcccgcgggcaccugggagcgggaggaggaccugaccaacuucugccaccaggagugccaggucacggagaccgagugccucugccccuacgaggcccuggugcugcgccggccgcuguuccucgacagcaucgugaaggggaugaagaaccugcugaacuccaccagccucgagaccucccugagcaucgaggcccccuggggcgccaucaacguccaguccacguacaagcccaccgugagcaccgccaacaucgcgcuguccuggagcuccguggagcaccgcgggaacaagguccucgugagcggccgguccgagagcaucaugaagcuggaggagcgcaccggcaucuccugggaccuggggguggaggacgccagcgaguccaagcuccugaccgucagcgugauggaccugucccagauguacagccccguguucgaguaccucagcggcgaccggcaggucgaggaguggccgaaggccacgugcaccggggacugccccgagcgcugcggcugcaccuccagcacgugccugcacaaggaguggccccacucccggaacuggcgcugcaaccccaccuggugcuggggcguggggaccggcugcacgugcugcgggcuggacgugaaggaccucuucaccgacuacauguucgucaaguggaagguggaguacaucaagaccgaggccaucgugugcgucgagcugaccagccaggagcggcagugcucccugaucgaggccggcacccgcuucaaccucgggagcgugaccaucacgcuguccgagccgcggaacauccagcagaagcugccgcccgagaucaucacccuccaccccaagaucgaggagggcuucuucgaccugaugcacgugcagaagguccugagcgcguccaccgugugcaagcuccagagcugcacccacggcgugcccggggaccugcaggucuaccacaucggcaaccugcucaagggggaccgcgugaacggccaccugauccacaagaucgagcagcacuucaacacguccuggaugagcugggacgggugcgaccuggacuacuacugcaacaugggcgacuggcccuccugcaccuacaccggcgugacccagcacaaccacgccagcuucgucaaccuccugaacaucgagacggacuacaccaagaccuuccacuuccacuccaagcgggugaccgcccacggggacacgccccagcuggaccucaaggcccgcccgaccuacggcgccggggagaucaccgugcuggucgagguggcggacauggagcugcacaccaagaagaucgagaucagcggccucaaguucgccgggcugacgugcaccggcugcuacgccugcuccagcggcaucuccugcaaggugcggauccacgucgacgagcccgacgagcugaccgugcacgucaagagcgacgaccccgacgugguggccgcgagcuccagccucauggcccgcaagcuggaguucgggaccgacuccacguucaaggccuucagcgccaugcccaagaccucccugugcuucuacaucguggagcgggaguacugcaagagcugcuccaaggaggacacccagaagugcgucaacaccaagcucgagcagccgcagagcauccugaucgagcacaagggcacgaucaucgggaagcagaacaacacgugcaccgccaaggcguccugcuggcuggagagcgugaaguccuucuucuacggccucaagaacaugcucgggggcaucuucggcaacgucuucaucgggaucuucaccuuccugacccccuucauccugcugauccuguucuucauguucggcuggcgcauccucuucugcuucaagugcugccgccggacccgcgggcuguucaaguaccggcaccugaaggacgacgaggagaccggcuaccgcaagaucaucgagcggcucaacaacaagaagggcaagaaccgccugcuggacggggagcggcucgccgaccgcaagaucgccgagcuguucagcaccaagacccacaucggc

SEQ ID NO: 12124 - RNA, 3495 nt, Artificial Sequence
  derived and/or modified CDS sequence (opt1) from CCHVF(CCHVF Sudan Al-Fulah 3-2008)__HQ378184.1__Gn-NSm-Gc
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggucaaguccuucaagcucugcgagaacagcgccacgggcaaguccugcgugaucgacagcgugcccgucaagugccgccagggguacugccugcggaucacccaggagggccgcgggcacgugaagcugucccggggcagcgaggugguccucgacgcgugcgacaccuccugcgagaucaugauccccaaggggaccggcgacauccugguggacugcagcggcgggcagcagcacuuccugaaggacaaccucguggaccugggcugccccaagaucccgcugcucgggaagauggccaucuacaucugccgcauguccaaccaccccaagacgaccauggccuuccuguucugguucagcuucggcuacgucaucacgugcauccugugcaaggccaucuucuaccuccugaucaucaucggcacccuggggaagcgguuccgccaguaccgggagcucaagccccagaccugcaccaucugcgagaccacccccgugaacgccaucgacgcggagaugcacgaccugaacugcuccuacaacaucugcccguacugcgccagccgccugacguccgacggccucgcccggcacgugacccagugccccaagcgcaaggagaaggucgaggagaccgagcuguaccugaaccucgagcggauccccuggguggugcgcaagcugcugcaggucagcgaguccaccgggguggcccucaagcggagcagcuggcugaucgugcugcucguccuguucacggugucccugagccccgugcaguccgcgccgaucggccacgggaagaccaucgaggccuaccgcgcccgggagggcuacaccagcaucugccucuucguccugggcuccauccuguucaucgugagcugccucaugaaggggcugguggacuccgucggcaacagcuucuuccccgggcuguccaucugcaagaccugcagcaucuccagcaucaacggcuucgagaucgagucccacaagugcuacugcagccucuucugcugccccuacugccgccacugcuccgccgacaaggagauccacaagcugcaccugagcaucugcaagaagcggaagacgggguccaacgugaugcucgccgucugcaagcgcaugugcuuccgcgcgaccauggaggugagcaaccgggcccuguucauccgcuccaucaucaacaccaccuucgugcugugcauccucauccuggccgucugcguggugagcacgagcgccgucgagauggagaaccugcccgccggcaccugggagcgggaggaggaccucaccaacuucugccaccaggagugccaggugaccgagacggagugccugugcccguacgaggcgcuggugcugcgccggccccucuuccuggacuccaucgucaagggcaugaagaaccugcucaacagcaccucccuggagaccagccuguccaucgaggcccccuggggcgccaucaacgugcagagcaccuacaagcccacgguguccaccgccaacaucgcccucagcugguccagcgucgagcaccgcgggaacaagauccugguguccgggcggagcgaguccaucaugaagcuggaggagcgcaccggcaucagcugggaccucgggguggaggacgcguccgagagcaagcugcugaccgucuccgugauggaccucagccagauguacagcccgguguucgaguaccuguccggcgaccggcaggucgaggaguggcccaaggcgaccugcacgggcgacugccccgagcgcugcgggugcaccagcuccacgugccugcacaaggaguggccccacagccggaacuggcgcugcaacccgaccuggugcuggggcguggggaccggcugcacgugcugcggccucgacgugaaggaccuguucaccgacuacauguucgucaaguggaagguggaguacaucaagaccgaggccaucgugugcgucgagcugaccucccaggagcggcagugcagccucaucgaggccgggacccgcuucaaccugggccccgugaccaucacccuguccgagccccggaacauccagcagaagcugcccccggagaucaucacgcuccacccccgcaucgaggagggguucuucgaccugaugcacgugcagaagguccucagcgccuccaccgugugcaagcugcagagcugcacccacggcgugcccggggaccugcaggucuaccacaucggcaaccuccugaagggcgacaaggugaacgggcaccugauccacaagaucgagccgcacuucaacaccuccuggaugagcugggacggcugcgaccucgacuacuacugcaacaugggggacuggcccuccugcacguacaccggcgugacccagcacaaccacgccagcuucgucaaccugcugaacaucgagaccgacuacacgaagaacuuccacuuccacuccaagcgggugaccgcccacggggacacgccccagcucgaccugaaggcccgccccaccuacggcgccggcgagaucaccgugcuggucgagguggcggacauggagcuccacaccaagaagaucgagaucagcgggcugaaguucgccucccugaccugcaccggcugcuacgccugcagcuccgggaucagcugcaaggugcggauccacgucgacgagccggacgagcucacggugcacgucaagagcgacgaccccgacgugguggccgccuccagcucccugauggcgcgcaagcuggaguucggcaccgacagcaccuucaaggccuucuccgccaugcccaagaccagccucugcuucuacaucguggagaaggaguacugcaaguccugcagcgaggaggacacgaagaagugcgucaacaccaagcuggagcagccccaguccauccugaucgagcacaaggggaccaucaucggcaagcagaacagcacgugcaccgccaagguguccugcuggcucgagagcgccaaguccuucuucuacggccugaaggacaugcugagcgggaucuucggcaacguguucaucgggaucuuccucuuccuggcgccguucguccugcucgugcuguucuucauguucggcuggcgcauccugcucugcuuccggugcugccgccggacccgcgggcuguucaaguaccggcaccugaaggacgacgaggagaccggcuaccgccggaucaucgagcgccucaacaacaagaagggcaagaacaagcugcuggacggggagcggcucgccgaccgcaagaucgccgagcuguucuccaccaagacccacaucggc

SEQ ID NO: 12125 - RNA, 3495 nt, Artificial Sequence
  derived and/or modified CDS sequence (opt1) from CCHVF(CCHVF Sudan AB1-2009)__HQ378187.1__Gn-NSm-Gc
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggucaaguccuucaagcucugcgagaacagcgccacgggcaagaacugcgagaucgacuccgugcccgugaagugccgccagggguacugccugcggaucacccaggagggccgcgggcacgucaagcugagccggggcuccgagguggugcucgacgcgugcgacaccagcugcgagaucaugauccccaaggggaccggcgacauccuggucgacugcuccggcgggcagcagcacuuccugaaggacaaccucaucgaccugggcugccccaagaucccgcugcucgggaagauggccaucuacaucugccgcaugagcaaccaccccaagacgaccauggccuuccuguucugguucuccuucggcuaccugaucacgugcauccucugcaaggccaucuucuaccugcugaucaucaucggcacccucgggaagcggcugaagcaguaccgcgagcugaagccccagaccugcaccaucugcgagaccacccccgugaacgccaucgacgcggagaugcacgaccucaacugcagcuacaacaucugcccguacugcgccucccggcugacgagcgacggccuggcccgccacgugauccagugccccaagcggaaggagaaggucgaggagaccgagcucuaccugaaccuggagcgcauccccuggguggugcggaagcuccugcaggucuccgagagcaccgggguggcccugaagcgcuccagcuggcucaucgugcugcugguccucuucaccgugagccugucccccgugcagagcgcgccgaucggccaggggaagacgaucgaggccuaccgggcccgcgagggcuacaccuccaucugccuguucguccucggcagcauccuguucaucguguccugccugaugaaggggcucguggacagcgucggcaacuccuucuuccccgggcugagcaucugcaagaccugcuccaucagcuccaucaacggcuucgagaucgagagccacaagugcuacugcucccuguucugcugccccuacugccggcacugcagcaccgacaaggagauccacaagcuccaccuguccaucugcaagaagcgcaagacggggagcaacgugaugcuggccgugugcaagcggaugugcuuccgcgccaccauggaggucuccaaccgcgcccucuucauccggagcaucaucaacaccaccuucgugcugugcauccugauccucgccgucugcgugguguccacgagcgccgucgagauggagaaccugcccgccggcaccugggagcgcgaggaggaccugaccaacuucugccaccaggagugccaggugaccgagacggagugccugugcccguacgaggcccucgugcugcggaagccccuguuccucgacagcaucgcgaagggcaugaagaaccugcugaacuccaccagccucgagaccucccugagcaucgaggcccccuggggcgccaucaacguccaguccaccuacaagcccacggugagcaccgccaacaucgcccuguccuggagcuccguggagcaccgcgggaacaagauccucgucagcgggcgguccgagagcaucaugaagcuggaggagcgcaccggcaucuccugggaccuggggguggaggacgcgagcgaguccaagcuccugaccgugagcgucauggaccugucccagauguacagcccgguguucgaguaccucagcggcgaccgccagguggaggaguggcccaaggcgaccugcacgggcgacugccccgagcggugcgggugcaccuccagcacgugccugcacaaggaguggccccacucccggaacuggcgcugcaacccgaccuggugcuggggcgucgggaccggcugcacgugcugcggccuggacgugaaggaccucuucaccgacuacauguucgugaaguggaaggucgaguacaucaagaccgaggccaucgugugcguggagcugaccagccaggagcggcagugcucccugaucgaggccgggacccgcuucaaccucggccccgucaccaucacccugagcgagccccggaacauccagcagaagcugcccccggagaucaucacgcuccacccccgcaucgaggagggguucuucgaccugaugcacgugcagaaggugcuguccgccagcaccgucugcaagcuccaguccugcacccacggcgugcccggggaccuccagguguaccacaucggcaaccugcugaagggcgacaaggucaacgggcaccugauccacaagaucgagccgcacuucaacaccagcuggauguccugggacggcugcgaccuggacuacuacugcaacaugggggacuggcccagcugcacguacaccggcgugacccagcacaaccacgcguccuucgugaaccuccugaacaucgagaccgacuacacgaagaacuuccacuuccacagcaagcgggucaccgcccacggggacacgccccagcuggaccucaaggcccgccccaccuacggcgccggcgagaucaccgugcugguggaggucgcggacauggagcugcacaccaagaagaucgagaucuccgggcucaaguucgccagccugaccugcaccggcugcuacgccugcuccagcgggaucuccugcaaggugcggauccacguggacgagccggacgagcugacgguccacgucaagagcgacgaccccgacgugguggccgccagcuccagccucauggcgcgcaagcuggaguucggcaccgacuccaccuucaaggccuucagcgccaugcccaagaccucccugugcuucuacaucguggagcgggagcacugcaagagcugcaacgaggaggacacgaagaagugcgugaacaccaagcucgagcagccccaguccauccugaucgagcacaaggggaccaucaucggcaagcagaacagcacgugcaccgcccgcgccuccugcuggcuggagagcgucaaguccuucuucuacggccucaagaacaugcugagcgggaucuucggcaacguguucauggggaucuuccuguuccucgcgccguucauccugcugauccucuucuucauguucggcuggcgcauccuguucugcuucaagugcugccggcgcacccgggggcuguucaaguaccgccaccucaaggacgacgaggagaccggcuaccggcgcaucaucgagcggcugaacaacaagaagggcaagaacaagcugcucgacggggagcgccuggccgaccggcgcaucgccgagcuguucuccaccaagacccacaucggc

SEQ ID NO: 12126 - RNA, 3495 nt, Artificial Sequence
  derived and/or modified CDS sequence (opt1) from CCHVF(CCHVF NIVA 118595)__JN572083.1__Gn-NSm-Gc
agcgaggaguccggcgacgacugcaucagccgcacccagcugcuccggaccgagacggccgaggugcacggggacaacuacggcgggcccggcgacaagaucaccaucugcaacggguccaccgucguggaccagcgccugggcagcgagcugggcugcuacaccaucaaccgggugaaguccuucaagcucugcgagaacagcgccacggggaaguccugcgagaucgacagcaucccggucaagugccgccagggcuacugccugaagaucacccaggaggggcggggccacgugaagcugucccgcgggagcgaggugguccucgacgcgugcgacuccagcugcgaggugaugauccccaagggcaccggcgacauccugguggacugcuccgggggccagcagcacuuccugaaggacaaccucaucgaccuggggugccccaagaucccccugcucggcaagauggccaucuacaucugccggaugagcaaccacccgaagaccacgauggccuuccuguucugguucuccuucggcuacgucaucacgugcauccugugcaaggugaucuucuaccuccugaucaucuucgggacccugggcaagcgcuucaagcaguaccgggagcucaagccccagaccugcaccaucugcgagaccacccccgugaacgccaucgacgccgagaugcacgaccugaacugcagcuacaacaucugccccuacugcgcgucccgccugaccagcgacgggcucgcccggcacgucacgcagugcccgaagcgcaaggagaagguggaggagaccgagcuguaccugaaccucgagcggauccccugggugguccgcaagcugcuccagguguccgagagcaccggcaucgcccugaagcggagcuccuggcugaucgugcugcucguccuguucaccgugagcaucacgcccgugcaguccgcccccaucgggcacggcaagaccaucgaggcguaccgcgcccgggaggaguacaccagcaucugccuguucguccucggcuccgugcuguucguggucagcugccugaugaaggggcucguggacuccgucggcaacaucuucuucccggggcuguucaucugcaagaccugcagcaucggcuccaucaacggguucgagaucgagagccacaagugcuacugcucccuguucugcugccccuacugccgccacugcagcgccgaccgggagauccaccagcuccaccuguccaucugcaagaagcgcaagacgggcagcaacgugaugcuggccgugugcaagcggaugugcuuccgcaccaccauggaggucuccaacaaggcccucuucgugcgcagcaucaucaacaccacguucguggucugcauccugauccuggcggugugcguggucuccaccagcgccguggagauggagucccuccccgccggcaccugggagcgggaggaggaccugaccaacuucugccaccaggagugccaggugacggagaccgagugccugugccccuacgaggcccucguccugcgccggccgcuguuccuggacagcaucgugaaggggaugaagaaccuccugaacagcaccucccuggagaccagccucuccaucgaggcccccuggggcgcgaucaacgugcagagcacguacaagcccaccgucuccgccgccaacaucgcccugagcugguccagcguggagcaccgcgggaacaagauccugguguccggccggagcgaguccaucaugaagcucgaggagcgcaccgggaucagcugggaccugggcgucgaggacgccuccgagagcaagcugcucaccguguccgugauggaccugagccagauguacucccccgucuucgaguaccugagcggcgaccgccagguggaggaguggccgaaggcgaccugcacgggggacugccccgagcggugcggcugcaccagcuccacgugccuccacaaggaguggccccacagccggaacuggcgcugcaaccccaccuggugcuggggcguggggaccggcugcacgugcugcgggcuggacgucaaggaccuguucaccgacuacauguucgugaaguggaagguggaguacaucaagaccgaggccaucgucugcguggagcucaccucccaggagcggcagugcagccugaucgaggccggcacccgcuucaaccugggguccgugaccaucacccucagcgagccgcggaacauccagcagaagcugccgcccgagaucaucacgcugcacccccgcaucgaggagggcuucuucgaccucaugcacguccagaaggugcuguccgccagcaccgugugcaagcugcaguccugcacccacgggguccccggcgaccuccagguguaccacaucggcaaccugcugaagggggaccgggugaacggccaccucauccacaagaucgagcagcaccugaacaccagcuggauguccugggacgggugcgaccuggacuacuacugcaacaugggcgacuggcccagcugcacguacaccggggucacccagcacaaccacgccuccuucgugaaccuccugaacaucgagaccgacuacacgaagaccuuccacuuccacagcaagcgcgugaccgcgcacggcgacacgccccagcuggaccucaaggcccggccgaccuacggcgccggggagaucaccguccugguggagguggccgacauggagcugcacaccaagaagaucgagaucuccggccucaaguucgcgagccuguccugcaccgggugcuacgccugcagcuccggcaucagcugcaagguccgcauccacguggacgagcccgacgagcugacggugcacgucaagagcgacgaccccgacgugguggccgccuccagcucccucauggcccggaagcuggagagcgggaccgacuccaccuucaaggcguucagcgccaugcccaagaccucccugugcuucuacaucgucgagcgcgaguacugcaagggcugcagcaaggaggacacgcagaagugcgugaacaccaagcucgagcagccgcaguccauccugaucgagcacaagggcaccaucaucgggaagcagaacaacacgugcaccgccaaggccagcugcuggcuggaguccgucaagagcuucuucuacggccucaagaacaugcuguccgggaucuucggcaacguguuccuggggaucuucagcuuccucgcccccuucgugcugcugauccucuucuucauguucggcuggcgcauccuguucugcuucaagugcugccggcgcacccggggccuguucaaguaccgccaccucaaggacgacgaggagaccggguaccggaagaucaucgagcgccugaacaacaagaagggcaagaacaagcugcucgacggggagcggcuggcggaccgcaagaucgccgagcuguucuccaccaagacccacaucggc

SEQ ID NO: 12127 - RNA, 3495 nt, Artificial Sequence
  derived and/or modified CDS sequence (opt1) from CCHVF(CCHVF NIV 112143)__JN572085.1__Gn-NSm-Gc
agcgaggaguccggcgacgacugcaucagccgcacccagcugcuccggaccgagacggccgaggugcacggggacaacuacggcgggcccggcgacaagaucaccaucugcaacggguccaccgucguggaccagcgccugggcagcgagcugggcugcuacaccaucaaccgggugaaguccuucaagcucugcgagaacagcgccacggggaaguccugcgagaucgacagcaucccggucaagugccgccagggcuacugccugaagaucacccaggaggggcggggccacgugaagcugucccgcgggagcgaggugguccucgacgcgugcgacuccagcugcgaggugaugauccccaagggcaccggcgacauccugguggacugcuccgggggccagcagcacuuccugaaggacaaccucaucgaccuggggugccccaagaucccccugcucggcaagauggccaucuacaucugccggaugagcaaccacccgaagaccacgauggccuuccuguucugguucuccuucggcuacgucaucaccugcauccugugcaaggugaucuucuaccuccugaucaucuucgggacccugggcaagcgcuucaagcaguaccgggagcucaagccccagaccugcacgaucugcgagaccacccccgugaacgccaucgacgccgagaugcacgaccugaacugcagcuacaacaucugccccuacugcgcgucccgccugaccagcgacgggcucgcccggcacgucacgcagugcccgaagcgcaaggagaagguggaggagaccgagcuguaccugaaccucgagcggauccccugggugguccgcaagcugcugcagguguccgagagcaccggcaucgcccucaagcggagcuccuggcugaucgugcugcucguccuguucaccgugagcaucacgcccgugcaguccgcccccaucgggcacggcaagaccaucgaggcguaccgcgcccgggaggaguacaccagcaucugccuguucguccucggcuccgugcuguucguggucagcugccugaugaaggggcucguggacuccgucggcaacaucuucuucccggggcuguucaucugcaagaccugcagcaucggcuccaucaacggguucgagaucgagagccacaagugcuacugcucccuguucugcugccccuacugccgccacugcagcgccgaccgggagauccaccagcuccaccuguccaucugcaagaagcgcaagacgggcagcaacgugaugcuggccgugugcaagcggaugugcuuccgcgccaccauggaggucuccaacaaggcgcucuucgugcgcagcaucaucaacaccaccuucguggucugcauccugauccuggccaucugcgugguguccacgagcgccgucgagauggagucccuccccgccggcaccugggagcgggaggaggaccugaccaacuucugccaccaggagugccaggugaccgagacggagugccugugccccuacgaggcccucgugcugcgccggccgcuguuccuggacagcaucgucaaggggaugaagaaccuccugaacagcaccucccuggagaccagccucuccaucgaggcgcccuggggcgccaucaacgugcagagcaccuacaagcccacgguguccgccgccaacaucgcccugagcugguccagcgucgagcaccgcgggaacaagauccugguguccggccggagcgaguccaucaugaagcucgaggagcgcaccgggaucagcugggaccugggcguggaggacgcguccgagagcaagcugcucaccgucuccgugauggaccugagccagauguacucccccguguucgaguaccugagcggcgaccggcaggucgaggaguggccgaaggccaccugcaccggggacugccccgagcgcugcggcugcacgagcuccaccugccuccacaaggaguggccccacagccggaacuggcgcugcaaccccaccuggugcuggggggugggcaccggcugcacgugcugcgggcuggacgugaaggaccuguucaccgacuacauguucgucaaguggaagguggaguacaucaagaccgaggccaucgugugcgucgagcucaccucccaggagcggcagugcagccugaucgaggccggcacgcgcuucaaccugggguccgugaccaucacccucagcgagccgcggaacauccagcagaagcugccccccgagaucaucacccugcacccccgcaucgaggagggcuucuucgaccucaugcacgugcagaagguccuguccgccagcacggugugcaagcugcaguccugcacccacggggugccgggcgaccuccaggucuaccacaucggcaaccugcugaagggggaccgggugaacggccaccucauccacaagaucgagcagcaccugaacaccagcuggauguccugggacgggugcgaccuggacuacuacugcaacaugggcgacuggcccagcugcaccuacacgggggugacccagcacaaccacgcguccuucgucaaccuccugaacaucgagaccgacuacaccaagacguuccacuuccacagcaagcgcgugaccgcccacggcgacaccccccagcuggaccucaaggcccggccgaccuacggcgccggggagaucacggugcuggucgagguggcggacauggagcugcacaccaagaagaucgagaucuccggccucaaguucgccagccuguccugcaccgggugcuacgccugcagcuccggcaucagcugcaaggugcgcauccacgucgacgagcccgacgagcugaccgugcacgugaagagcgacgaccccgacgucguggccgccuccagcucccucauggcgcggaagcuggaguucgggacggacagcaccuucaaggccuucuccgccaugcccaagaccagccugugcuucuacaucguggagcgcgaguacugcaagggcugcuccaaggaggacacccagaagugcgucaacacgaagcucgagcagccgcagagcauccugaucgagcacaagggcaccaucaucgggaagcagaacaacaccugcaccgccaaggccuccugcuggcuggagagcgugaaguccuucuucuacggccucaagaacaugcugagcgggaucuucggcaacguguuccuggggaucuucuccuuccucgcgcccuucguccugcugauccucuucuucauguucggcuggcgcauccuguucugcuucaagugcugccggcgcacgcggggccuguucaaguaccgccaccucaaggacgacgaggagaccggguaccggaagaucaucgagcgccugaacaacaagaagggcaagaacaagcugcucgacggggagcggcuggccgaccgcaagaucgccgagcuguucagcaccaagacccacaucggc

SEQ ID NO: 12128 - RNA, 3495 nt, Artificial Sequence
  derived and/or modified CDS sequence (opt1) from CCHVF(CCHVF SCT ex Afghanistan)__KC344856.1__Gn-NSm-Gc
agcgaggaguccggcgacgacugcaucagccgcacccagcugcuccggaccgagacggccgaggugcacaacgacaacuacgggggccccggggacaagaucaccaucugcaacggcuccaccaucgucgaccagcgccuggggagcgagcugggcugcuacaccaucaaccgggugaaguccuucaagcucugcgagaacagcgccacgggcaaguccugcaagaucgacagcaccccggugaagugccgccagggguucugccugaagaucacccaggagggccgggggcacgucaagcugucccgcggcagcgagguggugcucgacgcgugcgacuccagcugcgagaucaugauccccaaggggaccggcgacauccuggucgacugcuccggcgggcagcagcacuuccugaaggacaaccucaucgaccugggcugccccaacaucccccugcucgggaagauggccaucuacaucugccggaugagcaaccacccgaagacgaccauggccuuccuguucugguucuccuucggcuacgugaucaccugcaucuucugcaaggugaucuucuaccugcucaucgucgugggcacccuggggaagaaguucaagcaguaccgcgagcugaagccccagacgugcaccaucugcgagaccacccccacgaacgccaucgacgccgagaugcacgaccucaacugcagcuacaacaucugccccuacugcgcgucccggcugaccagcgacggccuggcccgccacgugacccagugcccgaagcggaaggagaaggucgaggagaccgagcucuaccugaaccuggagcgcauccccuggaucgugcggaagcuccugcagguguccgagagcacgggggucgcccugaagcgcagcuccuggcucaucgugcugcuggugcuccugaccgucagccugucccccgugcagagcgcccccaucggccacgggaagaccaucgagaccuaccagacgcgggagggcuacaucuccgugugccucuucguccugggcgggauccuguucguggugagcugccucaucaagggccuggucgacuccguggggaacagcuucuucccgggccuguccaucugcaagaccugcagcaucggguccgucaacggcuucgagaucgagagccacaagugcuacugcucccuccugugcugccccuacugccgccacugcagcaccgaccgggagauccaccagcugcaccucuccaucugcaagaagcgccggaccggcgggaacgugaugcuggcggugugcaagcgcaugugcuuccgggccacgauggaggucagcaacaaggugcuguucauccgcaacaucaucaacaccaccuucgugaucugcauccucauccuggccgucugcgugguguccaccagcgccgucgagauggagucccugcccgccggcacgugggagcgcgaggaggaccucaccaacuucugccaccaggagugccaggugaccgagaccgagugccugugccccuacgaggcgcuggugcugcggaagccgcucuuccugaacagcaucgucaaggggaugaagaaccugcucaacagcacgaaccuggagaccucccugagcaucgaggcccccuggggcgccaucaacgugcaguccaccuucaagcccaccgugagcaccgccaacaucgcccucuccuggagcuccgucgagcaccgcgggaacaagauccuggugagcggccgguccgagagcaucaugaagcuggaggagcgcacgggcaucuccugggaccucgggguggaggacgcgagcgaguccaagagccugaccgucuccgugauggaccugagccagauguacucccccguguucgaguaccucagcggcgaccggcaggucgaggaguggccgaaggccaccugcaccggggacugccccgagcgcugcggcugcacgagcuccaccugccugcacaaggaguggccccacagccggaacuggcgcugcaaccccaccuggugcuggggcguggggaccggcugcacgugcugcgggcuggacgugaaggaccucuucaccgacuacauguucgucaaguggaagguggaguacaucaagaccgaggccaucgugugcgucgagcugaccucccaggagcggcagugcagccugaucgaggccggcacgcgcuucaaccucgggccggugaccaucacccuguccgagccccggaacauccagcagaagcugccccccgagaucaucacccuccacccgcgcaucgaggagggcuucuucgaccugaugcacgugcagaagguccugagcgccuccacggugugcaagcuccagagcugcacccacggcgugcccggggaccugcaggucuaccacaucggcaaccugcucaagggggacaagcugaacggccacaugauccacaagaucgagccccacuucaacaccuccuggaugagcugggacgggugcgaccuggacuacuacugcaacaugggcgacuggccguccugcaccuacacgggcgugacccagcacaaccacgcggccuucgugaaccuccugaacaucgagaccgacuacaccaagaacuuccacuuccacagcaagcgggucacggcccacggggacaccccccagcuggaccucaaggcccgccccaccuacggcgccggggagaucaccgugcugguggaggucgcggacauggagcugcacacgaagaagaucgacaucuccggccucaaguucgccagccugaccugcgccgggugcuacgccugcuccagcggcaucuccugcaaggugcggauccacguggacgagcccgacgagcugaccguccacgugaagagcgaggacccggacaucguggcggccuccaccagccucaucgcccgcaagcuggagcugggcacggacagcaccuucaaggccuucuccgccaugcccaagaccagccucugcuucuacaucgucgagcgggaguacugcaaguccugcagcaaggaggacacccagaagugcgugaacacgaagcuggagcacccccaggggauccugaucgagcacaagggcaccaucaucgggaagcagaacgacaccugcaccgcgaaggccggcugcuggcucgaguccgugaagagcuucuucuacgggcugaagaacaugcuguccggcaucuucggcaacgucuucaucgggaucuuccucuuccuggcccccuucgugcugcucauccuguucuucauguucggcuggcgccugcucuucugcuucaagugcugccggcgcacccgcgggcuguucaaguaccggcaccugaaggaggacgaggagagcggcuaccgccggaucaucgagcgccucaacaacaagaagggcaagaacaagcugcuggacggggagcggcucgccgaccgccggaucgccgagcuguucuccacgaagacccacaucggc

SEQ ID NO: 12129 - RNA, 3495 nt, Artificial Sequence
  derived and/or modified CDS sequence (opt1) from CCHVF(CCHVF Zahedan 2007)__KC867273.1__Gn-NSm-Gc
agcgaggaguccggcgacgacugcaucagccgcacccagcugcuccggaccgagacggccgaggugcacggggacaacuacggcgggcccggcgacaagaucaccaucugcaacggguccaccgucguggaccagcgccugggcagcgagcugggcugcuacaccaucaaccgggugcgcuccuucaagcucugcgagaacagcgccacggggaaguccugcgagaucgacagcaucccggucaagugcaagcagggcuucugccugaagaucacccaggaggggcggggccacgugaagcugucccgcgggagcgaggugguccucgacgugugcgacuccagcugcgaggugaugauccccaagggcaccggcgacauccuggucgacugcuccgggggccagcagcacuuccugaaggacaaccucguggaccuggggugccccaagaucccccugcucggcaagauggcgaucuacaucugccggaugagcaaccacccgaagaccacgauggccuuccuguucugguucuccuucggcuacgugaucacgugcauccugugcaaggccaucuucuuccuccugaucaucuucgggacccugggcaagcgcuucaagcaguaccgggagcucaagccccagaccugcaccaucugcgagaccacccccgucaacgccaucgacgccgagaugcacgaccugaacugcagcuacaacaucugccccuacugcgcgucccgccugaccagcgacgggcucgcccggcacgugacgcagugcccgcgccggaaggagaagguggaggagaccgagcuguaccugaaccucgagcgcauccccugggucgugcggaagcugcuccagguguccgagagcaccggcaccguccucaagcgcagcuccuggcugaucgugcugcucgugcuguucacggucagccugucccccgugcagagcgcccccaucgggcacggcaagaccaucgagaccuaccgggugcgcgaggaguacaccuccaucugccucuucguccugggcagcauccuguucaucguguccuuccucaugaaggggcuggucgacggcguggggaacaucuucuucccgggccugagcgugugcaagacgugcuccaucgggagcaucaacggcuucgagaucgagucccaccggugcuacugcagccucuucugcugccccuacugccgccacugcuccgccgacggcgagauccaccagcugcaccugagcaucugcaagaagcggaagaccggguccaacgucaugcucgcggugugcaagcgcaugugcuuccgcgccaccauggaggugagcaacaagguccuguucauccgguccaucaucaacaccacguucguggugugcauccugauccucgccgucugcguggugagcaccuccgccgucgagauggagagccugcccgccggcaccugggagcgcgaggaggaccugaccaacuucugccaccaggagugccaggugacggagaccgagugccucugccccuacgaggcgcuggugcugcggcgcccgcuguuccucgacagcaucgucaaggacaugaagaaccugcugaacuccaccagccucgagaccucccugagcaucgaggcccccuggggcgccaucaacgugcaguccacguacaagcccaccgugagcaccgccaacaucgcccuguccuggagcuccgucgagcaccgggggaacaaggugcucgugagcgggcgcuccgagagcaucaugaagcuggaggagcggaccggcaucuccugggaccugggcgucgaggacgcgagcgaguccaagcuccugaccgugagcgugauggaccugucccagauguacagccccgucuucgaguaccucagcggggaccgccagguggaggaguggccgaaggccacgugcaccggcgacugccccgagcggugcgggugcaccuccagcacgugccugcacaaggaguggccccacucccgcaacuggcggugcaaccccaccuggugcuggggcgugggcaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccucggcagcgugaccaucacgcuguccgagccgcgcaacauccagcagaagcugccgcccgagaucaucacccuccaccccaagaucgaggagggguucuucgaccugaugcacguccagaaggugcugagcgccuccaccgugugcaagcuccagagcugcacccacggcguccccggcgaccuccagguguaccacaucgggaaccugcugaagggcgaccgggugaacgggcaccugauccacaagaucgagcagcacuucaacacguccuggaugagcugggacggcugcgaccuggacuacuacugcaacaugggggacuggcccuccugcaccuacaccggcgucacccagcacaaccacgcgagcuucgugaaccuccugaacaucgagacggacuacaccaagaccuuccacuuccacuccaagcgcgugaccgcccacggcgacacgccccagcuggaccucaaggcccggccgaccuacggggccggcgagaucaccguccugguggagguggccgacauggagcugcacaccaagaagaucgagaucagcgggcucaaguucgcgggccugacgugcaccgggugcuacgccugcuccagcggcaucuccugcaagguccgcauccacguggacgagcccgacgagcugaccgugcacgucaagagcgacgaccccgacgugguggccgccagcuccagccucauggcgcggaagcuggaguucggcaccgacuccacguucaaggccuucagcgccaugcccaagaccucccugugcuucuacaucgucgagcgcgaguacugcaagagcugcuccaaggaggacacccagaagugcgugaacaccaagcucgagcagccgcagagcauccugaucgagcacaaggggacgaucaucggcaagcagaacaacacgugcaccgccaaggccuccugcuggcuggagagcgucaaguccuucuucuacgggcucaagaacaugcugggcgggaucuucggcaacguguucaucggcaucuucaccuuccugacccccuucauccuccugaucuucuucuucauguucggguggcgcauccuguucugcuucaagugcugccggcgcacccggggccucuucaaguaccgccaccugaaggacgacgaggagaccggguaccggaagaucaucgagcgccugaacaacaagaagggcaagaaccggcuccuggacggcgagcgccuggcggaccggaagaucgccgagcuguucagcaccaagacccacaucggg

SEQ ID NO: 12130 - RNA, 3495 nt, Artificial Sequence
  derived and/or modified CDS sequence (opt1) from CCHVF(CCHVF SPU 44/08)__KJ682805.1__Gn-NSm-Gc
agcgaggaguccaacgacgacugccugagccgcacccagcuccugcggaccgagaacgccgagauccacuccgacaacuacggcgggcccggcgacaagaucacgaucugcaacgggagcaccaucguggaccagcgccugggcuccgagcucgggugcuacaccaucaaccgggucaagagcuucaagcugugcgagaacuccgccaccggcaagagcugcgagaucgacuccacgccggugcgcugccggcagggcuucugccugaagaucacccaggaggggcgcggccacgugaagcucagccggggguccgaggucgugcuggacgcgugcgacagcuccugcgagaucaugauccccaagggcaccggggacauccugguggacugcagcggcggccagcagcacuuccucaaggacaaccuggucgaccuggggugccccaacaucccccuccugggcaagauggccaucuacaucugccgcauguccaaccacccgaagaccacgauggccuuccuguucugguucagcuucggguacgugaucacgugcauccucugcaaggccaucuucuaccugcugaucguggucggcacccucggcaagaaguucaagcaguaccgggagcugaagccccagaccugcaccaucugcgagaccaaccccgugaacgccaucgacgcggagaugcacgaccugaacugcuccuacaacaucugccccuacugcgccagccgccucaccuccgacgggcuggcccggcacgugaugcagugcccgaagcgcaaggagaagaucgaggagaccgagcuguaccucaaccuggagcggauccccugggucgugcgcaagcugcuccaggugagcgagagcacgggcgucgcccugaagcgguccagcuggcuggugauccuccuggugcugcucaccgucucccugagccccgugcaguccgcgcccaucagccacggggagaccguggaggucuaccagacccgcgagggcuacacguccaucugccuguucgugcucgggagcauccuguuccugguguccugccucaugcggggccuggucgacagcguguccaacagcuucuucccgggccuguccaucugcaagaccugcagcaucggguccaucaacggcuucgagaucgagagccacaagugcuacugcucccucuucugcugccccuacugccgccacugcagcgccgacaucgagauccacaagcugcaccuguccaucugcaagaagcggaagaccgggagcaacgucaugcucgccgugugcaagcgcaugugcuuccgggccaccguggaggucagcaacaaggcccugcugauccgcaacaucaucaacacgaccuucguggugugcauccucauccuggcggucugcgugguguccaccagcgccgucgagauggagaaccugcccgccggcaccugggagaaggaggaggaccugacgaacuucugccaccaggagugccaggugaccgagaccgagugccucugccccuacgaggcccuggugcugcgcaagccccucuuccuggacuccaucgucaaggggaugaagaaccugcucaacagcaccucccuggagacgagccuguccaucgaggcccccuggggcgcgaucaacgugcagagcaccuucaagcccaccguguccgccgccaacaucgcccucagcugguccagcgucgagcaccggggcaacaagauccugguguccgggcgcagcgaguccaucaugaagcuggaggagcggaccggcaucagcugggaccucgggguggaggacgccuccgagagcaagcugcugacggucagcgugauggaccucucccagauguacagccccguguucgaguaccuguccggcgaccgccaggucgaggaguggccgaaggcgaccugcaccggggacugccccgagcggugcggcugcaccagcuccacgugccugcacaaggaguggccccacagccgcaacuggcggugcaaccccaccuggugcuggggcguggggaccggcugcacgugcugcgggcucgacgugaaggaccuguucaccgacuacauguucgucaaguggaagguggacuacaucaagaccgaggccaucgugugcgucgagcugaccucccaggagcgccagugcagccucaucgaggccggcacccgguucaaccugggcccggugaccaucacgcuguccgagccccgcaacauccagcagaagcucccgcccgagaucgugacccugcacccgcggaucgaggagggguucuucgaccugaugcacauccagaagguccucagcgccuccaccgugugcaagcugcagagcugcacccacggcgugcccggggaccugcagaucuaccacaucggcaaccuccugaagggggacaaggucaacggccaccugauccacaagaucgagccccacuucaacacguccuggaugagcugggacggcugcgaccucgacuacuacugcaacaugggggacuggccguccugcagcuacaccggcgugacccagcacaaccacgccgcguucgugaacaugcugaacaucgagaccgacuacacgaagaacuuccacuuccacuccaagcgcgucaccgcccacggggacacgccccagcuggaccucaaggcccggcccaccuacggcgccggggagaucaccgugcugguggaggucgcggacauggagcugcacaccaagaagaucgagaucagcggccucaaguucgccucccugaccugcaccggcugcuacgccugcagcagcgggaucuccugcaaggugcgcauccacguggacgagcccgacgagcugacgguccacgucaagagcgaggacccggacaucguggccgccuccagcucccucauggcgcggaagcuggaguucggcaccgacagcaccuucaaggccuucuccgccaugcccaagaccagccugugcuucuacaucguggagcgcgaguacugcaaguccugcagcaaggaggacacgcagaagugcgugaacaccaagcucgagcagccccaguccauccugaucgagcacaaggggaccaucaucggcaagcagaacgacacgugcaccgccaaggccagcugcuggcuggaguccaucaagagcuucuucuacgggcucaagaacaugcuguccggcaucuucggcaacguguucaucgggaucuuccuguuccucgcgcccuucaucaugcugauccuguucuucauguucggcuggcggauccucuucugcuucaagugcugccgccggacccgcgggcuguucaaguaccgccaccugaaggacgacgaggagaucggcuaccggaagaucaucgagcgccucaacaacaagaaggggaagaacaagcugcuggacggcgagcggcucgccgaccgcaagaucgccgagcuguucagcaccaagacccacaucggc

SEQ ID NO: 12131 - RNA, 3495 nt, Artificial Sequence
  derived and/or modified CDS sequence (opt1) from CCHVF(CCHVF SPU 383/87)__KJ682806.1__Gn-NSm-Gc
agcgaggaguccaacgacgacugccugagccgcacccagcuccugcggaccgagaacgccgagauccacuccgacaacuacggcgggcccggcgacaagaucacgaucugcaacgggagcaccaucguggaccagcgccugggcuccgagcucgggugcuacaccaucaaccgggucaagagcuucaagcugugcgagaacuccgccaccggcaagagcugcgagaucgacuccacgccggugcgcugccggcagggcuucugccugaagaucacccaggaggggcgcggccacgugaagcucagccggggguccgaggucgugcuggacgcgugcgacagcuccugcgagaucaugauccccaagggcaccggggacauccugguggacugcagcggcggccagcagcacuuccucaaggacaaccuggucgaccuggggugccccaacaucccccuccugggcaagauggccaucuacaucugccgcauguccaaccacccgaagaccacgauggccuuccuguucugguucagcuucggguacgugaucacgugcauccucugcaaggugaucuucuaccugcuggucguggugggcacccucggcaagaaguucaagcaguaccgggagcugaagccccagaccugcaccaucugcgagaccaaccccgucaacgccaucgacgccgagaugcacgaccugaacugcuccuacaacaucugccccuacugcgcgagccgccucaccuccgacgggcuggcccggcacgugauccagugcccgaagcgcaaggagaagaucgaggagaccgagcuguaccucaaccuggagcggauccccugggugguccgcaagcugcuccaggugagcgagagcacgggcguggcccugaagcgguccagcuggcuggucauccuccuggugcugcucaccgugucccugagccccguccaguccgcccccaucagccacggggagaccguggagguguaccagacccgcgagggcuacacguccaucugccuguucguccucgggagcauccuguuccugguguccugccucaugaagggccuggucgacagcgugggcaacuccuucuucccggggcugagcaucugcaagaccugcuccaucggcagcaucaacggguucgagaucgagucccacaagugcuacugcagccucuucugcugccccuacugccggcacugcuccgcggacaucgagauccaccgccugcaccugagcaucugcaagaagcggaagaccggcuccaacgugaugcucgccgucugcaagcgcaugugcuuccgggccaccguggaggugagcaacaaggcccugcugauccgcaacaucaucaacacgaccuucgucgugugcauccucauccuggccgugugcgucgugagcaccuccgcgguggagauggagaaccugcccgccgggaccugggagaaggaggaggaccugacgaacuucugccaccaggagugccaggucaccgagaccgagugccucugccccuacgaggcccuggugcugcgcaagccccucuuccuggacagcaucgugaagggcaugaagaaccugcucaacuccaccagccuggagacgucccugagcaucgaggcccccuggggcgccaucaacguccaguccaccuucaagcccaccgugagcgcggccaacaucgcccucuccuggagcuccguggagcaccgggggaacaagauccuggucagcggccgcuccgagagcaucaugaagcuggaggagcggaccgggaucuccugggaccucggcguggaggacgccagcgaguccaagcugcugacggugagcgucauggaccucagccagauguacucccccguguucgaguaccugagcggggaccgccagguggaggaguggccgaaggcgaccugcaccggcgacugccccgagcggugcggcugcaccuccagcacgugccugcacaaggaguggccccacucccgcaacuggcggugcaaccccaccuggugcuggggcgucgggaccgggugcacgugcugcggccucgacgugaaggaccuguucaccgacuacauguucgugaaguggaaggucgacuacaucaagaccgaggccaucgugugcguggagcugaccagccaggagcgccagugcucccucaucgaggccggcacccgguucaaccuggggccggucaccaucacgcugagcgagccccgcaacauccagcagaagcucccgcccgagaucgugacccugcacccgcggaucgaggagggcuucuucgaccugaugcacauccagaaggugcucuccgccagcaccgucugcaagcugcaguccugcacccacggggugcccggcgaccugcagaucuaccacaucgggaaccuccugaagggcgacaaggugaacggccaccugauccacaagaucgagccccacuucaacacgagcuggauguccugggacgggugcgaccucgacuacuacugcaacaugggcgacuggccgagcugcuccuacaccggggucacccagcacaaccacgccgccuucgugaacaugcugaacaucgagaccgacuacacgaagaacuuccacuuccacagcaagcgcgugaccgcgcacggcgacacgccccagcuggaccucaaggcccggcccaccuacggggccggcgagaucaccguccugguggagguggccgacauggagcugcacaccaagaagaucgagaucuccggccucaaguucgcgagccugaccugcaccgggugcuacgccugcuccagcggcaucagcugcaagguccgcauccacguggacgagcccgacgagcugacggugcacgucaaguccgaggacccggacaucguggccgccagcuccagccucauggcccggaagcuggaguucgggaccgacuccaccuucaaggcguucagcgccaugcccaagaccucccugugcuucuacaucguggagcgcgaguacugcaagagcugcuccaaggaggacacgcagaagugcgucaacaccaagcucgagcagccccagagcauccugaucgagcacaagggcaccaucuucgggaagcagaacgacacgugcaccgccaaggccuccugcuggcuggagagcgugaaguccuucuucuacggccucaagaacaugcugagcggcaucuucgggaacguguucaucggcgucuuccuguuccucgcccccuucaucaugcugauccuguucuucauguucggguggcggauccucuucugcuucaagugcugccgccggacccgcggccuguucaaguaccgccaccugaaggacgacgaggagaucggguaccggaagaucaucgagcgccucaacaacaagaagggcaagaacaagcugcuggacggcgagcggcucgcggaccgcaagaucgccgagcuguucuccaccaagacccacaucggg

SEQ ID NO: 12132 - RNA, 3495 nt, Artificial Sequence
  derived and/or modified CDS sequence (opt1) from CCHVF(CCHVF SPU 130/89)__KJ682807.1__Gn-NSm-Gc
agcgaggagcccaacuacgacugccugucccgcacccagcuccugcggaccgagaacgccgagauccacagcgacaacuacggcgggccgggcgacaagaucacgaucugcaacggguccaccaucguggaccagcgccugggcagcgagcucgggugcuacaccaucaaccgggucaaguccuucaagcugugcgagaacagcgccaccggcaaguccugcgagaucgacagcacgcccgugcgcugccggcagggcuucugccugaagaucacccaggaggggcgcggccacgugaagcucucccgggggagcgaggucgugcuggacgcgugcgacuccagcugcgagaucaugauccccaagggcaccggggacauccugguggacugcuccggcggccagcagcacuuccucaaggacaaccuggucgaccuggggugccccaacaucccgcuccugggcaagauggccaucuacaucugccgcaugagcaaccaccccaagaccacgauggccuuccuguucugguucuccuucggguacgugaucacgugcauccucugcaaggugaucuucuaccugcugaucgucgugggcacccucggcaagaaguucaagcaguaccgggagcugaagccccagaccugcaccaucugcgagaccaaccccgugaacgccaucgacgccgagaugcacgaccugaacugcagcuacaacaucugcccguacugcgcgucccgccucaccagcgacgggcuggcccggcacgucaugcagugccccaagcgcaaggagaagaucgaggagaccgagcuguaccucaaccuggagcggauccccuggguggugcgcaagcugcuccaggucuccgagagcacgggcguggcccugaagcggagcuccuggcuggugguccuccuggugcugcucaccgugagccugucccccguccagagcgccccgaucucccacggggagaccguggagguguaccagacccgcgagggcuacacgagcaucugccuguucguccucggguccauccuguuccuggugagcugccucaugaagggccuggucgacuccgugggcaacagcuucuuccccgggcuguccaucugcaagaccugcagcaucggcuccaucaacggguucgagaucgagagccacaagugcuacugcucccucuucugcugccccuacugccggcacugcagcgcggacaucgagauccacaagcugcaccuguccaucugcaagaagcgcaagaccggcagcaacgugaugcucgccgucugcaagcggaugugcuuccgcgccaccguggagguguccaacaaggcccugcugauccggaacaucaucaacacgaccuucgucgugugcauccucauccuggccgugugcgucgugagcaccagcgcgguggagauggagaaccugcccgccgggaccugggagaaggaggaggaccugacgaacuucugccaccaggagugccaggucaccgagaccgagugccucugcccguacgaggcccuggugcugcgcaagccccucucccuggacagcaucgugaagggcaugaagaaccugcucaacuccaccagccuggagacgucccugagcaucgaggcccccuggggcgccaucaacguccaguccaccuucaagcccaccgugagcgcggccaacaucgcccucuccuggagcuccguggagcaccgcgggaacaagauccuggucagcggccgguccgagagcaucaugaagcuggaggagcgcaccgggaucuccugggaccucggcguggaggacgccagcgaguccaagcugcugacggugagcgucauggaccucagccagauguacuccccgguguucgaguaccugagcggggaccgccagguggaggaguggcccaaggcgaccugcaccggcgacugccccgagcggugcggcugcaccuccagcacgugccugcacaaggaguggccccacucccggaacuggcgcugcaacccgaccuggugcuggggcgucgggaccgggugcacgugcugcggccucgacgugaaggaccuguucaccgacuacauguucgugaaguggaaggucgacuacaucaagaccgaggccaucgugugcguggagcugaccagccaggagcggcagugcucccucaucgaggccggcacccgcuucaaccuggggcccgucaccaucacgcugagcgagccccggaacauccagcagaagcugcccccggagaucgugacccuccacccccgcaucgaggagggcuucuucgaccugaugcacauccagaaggugcucuccgccagcaccgucugcaagcugcaguccugcacccacggggugcccggcgaccugcagaucuaccacaucgggaaccuccugaagggcgacaaggugaacggccaccugauccacaagaucgagccgcacuucaacacgagcuggauguccugggacgggugcgaccucgacuacuacugcaacaugggcgacuggcccagcugcuccuacaccggggucacccagcacaaccacgccgccuucgugaacaugcugaacaucgagaccgacuacacgaagaacuuccacuuccacagcaagcgggugaccgcgcacggcgacacgccccagcuggaccucaaggcccgccccaccuacggggccggcgagaucaccguccugguggagguggccgacauggagcugcacaccaagaaggucgagaucuccggccucaaguucgcgagccugaccugcaccgggugcuacgccugcuccagcggcaucagcugcaaggugcggauccacguggacgagccggacgagcugacgguccacgugaaguccgaggaccccgacaucguggccgccagcuccagccucauggcccgcaagcuggaguucgggaccgacuccaccuucaaggcguucagcgccaugcccaagaccucccugugcuucuacaucgucgagcgggagcacugcaagagcugcuccaaggaggacacgcagcgcugcgugaacaccaagcucgagcagccccagagcauccugaucgagcacaagggcaccaucaucgggaagcagaacgacacgugcaccgccaaggccuccugcuggcuggagagcaucaaguccuucuucuacggccucaagaacaugcugagcggcaucuucgggaacguguucaucggcgucuuccuguuccucgccccguucaucauccugauccuguucuucauguucggguggcggauccucuucugcuucaagugcugccgccggacccgcggccugcugaaguaccgccaccucaaggacgacgaggagaucggguaccggaagaucaucgagcgccugaacaacaagaagggcaagaacaagcugcucgacggcgagcggcuggcggaccgcaagaucgccgagcuguucuccaccaagacccacaucggg

SEQ ID NO: 12133 - RNA, 3495 nt, Artificial Sequence
  derived and/or modified CDS sequence (opt1) from CCHVF(CCHVF SPU 497/88)__KJ682808.1__Gn-NSm-Gc
agcgaggaguccaacgacgacugccucagccgcacccagcuccugcggaccgagaacgccgagauccacuccgacaacuacggcgggcccggcgacaagaucacgaucugcaacgggagcaccaucguggaccagcgccugggcuccgagcucgggugcuacaccaucaaccgggucaagagcuucaagcugugcgagaacuccgccaccggcaagagcugcgagaucgacuccacgccggugcgcugccggcagggcuucugccugaagaucacccaggaggggaagggccacgugaagcucagccgcggguccgaggucgugcuggacgcgugcgacagcuccugcgagaucaugauccccaagggcaccggggacauccugguggacugcagcggcggccagcagcacuuccucaaggacaaccuggucgaccuggggugccccaacaucccccuccugggcaagauggccaucuacaucugccggauguccaaccacccgaagaccacgaugguguuccuguucugguucagcuucggguacgugaucacgugcauccucugcaaggucaucuucuaccugcugaucguggugggcacccucggcaagaaguucaagcaguaccgcgagcugaagccccagaccugcaccaucugcgagaccaaccccgucaacgccaucgacgccgagaugcacgaccugaacugcuccuacaacaucugccccuacugcgccagccggcucaccuccgacgggcuggcgcgccacgugaugcagugcccgaagcggaaggagaagaucgaggagaccgagcuguaccucaaccuggagcgcauccccugggugguccggaagcugcuccaggugagcgagagcacgggcguggcccugaagcgcuccagcuggcuggucauccuccuggugcugcucaccgugucccugagccccguccaguccgcccccaucagccacggggagaccguggagguguaccagacccgggagggcuacacguccaucugccuguucguccucgggggcauccuguuccuggugagcugccucaugaagggccuggucgacuccguggggaacagcuucuucccgggccuguccaucugcaagaccugcagcaucggguccaucaacggcuucgagaucgagagccacaagugcuacugcucccucuucugcugccccuacugccgccacugcagcgccgacaucgagauccacaagcugcaccuguccaucugcaagaagcggaagaccuggagcaacgugaugcucgcggucugcaagcgcaugugcuuccgggccaccguggagguguccaacaaggcccugcugauccgcaacaucaucaacacgaccuucgucgugugcauccucauccuggccaucugcguggucagcaccagcgccguggagauggagaaccugcccgcggggaccugggagaaggaggaggaccugacgaacuucugccaccaggagugccaggugaccgagaccgagugccucugccccuacgaggcccugguccugcggaagccccucuuccuggacuccaucgugaagggcaugcgcaaccugcucaacagcaccucccuggagacgagccuguccaucgaggcccccuggggcgccaucaacgugcagagcaccuucaagcccaccgucuccgccgcgaacaucgcccucagcugguccagcguggagcaccgcgggaacaagauccugguguccggccggagcgaguccaucaugaagcuggaggagcgcaccgggaucagcugggaccucggcgucgaggacgccuccgagagcaagcugcugacgguguccgugauggaccucagccagauguacagccccgucuucgaguaccuguccggggaccgccagguggaggaguggccgaaggcgaccugcaccggcgacugccccgagcggugcggcugcaccagcuccacgugccugcacaaggaguggccccacagccggaacuggcgcugcaaccccaccuggugcuggggcguggggaccgggugcacgugcugcggccucgacgucaaggaccuguucaccgacuacauguucgugaaguggaagguggacuacaucaagaccgaggccaucgucugcguggagcugaccucccaggagcggcagugcagccucaucgaggccggcacccgcuucaaccuggggccggugaccaucacgcuguccgagccccggaacauccagcagaagcucccgcccgagaucgucacccugcacccgcgcaucgaggagggcuucuucgaccugaugcacauccagaaggugcucagcgccuccaccgugugcaagcugcagagcugcacccacgggguccccggcgaccugcagaucuaccacaucgggaaccuccugaagggcgacaaggugaacggccaccugauccacaagaucgagccccacuucaacacguccuggaugagcugggacgggugcgaccucgacuacuacugcaacaugggcgacuggccguccugcagcuacaccggggugacccagcacaaccacgccgccuucgucaacaugcugaacaucgagaccgacuacacgaagaacuuccacuuccacuccaagcgggugaccgcccacggcgacacgccccagcuggaccucaaggcgcgccccaccuacggggccggcgagaucaccgugcuggucgagguggccgacauggagcugcacaccaagaagaucgagaucagcggccucaaguucgccucccugaccugcaccgggugcuacgcgugcagcuccggcaucagcugcaaggugcggauccacgucgacgagcccgacgagcugacggugcacgucaagagcgaggacccggacaucguggccgccuccagcucccucauggcccgcaagcuggaguucgggaccgacagcaccuucaaggccuucuccgcgaugcccaagaccagccugugcuucuacaucguggagcgggaguacugcaaguccugcagcaaggaggacacgcagaagugcgugaacaccaagcucgagcagccccaguccauccugaucgagcacaagggcaccaucaucgggaagcagaacgacacgugcaccgcccgcgccagcugcuggcuggaguccaucaagagcuucuucuacggccucaagaacaugcuguccggcaucuucgggaacgucuucaucggcaucuuccuguucuucgcccccuucaucaugcucauccuguucuucauguucggguggcggauccuguucugcuucaagugcugccgccggacccgcggccucuucaaguaccgccaccugaaggacgacgaggaggugggguaccggaagaucaucgagcgccugaacaacaagaagggcaagaacaagcuccuggacggcgagcggcuggccgaccgcaagaucgcggagcuguucagcaccaagacccacaucggg

SEQ ID NO: 12134 - RNA, 3495 nt, Artificial Sequence
  derived and/or modified CDS sequence (opt1) from CCHVF(CCHVF SPU 18/88)__KJ682810.1__Gn-NSm-Gc
agcgaggaguccaacgacgacugccugagccgcacccagcuccugcggaccgagaacgccgagauccacuccgacaacuacggcgggcccggcgacaagaucacgaucugcaacgggagcaccaucguggaccagcgccugggcuccgagcucgggugcuacaccaucaaccgggucaagagcuucaagcugugcgagaacuccgccaccggcaagagcugcgagaucgacuccacgccggugcgcugccggcagggcuucugccugaagaucacccaggaggggcgcggccacgugaagcucagccggggguccgaggucgugcuggacgcgugcgacagcuccugcgagaucaugauccccaagggcaccggggacauccugguggacugcagcggcggccagcagcacuuccucaaggacaaccuggucgaccuggggugccccaacaucccccuccugggcaagauggccaucuacaucugccgcauguccaaccacccgaagaccacgaugggguuccuguucugguucagcuucggcuacgugaucacgugcauccucugcaaggugaucuucuaccugcugaucgucgugggcacccucgggaagaaguucaagcaguaccgggagcugaagccccagaccugcaccaucugcgagaccaaccccgugaacgccaucgacgccgagaugcacgaccugaacugcuccuacaacaucugccccuacugcgccagccgccucaccuccgacggccuggcgcggcacgucaugcagugcccgaagcgcaaggagaagaucgaggagaccgagcuguaccucaaccuggagcggauccccuggguggugcgcaagcugcuccaggucagcgagagcacggggguggcccugaagcgguccagcuggcuggugauccuccugguccugcucaccgugucccugagccccgugcaguccgcccccaucagccacggcgagaccgucgagguguaccagacccgcgagggguacacguccaucugccuguucgugcucggcagcauccuguuccuggucuccugccucaugaagggccugguggacagcgucgggaacuccuucagcccgggccuguccaucugcaagaccugcagcaucggguccaucaacggcuucgagaucgagagccacaagugcuacugcucccucuucugcugccccuacugccggcacugcagcgccgacaucgagauccacaagcugcaccuguccaucugcaagaagcgcaagaccgggagcaacgugaugcucgcggugugcaagcggaugugcuuccgcgccaccgucgaggugagcaacaaggcccugcugauccggaacaucaucaacacgaccuucguggucugcauccucauccuggccgugugcguggucuccaccagcgccguggagauggagaaccugcccgcgggcaccugggagaaggaggaggaccugacgaacuucugccaccaggagugccaggugaccgagaccgagugccucugccccuacgaggcccugguccugcgcaagccccucuuccuggacuccaucgugaagggcaagaagaaccugcucaacagcaccucccuggagacgagccuguccaucgaggcccccuggggcgccaucaacgugcagagcaccuucaagcccaccgucuccgccgcgaacaucgcccucagcugguccagcguggagcaccgcgggaacaagauccugguguccgggcggagcgaguccaucaugaagcuggaggagcgcaccggcaucagcugggaccucggggucgaggacgccuccgagagcaagcugcugacggugagcgugauggaccucucccagauguacagccccgucuucgaguaccuguccggcgaccgccagguggaggaguggccgaaggcgaccugcaccggcgacugccccgagcggugcgggugcaccagcuccacgugccugcacaaggaguggccccacagccggaacuggcgcugcaaccccaccuggugcuggggcguggggaccggcugcacgugcugcggccucgacgucaaggaccuguucaccgacuacauguucgugaaguggaagguggacuacaucaagaccgaggccaucgucugcguggagcugaccucccaggagcggcagugcagccucaucgaggccgggacccgcuucaaccugggcccggugaccaucacgcuguccgagccccggaacauccagcagaagcucccgcccgagaucgucacccugcacccgcgcaucgaggagggguucuucgaccugaugcacauccagaaggugcucagcgccuccaccgugugcaagcugcagagcugcacccacggcguccccggggaccugcagaucuaccacaucggcaaccuccugaagggcgacaaggugaacgggcaccugauccacaagaucgagccccacuucaacacguccuggaugagcugggacggcugcgaccucgacuacuacugcaacaugggggacuggccguccugcagcuacaccggcgugacccagcacaaccacgccgccuucgucaacaugcugaacaucgagaccgacuacacgaagaacuuccacuuccacuccaagcgggugaccgcccacggggacacgccccagcuggaccucaaggcgcgccccaccuacggcgccggcgagaucaccgugcuggucgagguggccgacauggagcugcacaccaagaagaucgagaucagcgggcucaaguucgccucccugaccugcaccggcugcuacgcgugcagcagcgggaucuccugcaaggugcggauccacgucgacgagcccgacgagcugacggugcacgucaagagcgaggacccggacaucguggccgccuccagcucccucauggcccgcaagcuggaguucggcaccgacagcaccuucaaggccuucuccgcgaugcccaagaccagccugugcuucuacaucguggagcgggaguacugcaaguccugcagcaaggaggacacgcagaagugcgugaacaccaagcucgagcagccccaguccauccugaucgagcacaaggggaccaucaucggcaagcagaacgacacgugcaccggcaaggccgggugcuggcuggagagcaucaaguccuucuucuacggccucaagaacaugcugagcgggaucuucggcaacgucuucaucgggaucuuccuguuccucgcccccuucaucaugcugauccuguucuucauguucggcuggcgcauccucuucugcuucaagugcugccggcgcacccggggccuguucaaguaccgccaccugaaggacgacgaggagaucggguaccgcaagaucaucgagcggcucaagaacaagaagggcaagaacaagcugcuggacggggagcgccucgccgaccggaagaucgccgagcuguucuccaccaagacccacaucggc

SEQ ID NO: 12135 - RNA, 3495 nt, Artificial Sequence
  derived and/or modified CDS sequence (opt1) from CCHVF(CCHVF SPU 556/87)__KJ682811.1__Gn-NSm-Gc
agcgaggaguccgacggcgacugcaucagccgcacccagcugcuccggaccgagacggccgagauccacuccgacaacuacgggggccccggggacaagaucaccaucugcaacggcagcaccaucguggaccagcgccugggguccgagcugggcugcuacaccaucaaccgggucaagagcuucaagcucugcgagaacuccgccacgggcaagagcugcgagaucgacuccaccccggugaagugccgccagggguucugccugaagaucacccaggagggccgggggcacgugaagcugagccgcggcuccgagaucguccucgacgcgugcgacagcuccugcgagaucaugauccccaaggggaccggcgacauccugguggacugcagcggcgggcagcagcacuuccugaaggacaaccucaucgaccugggcugccccaacaucccccugcucgggcggauggccaucuacaucugccgcauguccaaccacccgaagacgaccauggccuuccuguucugguucagcuucggcuacgugaucacgugcauccugugcaaggucaucuucuaccuccugaucguggccggcaccguggggaagaaguucaagcaguaccgggagcugcgcccccagaccugcaccaucugcgagaccacccccgucaacgccaucgacgcggagaugcacgaccucaacugcuccuacaacaucugccccuacugcgccagccggcugacguccgacggccuggcccgccacgugaugcagugcccgaagcggaaggagaagaucgaggagaccgagcucuaccugaaccuggagcgcauccccugggugguccggaagcuccuccaggugagcgagagcaccgggguggcccugaagcgcuccagcuggcugaccguccugcuggugcuccugaucgugucccugagccccguccaguccgcgcccaucggccacgggaagacgaucgagaccuaccaggcccgggagggcuacaccagcuucugccucuucauccugggcuccauccuguucaucgugagcugccucgugaaggggcugaucgacuccgucggcaacagcuucuucccggggcuguccaucugcaagaccugcagcaucggcuccgugaacggguucgagaucgagagccacaagugcuacugcucccucuucugcugccccuacugccgccacugcagcgccgaccgggagauccacaagcugcaccuguccaucugcaagaagcgcaagacgggcagcaacgugauguccgccgucugcaagcggaugugcuuccgcgccaccaucgaggugagcaaccgcgcgcuccugauccggagcaucaucaacaccaccuucgccgucugcauccugacgcucgccgugugcguggucuccaccagcgccguggagauggagucccugcccgccggcaccugggagcgcgaggaggaccugaccaacuucugccaccaggagugccaggugacggagaccgagugccucugccccuacgaggcgcugguccugcggaagccgcuguuccucgacagcaucgugaaggggaagaagaaccugcugaacuccaccagccucgagaccucccugagcaucgaggcccccuggggcgccaucaacgugcaguccacguucaagcccaccgucagcgccgccaacaucgcgcuguccuggagcuccguggagcaccgcgggaacaagauccucgugagcggccgguccgagagcaucaugaagcuggaggagcgcaccgggaucuccugggaccugggcgucgaggacgccagcgagagcaagcuccugaccguguccgugauggaccugagccagauguacucccccgucuucgaguaccucagcggcgaccgccagguggaggaguggccgaaggcgaccugcacgggggacugccccgagcggugcggcugcaccuccagcacgugccugcacaaggaguggccccacucccggaacuggcgcugcaaccccaccuggugcuggggcguggggaccggcugcacgugcugcgggcuggacgucaaggaccucuucaccgacuacauguucgugaaguggaagguggaguacaucaagaccgaggccaucgucugcguggagcugaccagccaggagcggcagugcucccugaucgaggccggcacccgcuucaaccucgggccggugaccaucacccugagcgagccccggaacauccagcagaagcugccgcccgagaucaucacgcuccacccccgcaucgaggagggcuucuucgaccugaugcacguccagaaggugcuguccgccagcaccgugugcaagcuccaguccugcacccacgggguccccggcgaccuccagguguaccacaucggcaaccugcugaagggggacaaggugaacggccaccugauccacaagaucgagccccacuucaacaccagcuggauguccugggacgggugcgaccuggacuacuacugcaacaugggcgacuggccgagcugcacguacaccggggucacccagcacaaccacgccgccuucgugaaccuccugaacaucgagaccgacuacacgaagaacuuccacuuccacuccaagcgggugaccgcccacggcgacacgccccagcuggaccucaaggcgcgccccaccuacggcgccggggaggucaccgugcugguggaggucgccgacauggagcugcacaccaagaagaucgagaucagcggccucaaguucgccucccugagcugcaccgggugcuacgccugcagcuccggcaucagcugcaaggugcggauccacguggacgagcccgacgagcugaccguccacgugaaguccgaggacccggacaucguggcggccgggagcucccucauggcccgcaagcuggaguucggcgccgacagcacguucaaggccuucuccgcgaugcccaagaccagccugugcuucuacaucgucgagcgggaguacugcaaguccugcagccgcgaggacacccagaagugcgugaacaccaagcucgagcgcccccaguccauccugaucgagcacaagggcacgaucaucgggaagcagaacgacacgugcaccgccaaggccagcugcuggcuggaguccgucaagagcuucuucuacggccucaaguccaugcugagcgggaucuucggcaacguguucaucgggaucuuccuguucaucgcccccuucgugcuccugauccuguucuucauguucggcuggcggauccucuucugcuucaagugcugccgccggacccgcggccuguucaaguaccggcaccugaaggacgacgaggagaccggguaccgcaagaucaucgagcggcucaacaacaagaagggcaagaacaagcugcuggacggggagcgccucgccgaccggaagaucgcggagcuguucuccaccaagagccacaucggc

SEQ ID NO: 12136 - RNA, 3495 nt, Artificial Sequence
  derived and/or modified CDS sequence (opt1) from CCHVF(CCHVF SPU 431/85)__KJ682812.1__Gn-NSm-Gc
agcgaggaguccgacggcgacugcaucagccgcacccagcugcuccggaccgagacgaccgagauccacuccgacaacuacgggggccccggggacaagaucaccaucugcaacggcagcaccaucguggaccagcgccugggguccgagcugggcugcuacacgaucaaccgggucaagagcuucaagcucugcgagaacuccgccaccggcaagagcugcgagaucgacuccaccccggugaagugccgccagggguucugccugaagaucacccaggagggccgggggcacgugaagcugagccgcggcuccgagaucguccucgacgccugcgacagcaacugcgagaucaugauccccaaggggacgggcgacauccugguggacugcuccggcgggcagcagcacuuccugaaggacaaccucaucgaccugggcugccccaacaucccccugcucgggaagauggcgaucuacaucugccggaugagcaaccacccgaagaccaccauggccuuccuguucugguucuccuucggcuacgugaucacgugcauccugugcaaggucaucuucuaccuccugaucguggccggcaccguggggaagaaguucaagcaguaccgcgagcugcggccccagaccugcaccaucugcgagaccauccccgucaacgccaucgacgccgagaugcacgaccucaacugcagcuacaacaucugccccuacugcgcgucccgccugacgagcgacggccuggcccggcacgugaugcagugcccgaagcgcaaggagaagguggaggagaccgagcucuaccugaaccuggagcggauccccugggucgugcgcaagcuccuccagguguccgagagcaccggggucgcccugaagcggagcuccuggcucaccgugcugcuggugcuccugaucgucagccugucccccgugcagagcgcccccaucggccacgggaagacgaucgagaccuaccaggcgcgcgagggcuacaccuccuucugccucuucauccugggcagcauccuguucguggucuccugccucgugaaggggcugaucgacagcgugggcaacuccuucuucccggggcugagcaucugcaagaccugcuccaucggcagcaucaacggguucgagaucgagucccacaagugcuacugcagccucuucugcugccccuacugccggcacugccccgccgaccgcgagauccacaagcugcaccuguccaucugcaagaagcggaagacgggcagcaacgucaugcucgccgugugcaagcgcaugugcuuccgggccaccaucgaggucuccaaccgcgcccugcugauccgcaacaucaucaacaccaccuucguggugugcauccucacgcuggcggucugcguggugagcaccuccgccgucgagauggagagccugcccgccggcaccugggagaaggaggaggaccucaccaacuucugccaccaggagugccaggugacggagaccgagugccugugcccguacgaggcccuggugcugcggaagccccucuuccuggacagcaucgucaaggggcgcaagaaccugcucaacuccaccagccuggagaccucccugagcaucgaggcccccuggggcgcgaucaacgugcaguccacguucaagcccaccgugagcgccgccaacaucgcccucuccuggagcuccgucgagcaccgggggaacaagauccuggugagcggccgcuccgagagcaucaugaagcuggaggagcggaccgggaucuccugggaccucggcguggaggacgccagcgaguccaagcugcugaccgucagcgugauggaccucucccagauguacagcccgguguucgaguaccugagcggcgaccgccaggucgaggaguggcccaaggcgaccugcacgggggacugccccgagcggugcggcugcaccuccagcacgugccugcacaaggaguggccccacucccgcaacuggcggugcaacccgaccuggugcuggggcguggggaccggcugcacgugcugcgggcucgacgugaaggaccuguucaccgacuacauguucgucaaguggaagguggaguacaucaagaccgaggccaucgugugcgucgagcugaccagccaggagcgccagugcucccucaucgaggccggcacccgguucaaccuggggcccgugaccaucacccugagcgagccccgcaacauccagcagaagcugcccccggagaucaucacgcugcacccccggaucgaggagggcuucuucgaccugaugcacgugcagcgcguccucuccgccagcaccgugugcaagcugcaguccugcacccacggggugcccggcgaccugcaggucuaccacaucggcaaccuccugaagggggacaaggugaacggccaccugauccacaagaucgagccgcacuucaacaccagcuggauguccugggacgggugcgaccucgacuacuacugcaacaugggcgacuggcccagcugcacguacaccggggugacccagcacaaccacgccgcguucgucaaccugcugaacaucgagaccgacuacacgaagaacuuccacuuccacuccaagcgggugaccgcccacggcgacacgccccagcucgaccugaaggcccgccccaccuacggcgccggggaggugaccguccugguggagguggcggacauggagcuccacaccaagaagaucgagaucagcggccugaaguucgccucccugaccugcaccgggugcuacgccugcagcuccggcaucagcugcaaggucaagauccacguggacgagccggacgagcucacggugcacgucaaguccgaggaccccgacaucguggccgccgggagcagccugauggcgcggaagcuggaguucggcgccgacuccaccuucaaggccuucagcgccaugcccaagaccucccucugcuucuacaucguggagcgcgaguacugcaagagcugcucccgggaggacacccgcaagugcgucaacacgaagcuggaccgcccccagagcauccugaucgagcacaagggcaccaucaucgggaagcagaacaacacgugcaccgccaaggcguccugcuggcucgagagcgugaaguccuucuucuacggccugaagaacaugcugagcgggaucuucggcaacguguucaucgggaucuuccucuucaucgccccguucguccugcugauccucuucuucauguucggcuggcggauccuguucugcuucaagugcugccgccggacccgcggccuguucaaguaccggcaccucaaggacgacgaggagaccggguaccgcaagaucaucgagcggcugaacaacaagaagggcaagaacaagcugcucgacggggagcgccuggccgaccggaagaucgccgagcuguucuccaccaagagccacaucggc

SEQ ID NO: 12137 - RNA, 3495 nt, Artificial Sequence
  derived and/or modified CDS sequence (opt1) from CCHVF(CCHVF SPU 48/90)__KJ682813.1__Gn-NSm-Gc
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggucaaguccuucaagcucugcgagaacagcgccacgggcaaguccugcgugaucgacagcgugcccgucaagugccgccagggguacugccugcggaucacccaggagggccgcgggcacgugaagcugucccggggcagcgaggugguccucgacgcgugcgacaccuccugcgagaucaugauccccaaggggaccggcgacauccugguggacugcagcggcgggcagcagcacuuccugaaggacaaccucaucgaccugggcugccccaagaucccgcugcucgggaagauggccaucuacaucugccgcauguccaaccaccccacgaccaccauggccuuccuguucugguucagcuucggcuacgugaucacgugcauccugugcaaggccaucuucuaccuccugaucaucaucggcacccuggggaagcgguuccgccaguaccgggagcucaagccccagaccugcaccaucugcgagaccacgcccgucaacgccaucgacgcggagaugcacgaccugaacugcuccuacaacaucugcccguacugcgccagccgccugaccuccgacggccucgcccggcacgugacccagugccccaagcgcaaggagaagguggaggagaccgagcuguaccugaaccucgagcggauccccugggucgugcgcaagcugcuccaggugagcgaguccacgggggucgcccucaagcggagcagcuggcugaucgugcugcucgugcuguucaccgucucccugagccccgugcaguccgcgccgaucggccacgggaagaccaucgaggccuaccgcgcccgggagggcuacaccagcaucugccucuucgugcugggcuccauccuguucgucgugagcugccucaugaagcgccugguggacuccgucgggaacagcuucuuccccggccuguccaucugcaagacgugcagcaucuccagcaucaacggguucgagaucgagucccacaagugcuacugcagccucuucugcugccccuacugccggcacugcuccgccgacaaggagauccacaagcugcaccugagcaucugcaagaagcgcaagaccggcuccaacgugaugcucgccgucugcaagcgcaugugcuuccgggcgaccauggaggugagcgaccgcgcccuguucauccgguccaucaucaacaccacguucgugcugugcauccucauccuggccgucugcguggugagcaccagcgccgucgagauggagaaccugcccgccgggaccugggagcgcgaggaggaccucaccaacuucugccaccaggagugccaggugacggagaccgagugccugugcccguacgaggcgcuggugcugcggaagccccucuuccgcgacuccaucgucaagggcaugaagaaccugcugaacagcaccucccucgagaccagccuguccaucgaggcccccuggggcgccaucaacgugcagagcacguacaagcccaccguguccaccgccaacaucgcccugagcugguccagcgucgagcaccgggggaacaagauccucguguccggccgcagcgaguccaucaugaagcuggaggagcggaccgggaucagcugggaccugggcguggaggacgcguccgagagcaagcuccugaccgucuccgugauggaccugagccagauguacagcccgguguucgaguaccucuccggggaccgccaggucgaggaguggcccaaggccacgugcaccggcgacugccccgagcggugcggcugcaccagcuccacgugccugcacaaggaguggccccacagccgcaacuggcggugcaacccgaccuggugcuggggcguggggaccgggugcacgugcugcggccuggacgugaaggaccucuucaccgacuacauguucgucaaguggaagguggaguacaucaagaccgaggccaucgugugcgucgagcugaccucccaggagcgccagugcagccugaucgaggccggcacccgguucaaccucgggcccgugaccaucacgcuguccgagccccgcaacauccagcagaagcugcccccggagaucaucacccuccacccccggaucgaggagggcuucuucgaccugaugcacgugcagaagguccugagcgccuccaccgugugcaagcuccagagcugcacccacggggugcccggcgaccugcaggucuaccacaucgggaaccugcucaagggcgacaaggugaacggccaccugauccacaagaucgagccgcacuucaacacguccuggaugagcugggacgggugcgaccuggacuacuacugcaacaugggcgacuggcccuccugcaccuacaccggggugacccagcacaaccgcgcgagcuucgucaaccuccugaacaucgagacggacuacaccaagaacuuccacuuccacuccaagcgggugaccgcccacggcgacacgccccagcuggaccucaaggcccgccccaccuacggggccggcgagaucaccgugcuggucgagguggcggacauggagcugcacaccaagaagaucgagaucagcggccucaaguucgccucccugaccugcacggggugcuacgccugcagcuccggcaucagcugcaaggugcgcauccacgucgacgagccggacgagcugaccgugcacgucaagagcgacgaccccgacgugguggccgccuccagcucccucauggcgcggaagcuggaguucgggaccgacagcaccuucaaggccuucuccgccaugcccaagacgagccugugcuucuacaucguggagaaggaguacugcaaguccugcagcgaggaggacaccaagaagugcgucaacaccaagcucgagcagccccaguccauccugaucgagcacaagggcaccaucaucgggaagcagaacagcacgugcaccgccaagguguccugcuggcuggagagcgccaaguccuucuucuacggccucaaggacaugcugagcggcaucuucgggaacguguucaucggcaucuuccuguuccucgcgccguucauccugcugauccucuucuucauguucggguggcgcauccugcugugcuucaagugcugccggcgcacccggggccucuucaaguaccgccaccugaaggacgacgaggagaccggguaccggcgcaucaucgagcggcugaacaacaagaagggcaagaacaagcuccuggacggcgagcgccuggccgaccggcgcaucgccgagcuguucuccaccaagacgcacaucggg

SEQ ID NO: 12138 - RNA, 3495 nt, Artificial Sequence
  derived and/or modified CDS sequence (opt1) from CCHVF(CCHVF SPU 187/90)__KJ682814.1__Gn-NSm-Gc
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggucaaguccuucaagcucugcgagaacagcgccacgggcaaguccugcgagaucgacagcgugcccgugaagugccgccagggguacugccugcggaucacccaggagggccgcgggcacgucaagcugucccggggcagcgagguggugcucgacgcgugcgacaccuccugcgagaucaugauccccaaggggaccggcgacauccuggucgacugcagcggcgggcagcagcacuuccugaaggacaaccucaucgaccugggcugccccaagaucccgcugcucgggaagauggccaucuacaucugccgcauguccaaccaccccaagacgaccauggccuuccuguucugguucagcuucggcuacgugaucacgugcauccugugcaaggccaucuucuaccuccugaucaucaucggcacccuggggaagcgguucaagcaguaccgcgagcucaagccccagaccugcaccaucugcgagaccacccccgugaacgccaucgacgcggagaugcacgaccugaacugcuccuacaacaucugcccguacugcgccagccggcugacguccgacggccucgcccgccacgucacccagugccccaagcggaaggagaagguggaggagaccgagcuguaccugaaccucgagcgcauccccugggugguccggaagcugcuccaggugagcgaguccaccgggguggcccucaagcgcagcagcuggcugaucguccugcucgugcuguucacggugucccugagccccguccaguccgcgccgaucggccacgggaagaccaucgaggccuaccgggcccgcgagggcuacaccagcaucugccucuucgugcugggcuccauccuguucguggucagcugccucaugaaggggcugguggacuccgugggcaacagcuucuuccccgggcuguccaucugcaagaccugcagcaucggcuccaucaacggguucgagaucgagagccacaagugcuacugcucccucuucugcugccccuacugccggcacugcagcgccgacaaggagauccacaagcugcaccuguccaucugcaagaagcgcaagacgggcagcaacgucaugcucgccgugugcaagcggaugugcuuccgcgcgaccauggaggucuccaaccgcgcccuguucauccggagcaucaucaacaccaccuucgugcugugcauccucauccuggccgugugcgucguguccacgagcgccguggagauggagaaccugcccgccggcaccugggagcgcgaggaggaccucaccaacuucugccaccaggagugccaggucaccgagacggagugccugugcccguacgaggcgcuggugcugcggcgcccccucuuccuggacagcaucgugaaggggaugaagaaccugcucaacuccaccagccuggagaccucccugagcaucgaggcccccuggggcgccaucaacguccaguccaccuacaagcccacggugagcaccgccaacaucgcccucuccuggagcuccguggagcaccgggggaacaagauccuggucagcggccgcuccgagagcaucaugaagcuggaggagcggaccgggaucuccugggaccucggcguggaggacgcgagcgaguccaagcugcugaccgugagcgucauggaccucucccagauguacagcccgguguucgaguaccugagcggcgaccgccagguggaggaguggcccaaggcgaccugcacgggggacugccccgagcggugcggcugcaccuccagcacgugccugcacaaggaguggccccacucccgcaacuggcggugcaacccgaccuggugcuggggcgucgggaccggcugcacgugcugcgggcucgacgugaaggaccuguucaccgacuacauguucgugaaguggaaggucgaguacaucaagaccgaggccaucgugugcguggagcugaccagccaggagcgccagugcucccucaucgaggccggcacccgguucaaccuggggcccgucaccaucacccugagcgagccccgcaacauccagcagaagcugcccccggagaucaucacgcugcacccccggaucgaggagggcuucuucgaccugaugcacgugcagaaggugcucuccgccagcaccgucugcaagcugcaguccugcacccacggggugcccggcgaccuccagguguaccacaucggcaaccuccugaagggggacaaggucaacggccaccugauccacaagaucgagccgcacuucaacaccagcuggauguccugggacgggugcgaccucgacuacuacugcaacaugggcgacuggcccagcugcacguacaccggggugacccagcacaaccacgccuccuucgugaaccugcugaacaucgagaccgacuacacgaagaacuuccacuuccacagcaagcgcgucaccgcccacggcgacacgccccagcucgaccugaaggcccggcccaccuacggcgccggggagaucaccgugcugguggaggucgcggacauggagcuccacaccaagaagaucgagaucuccggccugaaguucgccagccugaccugcaccgggugcuacgccugcuccagcggcaucuccugcaaggugcgcauccacguggacgagccggacgagcucacgguccacgucaagagcgacgaccccgacgugguggccgccagcuccagccugauggcgcggaagcuggaguucgggaccgacuccaucuucaaggccuucagcgccaugcccaagaccucccucugcuucuacaucguggagcgcgagcacugcaagagcugcuccgaggaggacaccaagaagugcgugaacacgaagcuggagcagccccagagcauccugaucgagcacaagggcaccaucaucggcaagcagaacuccacgugcaccgccaagaccagcugcuggcucgaguccgucaagagcuucuucuacgggcugaagaacaugcuguccggcaucuucgggaacguguucaucggcaucuuccucuuccuggccccguucauccugcucauccuguucuucauguucggguggcgcauccuguucugcuucaagugcugccggcgcacccggggccucuucaaguaccgccaccugaaggacgacgaggagaccggcuaccggcgcaucaucgagcggcugaacaacaagaaggggaagaacaagcuccuggacggcgagcgccuggcggaccggcgcaucgccgagcuguucagcaccaagacccacaucggg

SEQ ID NO: 12139 - RNA, 3495 nt, Artificial Sequence
  derived and/or modified CDS sequence (opt1) from CCHVF(CCHVF Haskovo-V46/13)__KR092379.1__Gn-NSm-Gc
agcgaggagcugggcgacgacugcaucucccgcacccagcuccugcggaccgagacggccgagauccacgacgacaacuacgggggccccggggacaagaucaccaucugcaacggcagcaccaucguggaccagcgccugggguccgagcucggcugcuacaccaucaaccggggcaagagcuucaagcugugcgagaacuccgccacggggaagaccugcgagaucgacagcaccccggucaagugccgccagggcuucugccugaagaucacccaggaggggcggggccacgugaagcucucccgcgggagcgaggugguccuggacgcgugcgacuccagcugcgaggugaugauccccaagggcacgggcgacauccugguggacugcuccgggggccagcagcacuuccucaaggacaaccugaucgaccuggggugcccccacaucccccuccugggcaagauggccaucuacaucugccggaugagcaaccacccgcgcaccaccauggccuuccuguucugguucuccuucggcuacgucaucacgugcaucuucugcaaggcccucuucuacagccugaucaucaucgggacccugggcaagaagaucaagcaguaccgggagcucaagccccagaccugcaccaucugcgagaccacgcccgugaacgccaucgacgcggagaugcacgaccugaacugcuccuacaacaucugccccuacugcgccagccgccugaccuccgacgggcucgcccggcacgugacccagugcccgaagcgcaaggagaaggucgaggagaccgagcuguaccugaaccucgagcggauccccuggaucgugcgcaagcugcuccaggugagcgaguccacgggcgucgcccucaagcggagcagcuggcugaucgugcugcucgugcugcugcccgucucccucagccccgugcaguccgcgccgguggggcacggcaagaccaucgagaccuaccagacccgcgagggcuucacgagcaucugccuguucaugcugggguccauccucuucaucgucagcugccuggugaagggccugguggacuccgucggggacagcuucuuccccggccucuccgugugcaagaccugcagcaucggguccaucaacggcuucgagaucgagagccacaagugcuacugcucccuguucugcugccccuacugccggcacugcagcgccgaccgcgagauccaccagcugcaccucuccaucugcaagaagcggaagaccggcagcaacgugaugcuggccgucugcaagcgcaugugcuuccgggccaccaucgaggccucccgccgcgcgcugcucauccggagcaucaucaacacgaccuucgccaugugcauccugacccugaccaucugcguggucuccacgagcgccguggagauggagaaccuccccgccgggaccugggagcgcgaggaggaccugaccaacuucugccaccaggagugccaggugaccgagacggagugccugugcccguacgaggcccugguccuccggaagccccuguuccuggacagcaucgugaagggcaugaagaaccuccugaacuccaccagccuggagaccucccucagcaucgaggcgcccuggggcgccaucaacgugcaguccaccuucaagcccaccgucagcacggccaacaucgcccuguccuggagcuccguggagcaccgcgggaacaagauccuggugaccgggcggagcgaguccaucaugaagcucgaggagcgcaccggcgucagcugggaccugggcguggaggacgccuccgagagcaagcugcucaccguguccaucauggaccugagccagauguacuccccggucuucgaguaccugagcggggaccgccagguggaggaguggcccaaggcgacgugcaccggcgacugccccgagcggugcgggugcaccagcuccacgugccuccacaaggaguggccccacagccggaacuggcgcugcaacccgaccuggugcuggggcgugggcaccgggugcacgugcugcggcgucgacgugaaggaccuguucaccgaccacauguucgugaaguggaaggucgaguacaucaagaccgaggccaucgugugcguggagcugaccucccaggagcggcagugcagccucaucgaggccgggacccgcuucaaccugggccccgucaccaucacgcuguccgagccccggaacauccagcagaagcugcccccggagaucaucacccugcaccccaagaucgaggagggguucuucgaccugaugcacgugcagaaggugcucagcgccuccaccgucugcaagcugcagagcugcacccacggcauccccggcgaccuccagguguaccacaucgggaaccugcugaagggcgaccgcgugaacgggcaccugauccacaagaucgagccgcacuucaacacguccuggaugagcugggacggcugcgaccucgacuacuacugcaacaugggggacuggcccuccugcaccuacaccggcgucacccagcacaaccacgccgcguucgugaaccugcugaacaucgagacggacuacaccaagaccuuccacuuccacagcaagcgggugaccgcccacggcgacacgccccagcucgaccugaaggcccgccccaccuacggggccggcgagaucaccguccugguggagguggcggacauggagcuccacaccaagaaggucgagaucuccgggcugaaguucgccagccugacgugcaccggcugcuacgccugcuccagcgggaucuccugcaaggugcggauccacguggacgagccggacgagcucaccguccacgucaagagcuccgaccccgacgugguggccgccggcaccagccugauggcgcgcaagcuggaguucggcacggacagcaccuucaaggccuucuccgccaugcccaagaccagccucugcuucuacaucguggagcgggaguacugcaaguccugcagcgaggacgacacccagaagugcguggacaccaagcuggagcagccccaguccauccugaucgagcacaaggggacgaucaucggcaagcagaacgacacgugcaccgcccgcgccagcugcuggcucgaguccgucaagagcuucuucuacgggcugaagaacaugcugggcuccguguucgggaacuuccucaucggcauccugcuguuccucgcgccguucgugcugcugguccucuucuucauguucggcuggaagauccuguucugcuucaagugcugccgccggacccgcgggcuguucaaguaccggcaccucaaggacgacgaggagaccggcuaccgccggaucaucgagcgccugaacagcaagaaggggaagaaccggcugcucgacggcgagcgccuggccgaccggaagaucgccgagcuguucuccaccaagacccacaucggc

SEQ ID NO: 12140 - RNA, 3495 nt, Artificial Sequence
  derived and/or modified CDS sequence (opt1) from CCHVF(CCHVF 24-R-2012)__KR814856.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacacguccugcgaggugaugauccccaaggggaccggcgacauccuggucgacugcagcggcgggcagcagcacuuccugaaggacaaccucaucgaccugggcugcccccacaucccgcugcucgggaagauggccaucuacaucugccggauguccaaccacccccgcaccaccauggccuuccuguucugguucagcuucggcuacgugaucacgugcaucuucugcaaggcccuguucuacucccucaucaucaucggcacccuggggaagaagaucaagcaguaccgggagcugaagccccagaccugcaccaucugcgagacggcccccgugaacgcgaucgacgccgagaugcacgaccucaacugcagcuacaacaucugcccguacugcgccucccgccugaccagcgacggccuggcccggcacgucccccagugccccaagcgcaaggagaagguggaggagaccgagcucuaccugaaccuggagcggauccccuggaucgugcgcaagcuccugcaggucuccgagagcaccgggguggcgcugaagcgguccagcuggcucaucgugcugcugguccuccugacggugagccuguccccggugcagagcgcccccgucggccacgggaagaccaucgagaccuaccagacccgcgagggcuucacguccgugugccucuucaugcugggcagcauccuguuccucguguccugccuggucaaggggcugguggacagcguguccgacagcuucuuccccggccucuccgucugcaagaccugcagcaucggguccaucaacggcuucgagaucgagagccacaagugcuacugcucccuguucugcugccccuacugccggcacugcagcgccgaccgcgagauccaccagcugcaccucuccaucugcaagaagcggaagauggggagcaacgugaugcuggccgucugcaagcgcaugugcuuccgggccaccaucgaggcgucccgccgcgcccugcucauccggagcaucaucaacaccacguucgugaucugcauccugacccugaccaucugcguggucuccaccagcgccguggagauggagaaccucccgagcggcacgugggagcgcgaggaggaccugaccaacuucugccaccaggagugccaggugaccgagaccgagugccugugccccuacgaggcccugguccuccggaagccccuguuccuggacuccaucgugaagggcaugaagaaccuccugaacagcacgucccuggagaccagccucuccaucgaggcccccuggggcgcgaucaacgugcagagcaccuucaagccgaccgucuccaccgccaacaucgcccugagcugguccagcguggagcaccgcgggaacaagauccuggugacggggcgguccgagagcaucaugaagcucgaggagcgcaccggcgucuccugggaccuggggguggaggacgccagcgaguccaagcugcucaccgugagcaucauggaccugucccagauguacagccccgucuucgaguaccugagcggcgaccgccagguggaggaguggcccaaggcgaccugcacgggcgacugccccgagcggugcgggugcaccuccagcacgugccuccacaaggaguggccgcacucccggaacuggcgcugcaaccccaccuggugcuggggcguggggaccggcugcacgugcugcggcgucgacgugaaggaccuguucaccgaccacauguucgugaaguggaaggucgaguacaucaagaccgaggccaucgugugcguggagcugaccagccaggagcggcagugcucccucaucgaggccgggacccgcuucaaccugggccccgucaccaucacccugagcgagccccggaacauccagcagaagcucccgcccgagaucaucacgcugcaccccaagguggaggagggguucuucgaccugaugcacgugcagaagguccucuccgccagcaccgugugcaagcugcaguccugcacccacggcaucccgggggaccuccagguguaccacaucggcaaccuccugaagggcgaccgcgucaacgggcaccugauccacaagaucgagccccacuucaacaccagcuggauguccugggacggcugcgaccucgacuacuacugcaacaugggggacuggcccagcugcacguacaccggcgugacccagcacaaccacgccgccuucgugaaccugcugaacaucgagaccgacuacacgaagaccuuccacuuccacuccaagcgggucaccgcgcacggggacacgccccagcucgaccugaaggcccgcccgaccuacggcgccggcgagaucaccgugcugguggaggucgccgacauggagcuccacaccaagaagguggagaucagcgggcugaaguucgcgucccuggccugcaccggcugcuacgccugcagcuccgggaucagcugcaaggugcggauccacgucgacgagcccgacgagcucacggugcacgugaaguccaacgaccccgacgucguggccgccagcaccagccugauggcgcgcaagcuggaguucggcaccgacuccaccuucaaggccuucagcgccaugcccaagacgucccucugcuucuacaucguggagcgggaguacugcaagagcugcuccgaggaggacacccagaagugcgucgacaccaagcuggagcagccgcagagcauccugaucgagcacaaggggaccaucaucggcaagcagaacgacacgugcaccgccaaggccuccugcuggcucgagagcgugaaguccuucuucuacggccugaagaacaugcuggggagcguguucggcaacuucuucaucgggauccuccuguuccuggcgcccuucguccuccuggugcuguucuucauguucggcuggaagauccucuucugcuucaagugcugccgccgcacccgggggcugcugaaguaccgccuccugaaggacgacgaggagaccggcuaccggcgcaucaucgagcggcugaacaacaagaagggcaagaaccgccuccuggacggggagcggcuggccgaccgcaagaucgccgagcuguucuccaccaagacgcacaucggc

SEQ ID NO: 12141 - RNA, 3495 nt, Artificial Sequence
  derived and/or modified CDS sequence (opt1) from CCHVF(CCHVF 36-ST-2014)__KR814857.1__Gn-NSm-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucaccugcaucuucugcaaggcccuguucuacagccucaucaucaucggcacgcuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccugcaggugagcgaguccaccggggucgcgcugaagcgcagcagcuggcucaucgugcugcuggugcuccugacggucucccugagccccgugcaguccgccccggugggccacgggaagaccaucgagaccuaccagacccgggagggcuucacgaacaucugccucuucaugcugggcagcauccuguucaucgucuccugccucgugaaggggcugguggacagcgucuccgacagcuucuuccccggccuguccgugugcaagaccugcagcaucggguccaucaacggcuucgagaucgagagccacaagugcuacugcucccucuucugcugccccuacugccgccacugcagcgccgaccgggagauccaccagcugcaccuggggaucugcaagaagcgcaagaccggcuccaacgugaugcucgccgucugcaagcggaugugcuucaaggccaccaucgaggcgagccgccgggcccugcugauccgcuccaucaucaacacgaccuucgugaucugcauccucacccuggccaucugcgucgugagcaccuccgccguggagauggagaaccugcccgccggcacgugggagcgcgaggaggaccucaccaacuucugccaccaggagugccaggucagcgagaccgagugccugugcccguacgaggcgcuggugcugcggaagccccucuuccuggacagcaucgugaaggggaugaagaaccugcucaacuccaccagccuggagacgucccugagcaucgaggcccccuggggcgccaucaacguccaguccaccuucaagcccaccgugagcaccgccaacaucgcccucuccuggagcuccguggagcaccgcgggaacaagauccuggucaccggccggagcgaguccaucaugaagcuggaggagcgcacgggggugagcugggaccucggcguggaggacgcguccgagagcaagcugcugaccgucuccaucauggaccucagccagauguacuccccgguguucgaguaccugagcggcgaccggcagguggaggaguggcccaaggccaccugcaccggggacugccccgagcgcugcggcugcacgagcuccaccugccugcacaaggaguggccccacagccggaacuggcgcugcaacccgaccuggugcuggggggucggcaccggcugcacgugcugcgggguggacgugaaggaccucuucaccgaccacauguucaucaaguggaaggucgaguacaucaagaccgaggccaucgugugcguggagcugaccucccaggagcggcagugcagccugaucgaggccggcacgcgcuucaaccucgggcccgucaccaucacccuguccgagccccggaacauccagcagaagcugcccccggagaucaucacccuccaccccaagaucgaggagggcuucuucgaccugaugcacgugcagaaggugcugagcgccuccacggucugcaagcuccagagcugcacccacgggauccccggcgaccugcagaucuaccacaucggcaaccugcucaagggggaccgccugaacggccaccugauccacaagaucgagccgcacuucaacaccuccuggaugagcugggacgggugcgaccucgacuacuacugcaacaugggcgacuggcccuccugcaccuacacgggggugacccagcacaaccacgcggccuucgugaaccugcugaacaucgagaccgacuacaccaagacguuccacuuccacagcaagcgggucaccgcccacggcgacaccccccagcucgaccugaaggcccgccccaccuacggcgcgggggagaucacggugcugguggaggucgccgacauggagcuccacaccaagaagguggagaucuccggccugaaguucgccagccuggccugcaccgggugcuacgccugcuccagcggcaucuccugcaaggugcggauccacgucgacgagccggacgagcucaccgugcacgugaagagcuccgaccccgacgucguggcggccagcacgagccugauggcccgcaagcuggaguucgggaccgacuccaccuucaaggccuucagcgccaugcccaagaccucccucugcuucuacaucguggagcgggaguacugcaagagcugcuccgaggacgacacgaagaagugcgucgacaccaagcuggaccagccccagagcauccugaucgagcacaagggcaccaucaucggcaagcagaacgacaccugcaccgcgaaggccuccugcuggcucgagagcgugaaguccuucuucuacgggcugaagaacaugcugggcagcguguucgggaacuucuucgucggcauccuccuguuccuggccccguucgugcuccuggugcuguucuucaugugcggguggaaguuccucuucugcuucaagugcugccgccggacgcgcggccuguucaaguaccgccaccugaaggacgacgaggagaccggcuaccggcgcaucaucgagcggcucaacuccaagaaggggaagaaccgccugcuggacggcgagcggcucgccgaccgcaagaucgccgagcuguucagcaccaagucccacaucggg

SEQ ID NO: 12142 - RNA, 3495 nt, Artificial Sequence
  derived and/or modified CDS sequence (opt1) from CCHVF(CCHVF 37-R-2013)__KR814858.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacacguccugcgaggugaugauccccaaggggaccggcgacauccuggucgacugcagcggcgggcagcagcacuuccugaaggacaaccucaucgaccugggcugcccccacaucccgcugcucgggaagauggccaucuacaucugccggauguccaaccacccccgcaccaccauggccuuccuguucugguucagcuucggcuacgugaucacgugcaucuucugcaaggcccuguucuacucccucaucaucaucggcacccuggggaagaagaucaagcaguaccgggagcugaagccccagaccugcaccaucugcgagacggcccccgugaacgcgaucgacgccgagaugcacgaccucaacugcagcuacaacaucugcccguacugcgccucccgccugaccagcgacggccuggcccggcacgucccccagugccccaagcgcaaggagaagguggaggagaccgagcucuaccugaaccuggagcggauccccuggaucgugcgcaagcuccugcaggucuccgagagcaccgggguggcgcugaagcgguccagcuggcucaucgugcugcugguccuccugacggugagccuguccccggugcagagcgcccccgucggccacgggaagaccaucgagaccuaccagacccgcgagggcuucacguccgugugccucuucaugcugggcagcauccuguuccucguguccugccuggucaaggggcugguggacagcguguccgacagcuucuuccccggccucuccgucugcaagaccugcagcaucggguccaucaacggcuucgagaucgagagccacaagugcuacugcucccuguucugcugccccuacugccggcacugcagcgccgaccgcgagauccaccagcugcaccucuccaucugcaagaagcggaagauggggagcaacgugaugcuggccgucugcaagcgcaugugcuuccgggccaccaucgaggcgucccgccgcgcccugcucauccggagcaucaucaacaccacguucgugaucugcauccugacccugaccaucugcguggucuccaccagcgccguggagauggagaaccucccgagcggcacgugggagcgcgaggaggaccugaccaacuucugccaccaggagugccaggugaccgagaccgagugccugugccccuacgaggcccugguccuccggaagccccuguuccuggacuccaucgugaagggcaugaagaaccuccugaacagcacgucccuggagaccagccucuccaucgaggcccccuggggcgcgaucaacgugcagagcaccuucaagccgaccgucuccaccgccaacaucgcccugagcugguccagcguggagcaccgcgggaacaagauccuggugacggggcgguccgagagcaucaugaagcucgaggagcgcaccggcgucuccugggaccuggggguggacgacgccagcgaguccaagcugcucaccgugagcaucauggaccugucccagauguacagccccgucuucgaguaccugagcggcgaccgccagguggaggaguggcccaaggcgaccugcacgggcgacugccccgagcggugcgggugcaccuccagcacgugccuccacaaggaguggccgcacucccggaacuggcgcugcaaccccaccuggugcuggggcguggggaccggcugcacgugcugcggcgucgacgugaaggaccuguucaccgaccacauguucgugaaguggaaggucgaguacaucaagaccgaggccaucgugugcguggagcugaccagccaggagcggcagugcucccucaucgaggccgggacccgcuucaaccugggccccgucaccaucacccugagcgagccccggaacauccagcagaagcucccgcccgagaucaucacgcugcaccccaagguggaggagggguucuucgaccugaugcacgugcagaagguccucuccgccagcaccgugugcaagcugcaguccugcacccacggcaucccgggggaccuccagguguaccacaucggcaaccuccugaagggcgaccgcgucaacgggcaccugauccacaagaucgagccccacuucaacaccagcuggauguccugggacggcugcgaccucgacuacuacugcaacaugggggacuggcccagcugcacguacaccggcgugacccagcacaaccacgccgccuucgugaaccugcugaacaucgagaccgacuacacgaagaccuuccacuuccacuccaagcgggucaccgcgcacggggacacgccccagcucgaccugaaggcccgcccgaccuacggcgccggcgagaucaccgugcugguggaggucgccgacauggagcuccacaccaagaagguggagaucagcgggcugaaguucgcgucccuggccugcaccggcugcuacgccugcagcuccgggaucagcugcaaggugcggauccacgucgacgagcccgacgagcucacggugcacgugaaguccaacgaccccgacgucguggccgccagcaccagccugauggcgcgcaagcuggaguucggcaccgacuccaccuucaaggccuucagcgccaugcccaagacgucccucugcuucuacaucguggagcgggaguacugcaagagcugcuccgaggaggacacccagaagugcgucgacaccaagcuggagcagccgcagagcauccugaucgagcacaaggggaccaucaucggcaagcagaacgugaccugcacggccaaggccuccugcuggcucgagagcgugaaguccuucuucuacggccugaagaacaugcuggggagcgucuucggcaacuucuucaucgggauccuccuguuccuggcgcccuucgugcuccuggugcuguucuucauguucggcuggaagauccucuucugcuucaagugcugccgccgcacccgggggcugcugaaguaccgccuccugaaggacgacgaggagaccggcuaccggcgcaucaucgagcggcugaacaacaagaagggcaagaaccgccuccuggacggggagcggcuggccgaccgcaagaucgccgagcuguucuccaccaagacgcacaucggc

SEQ ID NO: 12143 - RNA, 3495 nt, Artificial Sequence
  derived and/or modified CDS sequence (opt1) from CCHVF(CCHVF 44-ST-2010)__KR814859.1__Gn-NSm-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccugcugugguucuccuucggcuacgucaucaccugcaucuucugcaaggcccucuucuacagccugaucaucaucggcacgcuggggaagaagaucaagcaguaccgcgagcucaagccccagaccugcaccaucugcgagaccgcccccgugaacgcgaucgacgccgagaugcacgaccugaacugcuccuacaacaucugcccguacugcgccagccggcugacguccgacggccucgcccgccacgugacccagugccccaagcggaaggagaaggucgaggagaccgagcuguaccugaaccucgagcgcauccccuggaucgugcggaagcugcugcaggugagcgaguccaccggggucgcgcucaagcgcagcagcuggcugaucgugcugcucgugcugcugacggucucccucagccccgugcaguccgccccggugggccacgggaagaccaucgagaccuaccagacccgggagggcuucacgaacaucugccuguucaugcugggcagcauccucuucaucgucuccugccuggugaaggggcugguggacagcgucuccgacagcuucuuccccggccucuccgugugcaagaccugcagcuucggguccaucaacggcuucgagaucgagagccacaagugcuacugcucccuguucugcugccccuacugccgccacugcagcgccgaccgggagauccaccagcugcaccucgggaucugcaagaagcgcaagaccggcuccaacgugaugcuggccgucugcaagcggaugugcuucaaggccaccaucgaggcgagccgccgggcccugcucauccgcuccaucaucaacacgaccuucgugaucugcauccugacccuggccaucugcgucgugagcaccuccgccguggagauggagaaccuccccgccggcacgugggagcgcgaggaggaccugaccaacuucugccaccaggagugccaggucagcgagaccgagugccugugcccguacgaggcgcuggugcuccggaagccccuguuccuggacagcaucgugaaggggaugaagaaccuccugaacuccaccagccuggagacgucccucagcaucgaggcccccuggggcgccaucaacguccaguccaccuucaagcccaccgugagcaccgccaacaucgcccuguccuggagcuccguggagcaccgcgggaacaagauccuggucaccggccggagcgaguccaucaugaagcucgaggagcgcacgggggugagcugggaccugggcguggaggacgcguccgagagcaagcugcucaccgucuccaucauggaccugagccagauguacuccccgguguucgaguaccugagcggcgaccggcagguggaggaguggcccaaggccaccugcaccggggacugccccgagcgcugcggcugcacgagcuccaccugccuccacaaggaguggccccacagccggaacuggcgcugcaacccgaccuggugcuggggggucggcaccggcugcacgugcugcgggguggacgugaaggaccuguucaccgaccacauguucaucaaguggaaggucgaguacaucaagaccgaggccaucgugugcguggagcugaccucccaggagcggcagugcagccucaucgaggccggcacgcgcuucaaccuggggcccgucaccaucacccuguccgagccccggaacauccagcagaagcuccccccggagaucaucacccugcaccccaagaucgaggagggcuucuucgaccugaugcacgugcagaaggugcucagcgccuccacggucugcaagcugcagagcugcacccacgggauccccggcgaccugcagaucuaccacaucggcaaccuccugaagggggaccgccugaacggccaccucauccacaagaucgagccgcacuucaacaccuccuggaugagcugggacgggugcgaccuggacuacuacugcaacaugggcgacuggcccuccugcaccuacacgggggugacccagcacaaccacgcggccuucgugaaccugcucaacaucgagaccgacuacaccaagacguuccacuuccacagcaagcgggucaccgcccacggcgacaccccccagcuggaccugaaggcccgccccaccuacggcgcgggggagaucacggugcucguggaggucgccgacauggagcugcacaccaagaagguggagaucuccggccugaaguucgccagccucgccugcaccgggugcuacgccugcuccagcggcaucuccugcaaggugcggauccacgucgacgagccggacgagcugaccgugcacgugaagagcuccgaccccgacgucguggcggccagcacgagccugauggcccgcaagcucgaguucgggaccgacuccaccuucaaggccuucagcgccaugcccaagaccucccugugcuucuacaucguggagcgggaguacugcaagagcugcuccgaggacgacacgaagaagugcgucgacaccaagcuggaccagccccagagcauccucaucgagcacaagggcaccaucaucggcaagcagaacgacaccugcaccgcgaaggccuccugcuggcuggagagcgugaaguccuucuucuacgggcugaagaacaugcucggcagcguguucgggaacuucuucgucggcauccugcuguuccucgccccguucgugcugcuggugcucuucuucaugugcggguggaagauccuguucugcuucaagugcugccgccggacgcgcggccuguucaaguaccgccaccucaaggacgacgaggagaccggcuaccggcgcaucaucgagcggcugaacuccaagaaggggaagaaccgccugcucgacggcgagcggcuggccgaccgcaagaucgccgagcuguucagcaccaagucccacaucggg

SEQ ID NO: 12144 - RNA, 3495 nt, Artificial Sequence
  derived and/or modified CDS sequence (opt1) from CCHVF(CCHVF 46-ST-2012)__KR814860.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucaccugcaucuucugcaaggcccuguucuacagccucaucaucaucggcacgcuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugaccgugucccugagcccggugcaguccgcccccgucggccacgggaagacgaucgagaccuaccagacccgcgagggcuucaccagcaucugccucuucaugcugggcuccauccuguuccucgugagcugccuggugaaggggcuggucgacuccgugagcgacuccuucuuccccggccucagcgugugcaagacgugcuccaucgggagcaucaacggcuucgagaucgagucccacaagugcuacugcagccuguucugcugccccuacugccggcacugcuccgccgaccgcgagauccaccagcugcaccucagcaucugcaagaagcggaagaccggguccaacgucaugcuggccgugugcaagcgcaugugcuuccgggccaccaucgaggcgagccgccgcgcccugcucauccgguccaucaucaacgccaccuucgucaucugcauccugacgcugaccaucugcguggugagcaccagcgccgucgagauggagucccucccggccggcaccugggagcgcgaggaggaccugacgaacuucugccaccaggagugccaggugaccgagaccgagugccugugccccuacgaggcgcuggugcuccggaagccccuguuccuggacagcaucgucaagggcaugaagaaccuccugaacuccaccagccuggagacgucccucagcaucgaggcccccuggggggccaucaacgugcaguccaccuucaagccgaccgugagcaccgccaacaucgcccuguccuggagcuccgucgagcaccgcggcaacaagauccuggugaccgggcggagcgaguccaucaugaagcucgaggagcgcacgggcgugagcugggaccugggggucgaggacgcguccgagagcaagcugcucaccguguccaucauggaccugagccagauguacagccccguguucgaguaccuguccggcgaccggcaggucgaggaguggcccaaggccaccugcaccggcgacugccccgagcgcugcgggugcacgagcuccaccugccuccacaaggaguggccgcacagccggaacuggcgcugcaaccccaccuggugcuggggcguggggaccggcugcacgugcugcggcguggacgucaaggaccuguucaccgaccacauguucgugaaguggaagguggaguacaucaagaccgaggccaucgucugcguggagcugaccucccaggagcggcagugcagccucaucgaggccgggacgcgcuucaaccugggccccgugaccaucacccuguccgagccccggaacauccagcagaagcucccgcccgagaucaucacccugcaccccaaggucgaggagggguucuucgaccugaugcacgugcagaaggugcucagcgccuccacggucugcaagcugcagagcugcacccacggcaucccgggggaccugcagguguaccacaucggcaaccuccugaagggcgaccgcaucaacgggcaccugauccacaagaucgagccccacuucaacaccuccuggaugagcugggacggcugcgaccucgacuacuacugcaacaugggggacuggcccuccugcaccuacacgggcgugacccagcacaaccacgcggccuucgucaaccugcugaacaucgagaccgacuacaccaagacguuccacuuccacagcaagcgggugaccgcccacggggacaccccccagcucgaccugaaggcccgcccgaccuacggcgcgggcgagaucacggugcuggucgagguggccgacauggagcuccacaccaagaagguggagaucuccgggcugaaguucgccagccuggccugcaccggcugcuacgccugcuccagcgggaucuccugcaagguccggauccacguggacgagcccgacgagcucaccgugcacgucaagagcagcgaccccgacgugguggcggccuccacgagccugauggcccgcaagcuggaguucggcaccgacuccaccuucaaggccuucagcgccaugcccaagaccucccucugcuucuacaucgucgagcgggaguacugcaagagcugcuccgaggaggacacgcagaagugcguggacacccgccuggagcagccgcagagcauccugaucgagcacaaggggaccaucaucggcaagcagaacgacaccugcaccgcgaaggccuccugcuggcucgagagcgugaaguccuucuucuacggccugaagaacaugcuggggagcgucuucggcaacuucuucaucgggauccuccuguuccuggcccccuucgugcuccuggugcuguucuucauguucggcuggaagauccucuucugcuucaagugcugccgccggacgcgcgggcugcugaaguaccggcaccucaaggacgacgaggagaccggcuaccgccggaucaucgagcgccugaacaacaagaagggcaagaaccggcugcucgacggggagcgccuggccgaccggaagaucgccgagcuguucuccaccaagacccacaucggc

SEQ ID NO: 12145 - RNA, 3495 nt, Artificial Sequence
  derived and/or modified CDS sequence (opt1) from CCHVF(CCHVF 47-ST-2013)__KR814861.1__Gn-NSm-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcaagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccuccaggugagcgaguccaccggggucgcgcugaagcgcagcagcuggcucaucgugcugcuggugcuccugacggucucccugagccccgugcaguccgccccggugggccacgggaagaccaucgagaccuaccagacccgggagggcuucacgagcaucugccucuucaugcugggcuccauccuguucaucgucagcugccucgugaaggggcugguggacuccgucagcgacuccuucuuccccggccugagcgugugccggaccugcuccaucgggagcaucaacggcuucgagaucgagucccacaagugcuacugcagccucuucugcugccccuacugccgccacugcuccgccgaccgcgagauccaccagcugcaccugagcaucugcaagaagcggaagaccggguccaacgugaugcucgccgucugcaagcgcaugugcuucaaggccaccaucgaggcgagccggcgcgcccuguucauccgcuccaucaucaacacgaccuucgugaccugcauccugacccucgccaucugcgucgugagcacgagcgccguggagauggaggaccugcccgccggcaccugggagcgggaggaggaccugaccaacuucugccaccaggagugccaggucaccgagacggagugccucugcccguacgaggcgcuggugcugcgcaagccccuguuccucgacuccaucgugaagggcaugaagaaccugcugaacagcaccucccucgagaccagccuguccaucgaggcccccuggggcgccaucaacguccagagcaccuucaagcccaccguguccacggccaacaucgcccugagcugguccagcguggagcaccgggggaacaagauccucgucaccgggcgcuccgagagcaucaugaagcuggaggagcggaccggcguguccugggaccuggggguggaggacgcgagcgaguccaagcuccugaccgucagcaucauggaccugucccagauguacagcccgguguucgaguaccucagcggcgaccgccagguggaggaguggcccaaggccacgugcaccggcgagugccccgagcggugcgggugcaccuccagcacgugccugcacaaggaguggccccacucccgcaacuggcggugcaacccgaccuggugcuggggcgucgggaccggcugcacgugcugcggcguggacgugaaggaccuguucaccgaccacauguucaucaaguggaaggucgaguacaucaagaccgaggccaucgugugcguggagcucaccagccaggagcgccagugcucccugaucgaggccgggacccgguucaaccugggccccgucaccaucacgcucagcgagccccgcaacauccagcagaagcugcccccggagaucaucacccugcaccccaagaucgaggagggguucuucgaccucaugcacgugcagaaggugcuguccgccagcaccgucugcaagcugcaguccugcacccacggcauccccggggaccuccagaucuaccacaucggcaaccugcugaagggcgaccgggugaacgggcaccucauccacaagaucgagccgcacuucaacacgagcuggauguccugggacggcugcgaccuggacuacuacugcaacaugggggacuggcccagcugcaccuacaccggcgugacccagcacaaccacgcggccuucgucaaccugcucaacaucgagacggacuacaccaagaccuuccacuuccacuccaagcgcgugaccgcccacggggacacgccccagcuggaccugaaggcccggcccaccuacggcgcgggcgagaucaccgugcucgucgagguggccgacauggagcugcacaccaagaagguggaggucagcgggcugaaguucgccucccucgccugcacgggcugcuacgccugcagcuccgggaucagcugcaaggugcgcauccacguggacgagccggacgagcugaccguccacgugaaguccagcgaccccgacguggucgcggccagcaccucccugauggcccggaagcucgaguucggcaccgacagcacguucaaggccuucuccgccaugcccaagaccagccugugcuucuacaucguggagcgcgaguacugcaaguccugcagcgaggacgacaccaagaagugcguggacaccaagcuggagcagccccaguccauccucaucgagcacaaggggaccaucaucggcaagcagaacgacacgugcaccgcgaaggccagcugcuggcuggaguccgucaagagcuucuucuacggccugaagaacaugcucggguccguguucggcaacuucuucguggggauccugcuguuccucgccccguucguccugcuggugcuguucuucauguucggcuggaagauccuguucugcuucaagugcugccggcgcacccgcgggcuguucaaguaccggcaccucaaggacgacgaggagaccggcuaccgccggaucaucgagcgccugaacagcaagaagggcaagaaccggcugcucgacggggagcgccuggccgaccggaagaucgccgagcuguucuccacgaagacccacaucggc

SEQ ID NO: 12146 - RNA, 3495 nt, Artificial Sequence
  derived and/or modified CDS sequence (opt1) from CCHVF(CCHVF 52-R-2014)__KR814862.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacacguccugcgaggugaugauccccaaggggaccggcgacauccuggucgacugcagcggcgggcagcagcacuuccugaaggacaaccucaucgaccugggcugcccccacgugccgcugcucgggaagauggccaucuacaucugccggauguccaaccacccccgcaccaccauggccuuccuguucugguucagcuucggcuacgugaucacgugcaucuucugcaaggcccuguucuacucccucaucaucaucggcacccuggggaagaagaucaagcaguaccgggagcugaagccccagaccugcaccaucugcgagacggcccccgucaacgcgaucgacgccgagaugcacgaccucaacugcagcuacaacaucugcccguacugcgccucccgccugaccagcgacggccuggcccggcacgugccccagugccccaagcgcaaggagaagguggaggagaccgagcucuaccugaaccuggagcggauccccuggaucguccgcaagcuccuccagguguccgagagcaccgggguggcgcugaagcgguccagcuggcucaucguccugcuggugcuccugacggugagccuguccccgguccagagcgcccccgugggccacgggaagaccaucgagaccuaccagacccgcgagggcuucacguccgugugccucuucaugcugggcagcauccuguuccucgucuccugccuggugaaggggcugguggacagcgucuccgacagcuucuuccccggccucuccgugugcaagaccugcagcaucggguccaucaacggcuucgagaucgagagccacaagugcuacugcucccuguucugcugccccuacugccggcacugcagcgccgaccgcgagauccaccagcugcaccucuccaucugcaagaagcggaagauggggagcaacgucaugcuggccgugugcaagcgcaugugcuuccgggccaccaucgaggcgucccgccgcgcccugcucauccggagcaucaucaacaccacguucgugaucugcauccugacccugaccaucugcgucguguccaccagcgccguggagauggagaaccucccgagcggcacgugggagcgcgaggaggaccugaccaacuucugccaccaggagugccaggucaccgagaccgagugccugugccccuacgaggcccuggugcuccggaagccccuguuccuggacuccaucgugaagggcaugaagaaccuccugaacagcacgucccuggagaccagccucuccaucgaggcccccuggggcgcgaucaacguccagagcaccuucaagccgaccguguccaccgccaacaucgcccugagcugguccagcguggagcaccgcgggaacaagauccuggucacggggcgguccgagagcaucaugaagcucgaggagcgcaccggcguguccugggaccuggggguggacgacgccagcgaguccaagcugcucaccgucagcaucauggaccugucccagauguacagccccguguucgaguaccugagcggcgaccgccagguggaggaguggcccaaggcgaccugcacgggcgacugccccgagcggugcgggugcaccuccagcacgugccuccacaaggaguggccgcacucccggaacuggcgcugcaaccccaccuggugcuggggcgucgggaccggcugcacgugcugcggcguggacgugaaggaccuguucaccgaccacauguucgucaaguggaagguggaguacaucaagaccgaggccaucgugugcgucgagcugaccagccaggagcggcagugcucccucaucgaggccgggacccgcuucaaccugggccccgugaccaucacccugagcgagccccggaacauccagcagaagcucccgcccgagaucaucacgcugcaccccaagguggaggagggguucuucgaccugaugcacguccagaaggugcucuccgccagcaccgugugcaagcugcaguccugcacccacggcaucccgggggaccugcaggucuaccacaucggcaaccuccugaagggcgaccgcgugaacgggcaccugauccacaagaucgagccccacuucaacaccagcuggauguccugggacggcugcgaccucgacuacuacugcaacaugggggacuggcccagcugcacguacaccggcgugacccagcacaaccacgccgccuucgucaaccugcugaacaucgagaccgacuacacgaagaccuuccacuuccacuccaagcgggugaccgcgcacggggacacgccccagcucgaccugaaggcccgcccgaccuacggcgccggcgagaucaccgugcuggucgagguggccgacauggagcuccacaccaagaagguggagaucagcgggcugaaguucgcgucccuggccugcaccggcugcuacgccugcagcuccgggaucagcugcaagguccggauccacguggacgagcccgacgagcucacggugcacgucaaguccaacgaccccgacgugguggccgccagcaccagccugauggcgcgcaagcuggaguucggcaccgacuccaccuucaaggccuucagcgccaugcccaagacgucccucugcuucuacaucgucgagcgggaguacugcaagagcugcuccgaggaggacacccagaagugcguggacaccaagcuggagcagccgcagagcauccugaucgagcacaaggggaccaucaucggcaagcagaacgacacgugcaccgccaaggccggcugcuggcucgaguccgucaagagcuucuucuacgggcugaagaacaugcugggcuccguguucgggaacuucuucaucggcauccuccuguuccuggcgcccuucgugcuccuggugcuguucuucauguucggguggaagauccucuucugcuucaagugcugccgccgcacccggggccugcugaaguaccgccuccugaaggacgacgaggagaccggcuaccggcgcaucaucgagcggcugaacaacaagaaggggaagaaccgccuccuggacggcgagcggcuggccgaccgcaagaucgccgagcuguucagcaccaagacgcacaucggg

SEQ ID NO: 12147 - RNA, 3495 nt, Artificial Sequence
  derived and/or modified CDS sequence (opt1) from CCHVF(CCHVF 75-R-2012)__KR814863.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcgcgcccgugaagugccgccagggguucugccugaagaucacccaggagggccgggggcacgugaagcugucccgcggcagcgaggucgugcucgacgccugcgacuccagcugcgaggugaugauccccaaggggaccggcgacauccuggucgacugcuccggcgggcagcagcacuuccugaaggacaaccucaucgaccugggcugcccccacaucccgcugcucgggaagauggccaucuacaucugccggaugagcaaccacccccgcacgaccauggccuuccuguucugguucuccuucggcuacgugaucaccugcaucuucugcaaggcccuguucuacagccucaucaucaucggcacccuggggaagaagaucaagcaguaccgggagcugaagccccagacgugcaccaucugcgagaccgcgcccgugaacgccaucgacgccgagaugcacgaccucaacugcuccuacaacaucugcccguacugcgccagccgccugaccuccgacggccuggcgcggcacgucccccagugccccaagcgcaaggagaagguggaggagacggagcucuaccugaaccuggagcggauccccuggaucgugcgcaagcuccugcaggucagcgaguccaccgggguggcccugaagcggagcagcuggcucaucgugcugcugguccuccugaccgugucccugagcccggugcaguccgcccccgucggccacgggaagaccaucgagacguaccagacccgcgagggcuucaccagcaucugccucuucaugcugggcuccauccuguuccucgugagcugccuggugaaggggcuggucaacuccgugagcgacuccuucuuccccggccucagcgugugcaagaccugcuccaucgggagcaucaacggcuucgagaucgagucccacaagugcuacugcagccuguucugcugccccuacugccggcacugcuccgccgaccgcgagauccaccagcugcaccucagcaucugcaagaagcggaagacgggguccaacgucaugcuggccgugugcaagcgcaugugcuuccgggcgaccaucgaggccagccgccgcgcccugcucauccgguccaucaucaacaccaccuucgucaucugcauccugacgcugaccaucugcguggugagcaccagcgccgucgagauggagaaccucccguccggcaccugggagcgcgaggaggaccugacgaacuucugccaccaggagugccaggugaccgagaccgagugccugugccccuacgaggcccuggugcuccggaagccccuguuccuggacagcaucgucaagggcaugaagaaccuccugaacuccaccagccuggagacgucccucagcaucgaggcgcccuggggggccaucaacgugcaguccaccuucaagccgaccgugagcaccgccaacaucgcccuguccuggagcuccgucgagcaccgcggcaacaagauccuggugaccgggcggagcgaguccaucaugaagcucgaggagcgcacgggcgugagcugggaccugggggucgaggacgccuccgagagcaagcugcucaccguguccaucauggaccugagccagauguacagccccguguucgaguaccuguccggcgaccggcaggucgaggaguggcccaaggcgaccugcaccggcgacugccccgagcgcugcgggugcacgagcuccaccugccuccacaaggaguggccgcacagccggaacuggcgcugcaaccccaccuggugcuggggcguggggaccggcugcacgugcugcggcguggacgucaaggaccuguucaccgaccacauguucgugaaguggaagguggaguacaucaagaccgaggccaucgucugcguggagcugaccucccaggagcggcagugcagccucaucgaggccgggacgcgcuucaaccugggccccgugaccaucacccuguccgagccccggaacauccagcagaagcucccgcccgagaucaucacccugcaccccaaggucgaggagggguucuucgaccugaugcacgugcagaaggugcucagcgccuccacggucugcaagcugcagagcugcacccacggcaucccgggggaccugcagguguaccacaucggcaaccuccugaagggcgaccgcgugaacgggcaccugauccacaagaucgagccccacuucaacaccuccuggaugagcugggacggcugcgaccucgacuacuacugcaacaugggggacuggcccuccugcaccuacacgggcgucacccagcacaaccacgccgcguucgugaaccugcugaacaucgagaccgacuacaccaagacguuccacuuccacagcaagcgggugaccgcccacggggacaccccccagcucgaccugaaggcccgcccgaccuacggcgccggcgagaucacgguccugguggagguggcggacauggagcuccacaccaagaaggucgagaucuccgggcugaaguucgccagccuggccugcaccggcugcuacgccugcuccagcgggaucuccugcaaggugcggauccacguggacgagcccgacgagcucaccguccacgugaagagcagcgaccccgacguggucgccgcguccacgagccugauggcccgcaagcuggaguucggcaccgacuccaccuucaaggccuucagcgccaugcccaagaccucccucugcuucuacaucguggagcgggaguacugcaagagcugcuccgaggaggacacgcagaagugcguggacaccaagcuggagcagccgcagagcauccugaucgagcacaaggggaccaucaucggcaagcagaacgacaccugcaccgccaaggcguccugcuggcucgagagcgucaaguccuuccuguacggccugaagaacaugcucgggagcguguucggcaacuucuucaucgggauccugcuguuccucgcccccuucgugcugcugguccucuucuucauguucggcuggaagauccuguucugcuucaagugcugccgccgcacgcgggggcugcucaaguaccgccugcugaaggacgacgaggagaccggcuaccggcgcaucaucgagcggcucaacaacaagaagggcaagaaccgccugcuggacggggagcggcucgccgaccgcaagaucgccgagcuguucuccaccaagacccacaucggc

SEQ ID NO: 12148 - RNA, 3495 nt, Artificial Sequence
  derived and/or modified CDS sequence (opt1) from CCHVF(CCHVF 75-ST-2010)__KR814864.1__Gn-NSm-Gc
agcgaggaguccggcgacgacugcaucagccgcacccagcugcuccggaccgagacggccgagauccacgacgacaacuacgggggccccggggacaagaucaccaucugcaacggcuccaccaucguggaccagcgccuggggagcgagcugggcugcuacaccaucaaccgggucaaguccuucaagcucugcgagaacagcgccacgggcaagaccugcgagaucgacuccaccccggugaagugccgccagggguucugccugaagaucacccaggagggccgggggcacgugaagcugagccgcggcuccgaggucgugcucgacgcgugcgacagcuccugcgaggugaugauccccaaggggacgggcgacauccuggucgacugcagcggcgggcagcagcacuuccugaaggacaaccucaucgaccugggcugcccccacaucccccugcucgggaagauggccaucuacaucugccggauguccaaccacccgcgcaccaccauggccuuccuguucugguucagcuucggcuacgugaucacgugccuguucugcaaggcccucuucuacucccugaucaucaucggcacccuggggaagaagaucaagcaguaccgggagcuccgcccccagaccugcaccaucugcgagaccgcccccgugaacgcgaucgacgccgagaugcacgaccugaacugcagcuacaacaucugccccuacugcgccucccggcugacgagcgacggccucgcccgccacgucccgcagugccccaagcggaaggagaagguggaggagaccgagcuguaccugaaccucgagcgcauccccuggaucgugcggaagcugcugcaggucuccgagagcaccgggguggcgcucaagcgcagcuccuggcugaucgugcugcucguccugcugaccgugagccucucccccgugcagagcgccccggucggccacgggaagacgaucgagaccuaccagacccgggagggcuucaccuccaucugccuguucaugcugggcagcauccucuuccugguguccugccuggugaaggggcucgucgacagcguguccgacagcuucuuccccggccuguccgugugcaagacgugcagcaucggguccaucaacggcuucgagaucgagagccacaagugcuacugcucccugcucugcugccccuacugccgccacugcagcgccgaccgggagauccaccagcugcaccuguccaucugcaagaagcgcaagaccgggagcaacgucaugcucgccgugugcaagcggaugugcuuccgcgccaccaucgaggcgucccgccgggcccugcugauccgcagcaucaucaacaccacguucgucaucugcauccucacccugaccaucugcguggugagcaccuccgccgucgagauggagaaccugcccagcggcacgugggagaaggaggaggaccugaccaacuucugccaccaggagugccaggugaccgagaccgagugccucugcccguacgaggcccuggugcugcggaagccccucuuccuggacuccaucgucaagggcaugaagaaccugcucaacagcacgucccuggagaccagccuguccaucgaggcccccuggggcgcgaucaacgugcagagcaccuucaagcccaccguguccaccgccaacaucgcccucagcugguccagcgucgagcaccgcgggaacaagauccuggugacggggcgguccgagagcaucaugaagcuggaggagcgcaccggcguguccugggaccucggggucgaggacgccagcgaguccaagcugcugaccgugagcaucauggaccucagccagauguacuccccgguguucgaguaccugagcggcgaccggcaggucgaggaguggcccaaggcgaccugcacgggcgacugccccgagcgcugcgggugcaccuccagcacgugccugcacaaggaguggccccacucccggaacuggcgcugcaacccgaccuggugcuggggcguggggaccggcugcacgugcugcggcguggacgucaaggaccucuucaccgaccacauguucgugaaguggaagguggaguacaucaagaccgaggccaucgucugcguggagcugaccagccaggagcggcagugcucccugaucgaggccgggacccgcuucaaccucggccccgugaccaucacccugagcgagccccggaacauccagcagaagcugcccccggagaucaucacgcuccaccccaaggucgaggagggguucuucgaccugaugcacgugcagaaggugcuguccgccagcaccgucugcaagcuccaguccugcacccacggcauccccggggaccuccagguguaccacaucggcaaccugcucaagggcgaccgcgugaacgggcaccugauccacaagaucgagccgcacuucaacaccagcuggauguccugggacggcugcgaccuggacuacuacugcaacaugggggacuggcccagcugcacguacaccggcgucacccagcacaaccacgccgccuucgugaaccuccugaacaucgagaccgacuacacgaagaccuuccacuuccacuccaagcgggugaccgcgcacggggacacgccccagcuggaccucaaggcccgccccaccuacggcgccggcgagaucaccguccugguggagguggccgacauggagcugcacaccaagaaggucgagaucagcgggcucaaguucgcgucccuggccugcaccggcugcuacgccugcagcuccgggaucagcugcaaggugcggauccacguggacgagccggacgagcugacgguccacgucaagagcuccgaccccgacgugguggccgccagcaccucccucauggcgcgcaagcuggaguucggcaccgacagcaccuucaaggccuucuccgccaugcccaagacgagccugugcuucuacaucguggagcgggaguacugcaaguccugcagcgaggaggacacccagaagugcguggacaccaagcucgagcagccccaguccauccugaucgagcacaaggggaccaucaucggcaagcagaacgacacgugcaccgccaaggccagcugcuggcuggaguccgucaagagcuucuucuacggccucaagaacaugcugggguccguguucggcaacuucuucaucgggauccugcuguuccuggcgccguucgugcugcucguccuguucuucauguucggcuggaagauccuguucugcuucaagugcugccgccgcgcccgggggcuccugaaguaccgccaccugaaggacgacgaggagaccggcuaccggaagaucaucgagcgccucaacaacaagaagggcaagaaccggcugcuggacggggagcgccucgccgaccggaagaucgccgagcuguucagcaccaagacccacaucggc

SEQ ID NO: 12149 - RNA, 3495 nt, Artificial Sequence
  derived and/or modified CDS sequence (opt1) from CCHVF(CCHVF 81-R-2014)__KR814865.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugaccgugucccugagcccggugcaguccgcccccgucggccacgggaagacgaucgagaccuaccagacccgcgagggcuucaccagcaucugccucuucaugcugggcuccauccuguuccucgugagcugccuggugaaggggcuggucgacuccgugagcgacuccuucuuccccggccucagcgugugcaagacgugcuccaucgggagcaucaacggcuucgagaucgagucccacaagugcuacugcagccuguucugcugccccuacugccggcacugcuccgccgaccgcgagauccaccagcugcaccucagcaucugcaagaagcggaagaccggguccaacgucaugcuggccgugugcaagcgcaugugcuuccgggccaccaucgaggcgagccgccgcgcccugcucauccgguccaucaucaacaccacguucgucaucugcauccugacccugaccaucugcguggugagcaccagcgccgucgagauggagaaccucccggccggcacgugggagcgcgaggaggaccugaccaacuucugccaccaggagugccaggugaccgagaccgagugccugugccccuacgaggcccuggugcuccggaagccccuguuccuggacuccaucgucaagggcaugaagaaccuccugaacagcacgucccuggagaccagccucuccaucgaggcgcccuggggcgccaucaacgugcagagcaccuucaagccgaccguguccaccgccaacaucgcccugagcugguccagcgucgagcaccgcgggaacaagauccuggugacggggcgguccgagagcaucaugaagcucgaggagcgcaccggcguguccugggaccugggggucgaggacgccagcgaguccaagcugcucaccgugagcaucauggaccugucccagauguacagccccguguucgaguaccugagcggcgaccggcaggucgaggaguggcccaaggcgaccugcacgggcgacugccccgagcgcugcgggugcaccuccagcacgugccuccacaaggaguggccgcacucccggaacuggcgcugcaaccccaccuggugcuggggcguggggaccggcugcacgugcugcggcguggacgucaaggaccuguucaccgaccacauguucgugaaguggaagguggaguacaucaagaccgaggccaucgucugcguggagcugaccagccaggagcggcagugcucccucaucgaggccgggacccgcuucaaccugggccccgugaccaucacccugagcgagccccggaacauccagcagaagcucccgcccgagaucaucacgcugcaccccaaggucgaggagggguucuucgaccugaugcacgugcagaaggugcucuccgccagcaccgucugcaagcugcaguccugcacccacggcaucccgggggaccuccagguguaccacaucggcaaccugcugaagggcgaccgcaucaacgggcaccugauccacaagaucgagccccacuucaacaccagcuggauguccugggacggcugcgaccucgacuacuacugcaacaugggggacuggcccagcugcacguacaccggcgugacccagcacaaccacgccgcguucgucaaccugcugaacaucgagaccgacuacacgaagaccuuccacuuccacuccaagcgggugaccgcccacggggacacgccccagcucgaccugaaggcccgcccgaccuacggcgccggcgagaucaccgugcuggucgagguggcggacauggagcuccacaccaagaagguggagaucagcgggcugaaguucgccucccuggccugcaccggcugcuacgccugcagcuccgggaucagcugcaagguccggauccacguggacgagcccgacgagcucacggugcacgucaaguccagcgaccccgacgugguggccgcgagcaccucccugauggcccgcaagcuggaguucggcaccgacagcaccuucaaggccuucuccgccaugcccaagacgagccucugcuucuacaucgucgagcgggaguacugcaaguccugcagcgaggaggacacccagaagugcguggacacccgccuggagcagccgcaguccauccugaucgagcacaaggggaccaucaucggcaagcagaacgacacgugcaccgccaaggcgagcugcuggcucgaguccgucaagagcuucuucuacggccugaagaacaugcugggguccguguucggcaacuucuucaucgggauccuccuguuccuggcccccuucgugcuccuggugcuguucuucauguucggcuggaagauccucuucugcuucaagugcugccgccggacccgcgggcugcugaaguaccggcaccucaaggacgacgaggagaccggcuaccgccggaucaucgagcgccugaacaacaagaagggcaagaaccggcugcucgacggggagcgccuggccgaccggaagaucgccgagcuguucagcaccaagacgcacaucggc

SEQ ID NO: 12150 - RNA, 3495 nt, Artificial Sequence
  derived and/or modified CDS sequence (opt1) from CCHVF(CCHVF 3756-ST-2007)__KR814866.1__Gn-NSm-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccuccaggugagcgaguccaccggggucgcgcugaagcgcagcagcuggcucaucgugcugcuggugcuccugacggucucccugagccccgugcaguccgccccggugggccacgggaagaccaucgagaccuaccagacccgggagggcuucacgagcaucugccucuucaugcugggcuccauccuguucaucgucagcugccucgugaaggggcugguggacuccgucagcgacuccuucuuccccggccugagcgugugcaagaccugcuccaucgggagcaucaacggcuucgagaucgagucccacaagugcuacugcagccucuucugcugccccuacugccgccacugcuccgccgaccgggagauccaccagcugcaccugagcaucugcaagaagcgcaagaccggguccaacgugaugcucgccgucugcaagcggaugugcuucaaggccaccaucgaggcgagccgccgggcccugcugauccgcuccaucaucaacacgaccuucgugaucugcauccucacccuggccaucugcgucgugagcaccagcgccguggagauggaggaccugcccgccggcacgugggagcgcgaggaggaccucaccaacuucugccaccaggagugccaggucaccgagaccgagugccugugcccguacgaggcgcuggugcugcggaagccccucuuccuggacuccaucgugaagggcaugaagaaccugcucaacagcacgucccuggagaccagccuguccaucgaggcccccuggggcgccaucaacguccagagcaccuucaagcccaccguguccaccgccaacaucgcccucagcugguccagcguggagcaccgcgggaacaagauccuggucacggggcgguccgagagcaucaugaagcuggaggagcgcaccggcguguccugggaccucgggguggaggacgcgagcgaguccaagcugcugaccgucagcaucauggaccucucccagauguacagcccgguguucgaguaccugagcggcgaccgccagguggaggaguggcccaaggcgaccugcacgggcgacugccccgagcggugcgggugcaccuccagcacgugccugcacaaggaguggccccacucccggaacuggcgcugcaacccgaccuggugcuggggcgucgggaccggcugcacgugcugcggcguggacgugaaggaccucuucaccgaccacauguucaucaaguggaaggucgaguacaucaagaccgaggccaucgugugcguggagcugaccagccaggagcggcagugcucccugaucgaggccgggacccgcuucaaccucggccccgucaccaucacccugagcgagccccggaacauccagcagaagcugcccccggagaucaucacgcuccaccccaagaucgaggagggguucuucgaccugaugcacgugcagaaggugcuguccgccagcaccgucugcaagcuccaguccugcacccacggcauccccggggaccugcagaucuaccacaucggcaaccugcucaagggcgaccgcgugaacgggcaccugauccacaagaucgagccgcacuucaacaccagcuggauguccugggacggcugcgaccuggacuacuacugcaacaugggggacuggcccagcugcacguacaccggcgugacccagcacaaccacgccgccuucgucaaccuccugaacaucgagaccgacuacacgaagaccuuccacuuccacuccaagcgggugaccgcccacggggacacgccccagcuggaccucaaggcccgccccaccuacggcgcgggcgagaucaccgugcuggucgagguggccgacauggagcugcacaccaagaagguggagaucagcgggcucaaguucgccucccugaccugcacgggcugcuacgccugcagcuccgggaucagcugcaagguccggauccacguggacgagccggacgagcugaccgugcacgucaaguccagcgaccccgacgugguggccgcgagcaccucccucauggcccgcaagcuggaguucggcaccgacagcacguucaaggccuucuccgccaugcccaagaccagccugugcuucuacaucgucgagcgggaguacugcaaguccugcagcgaggacgacaccaagaagugcguggacaccaagcucgagcagccccaguccauccugaucgagcacaaggggaccaucaucggcaagcagaacgacacgugcaccgccaaggcgagcugcuggcuggaguccgucaagagcuucuucuacggccucaagaacaugcugggguccguguucggcagcuucuucguggggauccuccucuuccugaccccguucgugcugcucguccuguucuucauguucggcuggaagauccuguucugcuucaagugcugccgccggacccgcgggcuguucaaguaccgccaccugaaggacgacgaggagacgggcuaccggcgcaucaucgagcggcugaacuccaagaagggcaagaaccgccuccuggacggggagcggcuggccgaccgcaagaucgccgagcuguucagcaccaagacccacaucggc

SEQ ID NO: 12151 - RNA, 3495 nt, Artificial Sequence
  derived and/or modified CDS sequence (opt1) from CCHVF(CCHVF 3809-ST-2007)__KR814867.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugaccgugucccugagcccggugcaguccgcccccgucggccacgggaagacgaucgagaccuaccagacccgcgagggcuucaccagcaucugccucuucaugcugggcuccauccuguuccucgugagcugccuggugaaggggcuggucgacuccgugagcgacuccuucuuccccggccucagcgugugcaagacgugcuccaucgggagcgucaacggcuucgagaucgagucccacaagugcuacugcagccuguucugcugccccuacugccggcacugcuccgccgaccgcgagauccaccagcugcaccucagcgugugcaagaagcggaagaccggguccaacgucaugcuggccgugugcaagcgcaugugcuuccgggccaccaucgaggcgagccgccgcgcccugcucauccgguccaucaucaacaccacguucgugaucugcauccugacccugaccaucugcgucgugagcaccagcgccguggagauggagaaccucccggccggcacgugggagcgcgaggaggaccugaccaacuucugccaccaggagugccaggucaccgagaccgagugccugugccccuacgaggcccuggugcuccggaagccccuguuccuggacuccaucgugaagggcaugaagaaccuccugaacagcacgucccuggagaccagccucuccaucgaggcgcccuggggcgccaucaacguccagagcaccuucaagccgaccguguccaccgccaacaucgcccugagcugguccagcguggagcaccgcgggaacaagauccuggucacggggcgguccgagagcaucaugaagcucgaggagcgcaccggcguguccugggaccuggggguggaggacgccagcgaguccaagcugcucaccgucagcaucauggaccugucccagauguacagccccguguucgaguaccugagcggcgaccgccagguggaggaguggcccaaggcgaccugcacgggcgacugccccgagcggugcgggugcaccuccagcacgugccuccacaaggaguggccgcacucccggaacuggcgcugcaaccccaccuggugcuggggcgucgggaccggcugcacgugcugcggcguggacgugaaggaccuguucaccgaccacauguucgucaaguggaagguggaguacaucaagaccgaggccaucgugugcgucgagcugaccagccaggagcggcagugcucccucaucgaggccgggacccgcuucaaccugggccccgugaccaucacccugagcgagccccggaacauccagcagaagcucccgcccgagaucaucacgcugcaccccaagguggaggagggguucuucgaccugaugcacguccagaaggugcucuccgccagcaccgugugcaagcugcaguccugcacccacggcaucccgggggaccugcaggucuaccacaucggcaaccuccugaagggcgaccgcgugaacgggcaccugauccacaagaucgagccccacuucaacaccagcuggauguccugggacggcugcgaccucgacuacuacugcaacaugggggacuggcccagcugcacguacaccggcgugacccagcacaaccacgccgcguucgucaaccugcugaacaucgagaccgacuacacgaagaccuuccacuuccacuccaagcgggugaccgcccacggggacacgccccagcucgaccugaaggcccgcccgaccuacggcgccggcgagaucaccgugcuggucgagguggcggacauggagcuccacaccaagaagguggagaucagcgggcugaaguucgccucccuggccugcaccggcugcuacgccugcagcuccgggaucagcugcaagguccggauccacguggacgagcccgacgagcucacggugcacgucaaguccagcgaccccgacgugguggccgcgagcaccucccugauggcccgcaagcuggaguucggcaccgacagcaccuucaaggccuucuccgccaugcccaagacgagccucugcuucuacaucgucgagaaggaguacugccgguccugcagcgaggaggacacccagaagugcguggacaccaagcuggagcagccgcaguccauccugaucgagcacaaggggaccaucaucggcaagcagaacgacacgugcaccgccaaggcgagcugcuggcucgaguccgucaagagcuucuucuacggccugaagaacaugcugggguccguguucggcaacuucuucaucgggauccuccuguuccugacccccuucgugcuccuggugcuguucuucauguucggcuggaagauccucuucugcuucaagugcugccgccgcacccgggggcugcugaaguaccgccaccucaaggacgacgaggagaccggcuaccggcgcaucaucgagcggcugaacaacaagaagggcaagaaccgccugcucgacggggagcggcuggccgaccgcaagaucgccgagcuguucagcacgaagacccacaucggc

SEQ ID NO: 12152 - RNA, 3495 nt, Artificial Sequence
  derived and/or modified CDS sequence (opt1) from CCHVF(CCHVF 3820-ST-2007)__KR814868.1__Gn-NSm-Gc
agcgaggagcccggcgacgacugcaucucccgcacccagcugcucaagaccgagacggccgagauccacgacgacaacuacgggagcccgggcgacaagaucaccaucugcaacggguccaccaucguggaccagcggcugggcagcgagcuggggugcuacaccaucaaccgcgucaaguccuucaagcucugcgagaacagcgccacgggcaagaccugcgagaucgacuccacccccgugaagugccggcagggcuucugccugaagaucacccaggaggggcgcggccacgugaagcugagccggggguccgaggucgugcucgacgcgugcgacagcuccugcgagaucaugauccccaagggcacgggggacauccugguggacugcagcggcggccagcagcacuuccugaaggacaaccucaucgaccuggggugcccccacaucccgcugcucggcaagauggccaucuacaucugccgcauguccaaccacccccggaccaccauggccuuccuguucugguucagcuucggguacgucaucaccugcaucuucugcaaggcccuguucuacucccucaucaucaucggcacgcugggcaagaagaucaagcaguaccgcgagcugaagccccagaccugcaccaucugcgagaccgcccccgugaacgcgaucgacgccgagaugcacgaccucaacugcagcuacaacaucugcccguacugcgccucccggcugacgagcgacgggcuggcccgccacgugacccagugccccaagcggaaggagaaggucgaggagaccgagcucuaccugaaccuggagcgcauccccuggaucgugcggaagcuccugcagguguccgagagcaccggcgucgcgcugaagcgcagcuccuggcucaucgugcugcuggugcuccuggccgucagccugucccccgugcagagcgccccgguggggcacggcaagacgaucgagaccuaccagacccgggagggguucaccuccaucugccucuucaugcugggcagcauccuguucaucgucuccugccucgugaagggccugguggacagcgucuccgacagcuucuuccccgggcuguccgugugcaagacgugcagcaucggcuccaucaacggguucgagaucgagagccacaagugcuacugcucccucuucugcugccccuacugccgccacugcagcgccgaccgggagauccaccagcugcaccuguccaucugcaagaagcgcaagaccggcagcaacgugaugcucgccgucugcaagcggaugugcuucaaggcgaccaucgaggccucccgccgggcccugcugauccgcagcaucaucaacaccacguucgugaugugcauccucacccuggccaucugcgucgugagcaccuccgccguggagauggaggaccugcccgcggggaccugggagcgcgaggaggaccucacgaacuucugccaccaggagugccaggucaccgagaccgagugccugugcccguacgaggcccuggugcugcggaagccccucuuccuggacagcaucgugaagggcaugaagaaccugcucaacuccaccagccuggagacgucccugagcaucgaggcccccuggggcgccaucaacguccaguccaccuucaagcccaccgugagcaccgccaacaucgcgcucuccuggagcuccguggagcaccgcgggaacaagauccuggucaccggccggagcgaguccaucaugaagcuggaggagcgcacgggggugagcugggaccucggcguggaggacgccuccgagagcaagcugcugaccgucuccaucauggaccucagccagauguacagcccgguguucgaguaccuguccggggaccggcagguggaggaguggcccaaggccaccugcaccggcgacugccccgagcgcugcggcugcacgagcuccaccugccugcacaaggaguggccccacagccggaacuggcgcugcaacccgaccuggugcuggggggucggcaccgggugcacgugcugcggcguggacgugaaggaccucuucaccgaccacauguucaucaaguggaaggucgaguacaucaagaccgaggccaucgugugcguggagcugaccucccaggagcggcagugcagccugaucgaggccggcacgcgcuucaaccucgggcccgucaccaucacccuguccgagccccggaacauccagcagaagcugcccccggagaucaucacccuccaccccaagaucgaggagggcuucuucgaccugaugcacgugcagaaggugcugagcgcguccacggucugcaagcuccagagcugcacccacgggauccccggcgaccugcagaucuaccacaucgggaaccugcucaagggcgaccgcgugaacggccaccugauccacaagaucgagccgcacuucaacaccuccuggaugagcugggacgggugcgaccuggacuacuacugcaacaugggcgacuggcccuccugcaccuacacgggggugacccagcacaaccacgccgccuucgucaaccuccugaacaucgagaccgacuacaccaagacguuccacuuccacagcaagcgggugaccgcccacggcgacaccccccagcuggaccucaaggcgcgccccaccuacggggccggcgagaucacggugcuggucgagguggccgacauggagcugcacaccaagaagguggagaucuccggccucaaguucgccagccugaccugcaccgggugcuacgccugcuccagcggcaucuccugcaagguccggauccacguggacgagccggacgagcugacggugcacgucaagagcagcgaccccgacgugguggcggccuccaccagccucauggcccgcaagcuggaguucgggaccgacuccaccuucaaggccuucagcgccaugcccaagacgucccugugcuucuacaucgucgagcgggaguacugcaagagcugcuccgaggacgacaccaagaagugcguggacaccaagcucgagcagccccagagcauccugaucgagcacaagggcaccaucaucgggaagcagaacgacaccugcacggcgaaggccuccugcuggcuggagagcgugaaguccuucuucuacggccucaagaacaugcugggcagcgucuucggguccuucuucgugggcauccugcucuuccuggccccguucgugcugcucguccuguucuucauguucggguggaagauccuguucugcuucaagugcugccgccggacccgcggccucuucaaguaccgccaccugaaggacgacgaggagaccggguaccggcgcaucaucgagcggcugaacagcaagaagggcaagaaccgccuccuggacggcgagcggcuggccgaccgcaagaucgccgagcucuucuccaccaagacgcacaucggg

SEQ ID NO: 12153 - RNA, 3495 nt, Artificial Sequence
  derived and/or modified CDS sequence (opt1) from CCHVF(CCHVF 4495-ST-2008)__KR814869.1__Gn-NSm-Gc
agcgaggaguccggcgacgacugcaucagccgcacccagcugcuccggaccgagacggccgagauccacgacgacaacuacgggggccccggggacaagaucaccaucugcaacggcuccaccaucguggaccagcgccuggggagcgagcugggcugcuacaccaucaaccgggucaaguccuucaagcucugcgagaacagcgccacgggcaagaccugcgagaucgacuccaccccggugaagugccgccagggguucugccugaagaucacccaggagggccgggggcacgugaagcugagccgcggcuccgaggucgugcucgacgcgugcgacagcuccugcgaggugaugauccccaaggggacgggcgacauccuggucgacugcagcggcgggcagcagcacuuccugaaggacaaccucaucgaccugggcugcccccacaucccccugcucgggaagauggccaucuacaucugccggauguccaaccacccgcgcaccaccauggccuuccuguucugguucagcuucggcuacgugaucacgugccuguucugcaaggcccucuucuacucccugaucaucaucggcacccuggggaagaagaucaagcaguaccgggagcuccgcccccagaccugcaccaucugcgagaccgcccccgugaacgcgaucgacgccgagaugcacgaccugaacugcagcuacaacaucugccccuacugcgccucccggcugacgagcgacggccucgcccgccacgucccgcagugccccaagcggaaggagaagguggaggagaccgagcuguaccugaaccucgagcgcauccccuggaucgugcggaagcugcugcaggucuccgagagcaccgggguggcgcucaagcgcagcuccuggcugaucgugcugcucguccugcugaccgugagccucucccccgugcagagcgccccggucggccacgggaagacgaucgagaccuaccagacccgggagggcuucaccuccaucugccuguucaugcugggcagcauccucuuccugguguccugccuggugaaggggcucgucgacagcguguccgacagcuucuuccccggccuguccgugugcaagacgugcagcaucggguccaucaacggcuucgagaucgagagccacaagugcuacugcucccugcucugcugccccuacugccgccacugcagcgccgaccgggagauccaccagcugcaccuguccaucugcaagaagcgcaagaccgggagcaacgucaugcucgccgugugcaagcggaugugcuuccgcgccaccaucgaggcgucccgccgggcccugcugauccgcagcaucaucaacaccacguucgucaucugcauccucacccugaccaucugcguggugagcaccuccgccgucgagauggagaaccugcccagcggcacgugggagaaggaggaggaccugaccaacuucugccaccaggagugccaggugaccgagaccgagugccucugcccguacgaggcccuggugcugcggaagccccucuuccuggacuccaucgucaagggcaugaagaaccugcucaacagcacgucccuggagaccagccuguccaucgaggcccccuggggcgcgaucaacgugcagagcaccuucaagcccaccguguccaccgccaacaucgcccucagcugguccagcgucgagcaccgcgggaacaagauccuggugacggggcgguccgagagcaucaugaagcuggaggagcgcaccggcaucuccugggaccucgggguggaggacgccagcgaguccaagcugcugaccgucagcaucauggaccucagccagauguacuccccgguguucgaguaccugagcggcgaccgccagguggaggaguggcccaaggcgaccugcacgggcgacugccccgagcggugcgggugcaccuccagcacgugccugcacaaggaguggccccacucccggaacuggcgcugcaacccgaccuggugcuggggcgucgggaccggcugcacgugcugcggcguggacgugaaggaccucuucaccgaccacauguucgucaaguggaagguggaguacaucaagaccgaggccaucgugugcgucgagcugaccagccaggagcggcagugcucccugaucgaggccgggacccgcuucaaccucggccccgugaccaucacccugagcgagccccggaacauccagcagaagcugcccccggagaucaucacgcuccaccccaagguggaggagggguucuucgaccugaugcacguccagaaggugcuguccgccagcaccgugugcaagcuccaguccugcacccacggcauccccggggaccugcaggucuaccacaucggcaaccugcucaagggcgaccgcgugaacgggcaccugauccacaagaucgagccgcacuucaacaccagcuggauguccugggacggcugcgaccuggacuacuacugcaacaugggggacuggcccagcugcacguacaccggcgugacccagcacaaccacgccgccuucgucaaccuccugaacaucgagaccgacuacacgaagaccuuccacuuccacuccaagcgggugaccgcgcacggggacacgccccagcuggaccucaaggcccgccccaccuacggcgccggcgagaucaccgugcuggucgagguggccgacauggagcugcacaccaagaagguggagaucagcgggcucaaguucgcgucccuggccugcaccggcugcuacgccugcagcuccgggaucagcugcaagguccggauccacguggacgagccggacgagcugacggugcacgucaagagcuccgaccccgacgugguggccgccagcaccucccucauggcgcgcaagcuggaguucggcaccgacagcaccuucaaggccuucuccgccaugcccaagacgagccugugcuucuacaucgucgagcgggaguacugcaaguccugcagcgaggaggacacccagcgcugcguggacaccaagcucgagcagccccaguccauccugaucgagcacaaggggaccaucaucggcaagcagaacgacacgugcaccgccaaggccagcugcuggcuggaguccgucaagagcuucuucuacggccucaagaacaugcugggguccguguucggcaacuucuucaucgggauccuccuguuccuggcgccguucgugcugcucgugcuguucuucauguucggcuggaagauccuguucugcuucaagugcugccgccgggcccgcgggcuccugaaguaccggcaccugaaggacgacgaggagaccggcuaccgcaagaucaucgagcggcucaacaacaagaagggcaagaaccgccugcuggacggggagcggcucgccgaccgcaagaucgccgagcuguucagcaccaagacccacaucggc

SEQ ID NO: 12154 - RNA, 3495 nt, Artificial Sequence
  derived and/or modified CDS sequence (opt1) from CCHVF(CCHVF 4691-ST-2009)__KR814871.1__Gn-NSm-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccuccaggugagcgaguccaccggggucgcgcugaagcgcagcagcuggcucaucgugcugcuggugcuccugacggucucccugagccccgugcaguccgccccggugggccacgggaagaccaucgagaccuaccaggcccgggagggcuucaccagcaucugccucuucaugcugggcuccauccuguucaucgucagcugccucgugaaggggcugguggacuccgucagcgacuccuucuuccccggccugagcgugugcaagacgugcuccaucgggagcaucaacggcuucgagaucgagucccacaagugcuacugcagccucuucugcugccccuacugccgccacugcuccgccgaccgggagauccaccagcugcaccugagcaucugcaagaagcgccggaccggguccaacgugaugcucgccgucugcaagcgcaugugcuucaaggcgaccaucgaggccagccggcgcgcccugcugauccgcuccaucaucaacaccacguucgugaucugcauccucacccuggccaucugcgucgugagcaccagcgccguggagauggagaaccugcccgcgggcaccugggagcgggaggaggaccucacgaacuucugccaccaggagugccaggucaccgagaccgagugccugugcccguacgaggcccuggugcugcgcaagccccucuuccuggacuccaucgugaagggcaugaagaaccugcucaacagcaccucccuggagacgagccuguccaucgaggcccccuggggcgccaucaacguccagagcaccuucaagcccgccguguccaccgcgaacaucgcccucagcugguccagcguggagcaccgggggaacaagauccuggucaccgggcgcuccgagagcaucaugaagcuggaggagcggaccggcguguccugggaccucgggguggaggacgccagcgaguccaagcugcugacggucagcaucauggaccucucccagauguacagcccgguguucgaguaccugagcggcgaccgccagguggaggaguggcccaaggcgaccugcaccggcgacugccccgagcggugcgggugcaccuccagcacgugccugcacaaggaguggccccacucccgcaacuggcggugcaacccgaccuggugcuggggcgucgggaccggcugcacgugcugcggcguggacgugaaggaccucuucaccgaccacauguucaucaaguggaaggucgaguacaucaagaccgaggccaucgugugcguggagcugaccagccaggagcgccagugcucccugaucgaggccgggacccgguucaaccucggccccgucacgaucacccugagcgagccccgcaacauccagcagaagcugcccccggagaucaucacccuccaccccaagaucgaggagggguucuucgaccugaugcacgugcagaaggugcuguccgccagcaccgucugcaagcuccaguccugcacgcacggcauccccggggaccugcagaucuaccacaucggcaaccugcucaagggcgaccgggugaacgggcaccugauccacaagaucgagccgcacuucaacaccagcuggauguccugggacggcugcgaccuggacuacuacugcaacaugggggacuggcccagcugcaccuacaccggcgugacgcagcacaaccacgccgccuucgucaaccuccugaacaucgagaccgacuacaccaagaccuuccacuuccacuccaagcgcgugacggcgcacggggacacgccccagcuggaccucaaggcccggcccaccuacggcgccggcgagaucaccgugcuggucgagguggccgacauggagcugcacaccaagaagguggagaucagcgggcucaaguucgccucccuggcgugcaccggcugcuacgccugcagcuccgggaucagcugcaagguccgcauccacguggacgagccggacgagcugaccgugcacgucaaguccagcgaccccgacgugguggccgccagcaccucccucauggcccggaagcuggaguucggcacggacagcaccuucaaggcguucuccgccaugcccaagaccagccugugcuucuacaucgucgagcgcgaguacugcaaguccugcagcgaggacgacaccaagaagugcguggacacgaagcucgagcagccccaguccauccugaucgagcacaaggggaccaucaucggcaagcagaacgacacgugcaccgccaaggccagcugcuggcuggaguccgucaagagcuucuucuacggccucaagaacaugcugggguccguguucggcaacuucuucguggggauccuccucuuccuggccccguucgugcugcucguccuguucuucauguucggcuggaagauccuguucugcuucaagugcugccggcgcacccgcgggcuguucaaguaccggcaccugaaggacgacgaggagaccggcuaccgccggaucaucgagcgccugaacagcaagaagggcaagaaccggcuccuggacggggagcgccuggcggaccggaagaucgccgagcuguucuccaccaagacccacaucggc

SEQ ID NO: 12155 - RNA, 3495 nt, Artificial Sequence
  derived and/or modified CDS sequence (opt1) from CCHVF(CCHVF 4701-ST-2009)__KR814872.1__Gn-NSm-Gc
agcgaggagcccggcgacgacugcaucucccgcacccagcugcucaagaccgagacggccgagauccacgacgacaacuacgggggcccgggggacaagaucaccaucugcaacggcagcaccguggucgaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgagguggugcucgacgcgugcgacuccagcugcgagaucaugauccccaaggggacgggcgacauccuggucgacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgugaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgucacccagugccccaagcggaaggagaagguggaggagaccgagcucuaccugaaccuggagcgcauccccuggaucgugcggaagcuccugcaggucagcgaguccaccgggguggcgcugaagcgcagcagcuggcucaucgugcugcugguccuccugacggugucccugagccccgugcaguccgccccggucggccacgggaagaccaucgagaccuaccagacccgggagggcuucacgagcaucugccucuucaugcugggcuccauccuguucaucgugagcugccucgugaaggggcuggucgacuccgugagcgacuccuucuuccccggccugagcgugugcaagaccugcuccaucgggagcaucaacggcuucgagaucgagucccacaagugcuacugcagccucuucugcugccccuacugccgccacugcuccgccgaccgggagauccaccagcugcaccugagcaucugcaagaagcgcaagaccggguccaacgucaugcucgccgugugcaagcggaugugcuucaaggccaccaucgaggcgagccgccgggcccugcugauccgcuccaucaucaacacgaccuucgucaugugcauccucacccuggccaucugcguggugagcaccagcgccgucgagauggaggaccugcccgccggcacgugggagcgcgaggaggaccucaccaacuucugccaccaggagugccaggugaccgagaccgagugccugugcccguacgaggcgcuggugcugcggaagccccucuuccuggacuccaucgucaagggcaugaagaaccugcucaacagcacgucccuggagaccagccuguccaucgaggcccccuggggcgccaucaacgugcagagcaccuucaagcccaccguguccaccgccaacaucgcccucagcugguccagcgucgagcaccgcgggaacaagauccuggugacggggcgguccgagagcaucaugaagcuggaggagcgcaccggcguguccugggaccucggggucgaggacgcgagcgaguccaagcugcugaccgugagcaucauggaccucucccagauguacagcccgguguucgaguaccugagcggcgaccggcaggucgaggaguggcccaaggcgaccugcacgggcgacugccccgagcgcugcgggugcaccuccagcacgugccugcacaaggaguggccccacucccggaacuggcgcugcaacccgaccuggugcuggggcguggggaccggcugcacgugcugcggcguggacgucaaggaccucuucaccgaccacauguucaucaaguggaagguggaguacaucaagaccgaggccaucgugugcgucgagcugaccagccaggagcggcagugcucccugaucgaggccgggacccgcuucaaccucggccccgugaccaucacccugagcgagccccggaacauccagcagaagcugcccccggagaucaucacgcuccaccccaagaucgaggagggguucuucgaccugaugcacgugcagaagguccuguccgccagcaccgugugcaagcuccaguccugcacccacggcauccccggggaccugcagaucuaccacaucggcaaccugcucaagggcgaccgcgugaacgggcaccugauccacaagaucgagccgcacuucaacaccagcuggauguccugggacggcugcgaccuggacuacuacugcaacaugggggacuggcccagcugcacguacaccggcgucacccagcacaaccacgccgccuucgugaaccuccugaacaucgagaccgacuacacgaagaccuuccacuuccacuccaagcgggugaccgcccacggggacacgccccagcuggaccucaaggcccgccccaccuacggcgcgggcgagaucaccguccugguggagguggccgacauggagcugcacaccaagaaggucgagaucagcgggcucaaguucgccucccugaccugcacgggcugcuacgccugcagcuccgggaucagcugcaaggugcggauccacguggacgagccggacgagcugaccguccacgugaaguccagcgaccccgacguggucgccgcgagcaccucccucauggcccgcaagcuggaguucggcaccgacagcacguucaaggccuucuccgccaugcccaagaccagccugugcuucuacaucguggagcgggaguacugcaaguccugcagcgaggacgacaccaagaagugcguggacaccaagcucgagcagccccaguccauccugaucgagcacaaggggaccaucaucggcaagcagaacgacacgugcaccgccaaggcgagcugcuggcuggaguccgucaagagcuucuucuacggccucaagaacaugcugggguccguguucggcggguucuucgugggcauccuccucuuccuggccccguucguccugcucgugcuguucuucauguucggguggaagauccuguucugcuucaagugcugccgccggacccgcggccucuucaaguaccgccaccugaaggacgacgaggagaccggcuaccggcgcaucaucgagcggcugaacagcaagaaggggaagaaccgccuccuggacggcgagcggcuggccgaccgcaagaucgccgagcuguucuccacgaagacccacaucggg

SEQ ID NO: 12156 - RNA, 3495 nt, Artificial Sequence
  derived and/or modified CDS sequence (opt1) from CCHVF(CCHVF 5170-R-2011)__KR814873.1__Gn-NSm-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgugugcgacuccagcugcgagaucaugauccccaaggggacgggcgacauccuggucgacugcuccggcgggcagcagcacuuccugaaggacaaccucaucgaccugggcugcccccacaucccgcugcucgggaagauggcgaucuacaucugccgcaugagcaaccacccccggaccaccauggccuuccuguucugguucuccuucggcuacgugaucacgugcaucuucugcaaggcccuguucuacagccucaucaucaucggcacccuggggaagaagaucaagcaguaccgcgagcugaagccccagaccugcaccaucugcgagaccgcccccgugaacgccaucgacgcggagaugcacgaccucaacugcuccuacaacaucugcccguacugcgccagccggcugacguccgagggccuggcccgccacgucacccagugccccaagcggaaggagaagguggaggagaccgagcucuaccugaaccuggagcgcauccccuggaucgugcggaagcuccugcaggucagcgaguccaccgggguggcccugaagcgcagcagcuggcucaucgugcugcugguccuccugacggugucccugagccccgugcaguccgcgccggucggccacgggaagaccaucgagaccuaccagacccgggagggcuucacgagcaucugccucuucaugcugggcuccauccuguucaucgugagcugccucgugaaggggcuggucgacuccgugagcgacuccuucuuccccggccugagcgugugcaagaccugcuccaucgggagcaucaacggcuucgagaucgagucccacaagugcuacugcagccucuucugcugccccuacugccgccacugcuccgccgaccgggagauccaccagcugcaccugagcaucugcaagaagcgcaagaccggguccaacgucaugcucgccgugugcaagcggaugugcuucaaggccaccaucgaggccagccgccgggcgcugcugauccgcuccaucaucaacacgaccuucgucaucugcauccucacccuggccaucugcguggugagcaccagcgccgucgagauggaggaccugcccgccggcacgugggagcgcgaggaggaccucaccaacuucugccaccaggagugccaggugaccgagaccgagugccugugcccguacgaggcccuggugcugcggaagccccucuuccuggacuccaucgucaagggcaugaagaaccugcucaacagcacgucccuggagaccagccuguccaucgaggcgcccuggggcgccaucaacgugcagagcaccuucaagcccaccguguccaccgccaacaucgcccucagcugguccagcgucgagcaccgcgggaacaagauccuggugacggggcgguccgagagcaucaugaagcuggaggagcgcaccggcguguccugggaccucggggucgaggacgccagcgaguccaagcugcugaccgugagcaucauggaccucucccagauguacagcccgguguucgaguaccugagcggcgaccggcaggucgaggaguggcccaaggcgaccugcacgggcgacugccccgagcgcugcgggugcaccuccagcacgugccugcacaaggaguggccccacucccggaacuggcgcugcaacccgaccuggugcuggggcguggggaccggcugcacgugcugcggcguggacgucaaggaccucuucaccgaccacauguucaucaaguggaagguggaguacaucaagaccgaggccaucgugugcgucgagcugaccagccaggagcggcagugcucccugaucgaggccgggacccgcuucaaccucggccccgugaccaucacccugagcgagccccggaacauccagcagaagcugcccccggagaucaucacgcuccaccccaagaucgaggagggguucuucgaccugaugcacgugcagaagguccuguccgccagcaccgugugcaagcuccaguccugcacccacggcauccccggggaccugcagaucuaccacaucggcaaccugcucaagggcgaccgcgugaacgggcaccugauccacaagaucgagccgcacuucaacaccagcuggauguccugggacggcugcgaccuggacuacuacugcaacaugggggacuggcccagcugcacguacaccggcgucacccagcacaaccacgccgcguucgugaaccuccugaacaucgagaccgacuacacgaagaccuuccacuuccacuccaagcgggugaccgcccacggggacacgccccagcuggaccucaaggcccgccccaccuacggcgccggcgagaucaccguccugguggagguggcggacauggagcugcacaccaagaaggucgagaucagcgggcucaaguucgccucccugaccugcacgggcugcuacgccugcagcuccgggaucagcugcaaggugcggauccacguggacgagccggacgagcugaccguccacgugaaguccagcgaccccgacguggucgccgccagcaccucccucauggcgcgcaagcuggaguucggcaccgacagcacguucaaggccuucuccgccaugcccaagaccagccugugcuucuacaucguggagcgggaguacugcaaguccugcagcgaggacgacaccaagaagugcguggacaccaagcucgagcagccccaguccauccugaucgagcacaaggggaccaucaucggcaagcagaacgacacgugcaccgccaaggccagcugcuggcuggaguccgucaagagcuucuucuacggccucaagaacaugcugggguccguguucggcagcuucuucguggggauccuccucuuccuggcgccguucguccugcucgugcuguucuucauguucggcuggaagauccuguucugcuucaagugcugccgccggacccgcggccucuucaaguaccgccaccugaaggacgacgaggagaccggguaccggcgcaucaucgagcggcugaacuccaagaagggcaagaaccgccuccuggacggggagcggcuggccgaccgcaagaucgccgagcuguucagcacgaagacccacaucggc

SEQ ID NO: 12157 - RNA, 3495 nt, Artificial Sequence
  derived and/or modified CDS sequence (opt1) from CCHVF(CCHVF Oman-199809166)__KR864901.1__Gn-NSm-Gc
agcgaggaguccggcgaggacugcaucagccgcacccagcugcuccggaccgagacggccgagauccacggggacaacuacggcgggcccggcgacaagaucaccaucugcaacggguccaccaucguggaccagcgccugggcagcgagcugggcugcuacaccaucaaccgggucaaguccuucaagcucugcgagaacagcgccacggggaaguccugcgagaucgacaacaccccggugaagugcaagcagggcuucugccugaagaucacccaggaggggcgcggccacgugaagcugagccgggacuccgaggucgugcucgacgcgugcgacagcuccugcgagaucaugauccccaaggggaccggcgacauccugguggacugcagcggcgggcagcagcacuuccugaaggacaaccucaucgaccugggcugccccaacaucccccugcucgggaagauggccaucuacaucugccgcauguccaaccacccgaagacgaccauggccuuccuguucugguucagcuucggcuacgucaucacgugcauccugugcaaggugaucuucuaccuccugaucguggucggcacccuggggaagaaguucaagcaguaccgggagcucaagccccagaccugcaccaucugcgagaccacccccgugaacgccaucgacgccgagaugcacgaccugaacugcuccuacaacaucugccccuacugcgcgagccgccugacguccgacggccucgcccggcacgugaugcagugcccgaagcgcaaggagaagaucgaggagaccgagcuguaccugaaccucgagcggauccccugggucgugcgcaagcugcuccaggugagcgaguccaccggggucgcccucaagcggagcagcuggcugaucgugcugcucgugcugcugaccgucucccucagccccgugcaguccgcccccaucggccacgggaagacgaucgagaccuaccagacccgcgagggcuacaccagcaucugccuguucgugcugggcuccauccucuucaucgucagccaccugaugaaggggcugguggacuccgugggcaacagcuucuucccggggcucuccaucugcaagacgugcagcaucggcuccaucaacggguucgagaucgagagccacaagugcuacugcucccuguucugcugccccuacugccggcacugcagcgcggacaaggagauccacaagcugcaccucuccaucugcaagaagcgcaaggccggcagcaacgucaugcuggccgugugcaagcggaugugcuuccgcgccaccauggaggucuccaacaaggcccugcucauccggagcgugaucaacaccaccuucguggucugcauccugauccuggcggugugcguggucuccacgagcgccguggagauggagagccuccccgccggcaccugggagcgcgaggaggaccugaccaacuucugccaccaggagugccaggugaccgagacggagugccugugccccuacgaggcccugguccuccggaagccgcuguuccuggacuccaucgccaaggggaugaagaaccuccugaacagcaccucccuggagaccagccucuccaucgaggcgcccuggggcgccaucaacgugcagagcaccuucaagcccacgguguccaccgccaacaucgcccugagcugguccagcgucgagcaccgcgggaacaagauccugguguccggccgcagcgaguccaucaugaagcucgaggagcggaccgggaucagcugggaccugggcguggaggacgccuccgagagcaagcugcucaccgucuccgugauggaccugagccagauguacagccccguguucgaguaccuguccggcgaccgccaggucgaggaguggccgaaggcgaccugcacgggggacugccccgagcggugcggcugcaccagcuccacgugccuccacaaggaguggccccacagccgcaacuggcggugcaaccccaccuggugcuggggcguggggaccggcugcacgugcugcgggcuggacgugaaggaccuguucaccgacuacauguucgucaaguggaagguggaguacaucaagaccgaggccaucgugugcgucgagcucaccucccaggagcgccagugcagccugaucgaggccggcacccgguucaaccuggggccggugaccaucacccucuccgagccccgcaacauccagcagaagcugccgcccgagaucgugacgcugcacccccggaucgaggagggcuucuucgaccucaugcacguccagaaggugcugagcgccuccaccgugugcaagcugcagagcugcacccacgggguccccggcgaccuccagguguaccacaucggcaaccugcugaagggggacaaggugaacggccaccucauccacaaggucgagccccacuucaacaccuccuggaugagcugggacgggugcgaccuggacuacuacugcaacaugggcgacuggccguccugcacguacaccggggugacccagcacaaccacgccgcguucgugaaccugcucaacaucgagaccgacuacacgaagaacuuccacuuccacagcaagcgcgucaccgcccacggcgacacgccccagcuggaccugaaggcccggcccaacuacggcgccggggagaucaccgugcucguggaggucgcggacauggagcugcacaccaagaagaucgagaucuccggccugaaguucgccagccugaccugcaccgggugcuacgccugcuccagcggcaucuccugcaaggugcgcauccacguggacgagcccgacgagcugaccguccacgucaagagcgaggacccggacaucguggccgccagcuccagccugauggcgcggaagcucgaguucgggacggacuccaccuucaaggccuucagcgccaugcccaagaccucccugugcuucuacaucguggagcgcgaguacugcaagagcugcuccaaggaggacacccagaagugcgugaacgccaagcuggagcggccccagagcauccucaucgagcacaagggcacgaucaucggcaagcagaacgacacgugcaccgccaaggcguccugcuggcuggagagcgugaaguccuucuucuacgggcugaagaacaugcucagcggcaucuucgggaacgucuucaucggcaucuuccuguuccuggcccccuucauccuccugauccuguucuucauguucggguggcgcauccucuucugcuucaagugcugccggcgcacccggggccuguucaaguaccgccaccugaaggacgacgaggagaccggcuaccgcaagaucaucgagcggcucaacaacaagaaggggaagaacaagcugcuggacggcgagcgccucgccgaccggaagaucgccgagcuguucuccaccaagacccacaucggg

SEQ ID NO: 12158 - RNA, 3495 nt, Artificial Sequence
  derived and/or modified CDS sequence (opt1) from CCHVF(CCHVF 200406546-Turkey)__KR864902.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgugugcgacuccagcugcgaggucaugauccccaaggggacgggcgacauccugguggacugcuccggcgggcagcagcacuuccugaaggacaaccucaucgaccugggcugcccccacgugccgcugcucgggcggauggcgaucuacaucugccgcaugagcaaccacccccggaccaccauggccuuccuguucugguucuccuucggcuacgucaucacgugcaucuucugcaaggcccuguucuacagccucaucaucaucggcacccuggggaagaaguucaagcaguaccgcgagcugaagccccagaccugcaccaucugcgagaccgcccccgugaacgccaucgacgcggagaugcacgaccucaacugcuccuacaacaucugcccguacugcgccagccggcugacguccgacggccuggcccgccacgugccccagugccccaagcggaaggagaaggucgaggagaccgagcucuaccugaaccuggagcgcauccccuggaucgugcggaagcuccuccaggugagcgaguccaccggggucgcccugaagcgcagcagcuggcucaucgugcugcuggugcuccugaccgucucccugagcccggugcaguccgcgcccgugggccacgggaagacgaucgagaccuaccagacccgggagggcuucaccagcaucugccucuucaugcugggcuccauccuguucaucgucagcugccucgugaaggggcugguggacuccgucagcgacuccuucuuccccggccugagcgugugcaagacgugcuccaucgggagcaucaacggcuucgagaucgagucccacaagugcuacugcagccucuucugcugccccuacugccgccacugcuccgccgaccgggagauccaccagcugcaccugagcaucugcaagaagcgcaagaccggguccaacgucaugcucgccgugugcaagcggaugugcuuccgcgccaccaucgaggccagccgccgggcgcugcugauccgcuccaucaucaacaccacguucgugaucugcauccucacccugaccaucugcgucgugagcaccagcgccguggagauggagaaccugccggccggcacgugggagcgggaggaggaccucaccaacuucugccaccaggagugccaggucaccgagaccgagugccugugccccuacgaggcccuggugcugcgcaagccccucuuccuggacuccaucgugaagggcaugaagaaccugcucaacagcacgucccuggagaccagccuguccaucgaggcccccuggggcgcgaucaacguccagagcaccuucaagccgaccguguccaccgccaacaucgcccucagcugguccagcaucgagcaccgggggaacaagauccuggugacggggcgcuccgagagcaucaugaagcuggaggagcggaccggcgucuccugggaccucgggguggaggacgccagcgaguccaagcugcugaccgugagcaucauggaccucucccagauguacagccccgucuucgaguaccugagcggcgaccgccagguggaggaguggcccaaggcgaccugcacgggcgacugccccgagcggugcgggugcaccuccagcacgugccugcacaaggaguggccgcacucccgcaacuggcggugcaaccccaccuggugcuggggcguggggaccggcugcacgugcugcggcgucgacgugaaggaccucuucaccgaccacauguucgugaaguggaaggucgaguacaucaagaccgaggccaucgugugcguggagcugaccagccaggagcgccagugcucccugaucgaggccgggacccgguucaaccucggccccgucaccaucacccugagcgagccccgcaacauccagcagaagcugccgcccgagaucaucacgcuccaccccaagguggaggagggguucuucgaccugaugcacgugcagaagguccuguccgccagcaccgugugcaagcuccaguccugcacccacggcaucccgggggaccuccagguguaccacaucggcaaccugcucaagggcgaccgggucaacgggcaccugauccacaagaucgagccccacuucaacaccagcuggauguccugggacggcugcgaccuggacuacuacugcaacaugggggacuggcccagcugcacguacaccggcgugacccagcacaaccacgccgccuucgugaaccuccugaacaucgagaccgacuacacgaagaccuuccacuuccacuccaagcgcgucaccgcgcacggggacacgccccagcuggaccucaaggcccggccgaccuacggcgccggcgagaucaccgugcugguggaggucgccgacauggagcugcacaccaagaagguggagaucagcgggcucaaguucgcgucccuggccugcaccggcugcuacgccugcagcuccgggaucagcugcaaggugcgcauccacgucgacgagcccgacgagcugacggugcacgugaaguccagcgaccccgacgucguggccgccagcaccucccucaccgcgcggaagcuggaguucggcaccgacagcacguucaaggccuucuccgccaugcccaagaccagccugugcuucuacaucguggagaaggaguacugcaaguccugcaacgaggacgacacccagaagugcgucgacaccaagcucgagcagccgcagagcauccugaucgagcacaaggggaccaucaucggcaagcagaacgacacgugcaccgccaaggccuccugcuggcuggagagcgugaaguccuucuucuacggccucaagaacaugcuggggagcguguucggcaacuucuucaucgggauccugcuguuccuggcgcccuucguccugcucgugcuguucuucauguucggcuggaagauccuguucugcuucaagugcugccgccgcacccggggccucuucaaguaccgccaccugaaggacgacgaggagaccggguacaagcggaucaucgagcgccugaacaacaagaagggcaagaaccggcuccuggacggggagcgccuggccgaccggaagaucgccgagcuguucuccacgaagacccacaucggc

SEQ ID NO: 12159 - RNA, 3495 nt, Artificial Sequence
  derived and/or modified CDS sequence (opt1) from CCHVF(CCHVF 1-CR/HU-2015)__KU161584.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucacccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugacggugucccugagccccgugcaguccgccccggucggccacgggaagaccaucgagaccuaccagacccgcgagggcuucacgagcaucugccucuucaugcugggcuccauccuguucaucgugagcugccucgugaaggggcuggucgacuccgugagcgacuccuucuuccccggccugagcgugugccggaccugcuccaucgggagcaucaacggcuucgagaucgagucccacaagugcuacugcagccucuucugcugccccuacugccgccacugcuccgccgaccgggagauccaccagcugcaccugagcaucugcaagaagcgcaagaccggguccaacgucaugcucgccgugugcaagcggaugugcuuccgcgccaccauggaggcgagccgccgggcccugcugauccgcuccaucaucaacacgaccuucgucaucugcauccucacccugaccaucugcguggugagcacgagcgccgucgagauggagaaccugcccgccggcaccugggagcgggaggaggaccucaccaacuucugccaccaggagugccaggugaccgagacggagugccugugcccguacgaggcccuggugcugcgcaagccccucuuccuggacuccaucgucaagggcaugaagaaccugcucaacagcaccucccuggagaccagccuguccaucgaggcgcccuggggcgccaucaacgugcagagcaccuucaagcccaccguguccacggccaacaucgcccucagcugguccagcgucgagcaccgggggaacaagauccuggugaccgggcgcuccgagagcaucaugaagcuggaggagcggaccggcguguccugggaccucggggucgaggacgccagcgaguccaagcugcugaccgugagcaucauggaccucucccagauguacagcccgguguucgaguaccugagcggcgaccgccaggucgaggaguggcccaaggcgacgugcaccggcgacugccccgagcggugcgggugcaccuccagcacgugccugcacaaggaguggccccacucccgcaacuggcggugcaacccgaccuggugcuggggcguggggaccggcugcacgugcugcggcguggacgucaaggaccucuucaccgaccacauguucgugaaguggaagguggaguacaucaagaccgaggccaucgucugcguggagcugaccagccaggagcgccagugcucccugaucgaggccgggacccgguucaaccucggccccgugaccaucacgcugagcgagccccgcaacauccagcagaagcugcccccggagaucaucacccuccaccccaagaucgaggagggguucuucgaccugaugcacguccagaaggugcuguccgccagcaccgugugcaagcuccaguccugcacccacggcauccccggggaccugcaggucuaccacaucggcaaccugcucaagggcgaccgggugaacgggcaccugauccacaagaucgagccgcacuucaacacgagcuggauguccugggacggcugcgaccuggacuacuacugcaacaugggggacuggcccagcugcaccuacaccggcgugacccagcacaaccacgccgcguucgucaaccuccugaacaucgagacggacuacaccaagaccuuccacuuccacuccaagcgcgugaccgcccacggggacacgccccagcuggaccucaaggcccggcccaccuacggcgccggcgagaucaccgugcuggucgagguggcggacauggagcugcacaccaagaagguggagaucagcgggcucaaguucgccucccuggccugcacgggcugcuacgccugcagcuccgggaucagcugcaagguccgcauccacguggacgagccggacgagcugaccgugcacgucaaguccagcgaccccgacgugguggccgcgagcaccucccucauggcccggaagcuggaguucggcaccgacagcacguucaaggccuucuccgccaugcccaagaccagccugugcuucuacaucgucgagcgcgaguacugcaaguccugcagcgaggacgacaccaagaagugcguggacaccaagcucgagcagccccaguccauccugaucgagcacaaggggaccaucaucggcaagcagaacgacacgugcaccgccaaggcgagcugcuggcuggaguccgucaagagcuucuucuacggccucaagaacaugcugggguccguguucggcaacuucuucaucgggauccuccucuuccuggccccguucgugcugcucgugcuguucuucauguucggcuggaagauccuguucugcuucaagugcugccgccggacccgcggccucuucaaguaccggcaccugaaggacgacgaggagaccggguaccgccggaucaucgagcgccugaacaacaagaagggcaagaaccggcuccuggacggggagcgccuggccgaccggaagaucgccgagcuguucagcacgaagacccacaucggc

SEQ ID NO: 12160 - RNA, 3495 nt, Artificial Sequence
  derived and/or modified CDS sequence (opt1) from CCHVF(CCHVF 1231-CR/TI-2015)__KU161585.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucacccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugacggugucccugagccccgugcaguccgccccggucggccacgggaagaccaucgagaccuaccagacccgcgagggcuucacgagcaucugccucuucaugcugggcuccauccuguucaucgugagcugccucgugaaggggcuggucgaguccgugagcgacuccuucuuccccggccugagcgugugccggaccugcuccaucgggagcaucaacggcuucgagaucgagucccacaagugcuacugcagccucuucugcugccccuacugccgccacugcuccgccgaccgggagauccaccagcugcaccugagcaucugcaagaagcgcaagaccggguccaacgucaugcucgccgugugcaagcggaugugcuuccgcgccaccauggaggcgagccgccgggcccugcugauccgcuccaucaucaacacgaccuucgucaucugcauccucacccugaccaucugcguggugagcacgagcgccgucgagauggagaaccugcccgccggcaccugggagcgggaggaggaccucaccaacuucugccaccaggagugccaggugaccgagacggagugccugugcccguacgaggcccuggugcugcgcaagccccucuuccuggacuccaucgucaagggcaugaagaaccugcucaacagcaccucccuggagaccagccuguccaucgaggcgcccuggggcgccaucaacgugcagagcaccuucaagcccaccguguccacggccaacaucgcccucagcugguccagcgucgagcaccgggggaacaagauccuggugaccgggcgcuccgagagcaucaugaagcuggaggagcggaccggcguguccugggaccucggggucgaggacgccagcgaguccaagcugcugaccgugagcaucauggaccucucccagauguacagcccgguguucgaguaccugagcggcgaccgccaggucgaggaguggcccaaggcgacgugcaccggcgacugccccgagcggugcgggugcaccuccagcacgugccugcacaaggaguggccccacucccgcaacuggcggugcaacccgaccuggugcuggggcguggggaccggcugcacgugcugcggcguggacgucaaggaccucuucaccgaccacauguucgugaaguggaagguggaguacaucaagaccgaggccaucgucugcguggagcugaccagccaggagcgccagugcucccugaucgaggccgggacccgguucaaccucggccccgugaccaucacgcugagcgagccccgcaacauccagcagaagcugcccccggagaucaucacccuccaccccaagaucgaggagggguucuucgaccugaugcacguccagaaggugcuguccgccagcaccgugugcaagcuccaguccugcacccacggcauccccggggaccugcaggucuaccacaucggcaaccugcucaagggcgaccgggugaacgggcaccugauccacaagaucgagccgcacuucaacacgagcuggauguccugggacggcugcgaccuggacuacuacugcaacaugggggacuggcccagcugcaccuacaccggcgugacccagcacaaccacgccgcguucgucaaccuccugaacaucgagacggacuacaccaagaccuuccacuuccacuccaagcgcgugaccgcccacggggacacgccccagcuggaccucaaggcccggcccaccuacggcgccggcgagaucaccgugcuggucgagguggcggacauggagcugcacaccaagaagguggagaucagcgggcucaaguucgccucccuggccugcacgggcugcuacgccugcagcuccgggaucagcugcaagguccgcauccacguggacgagccggacgagcugaccgugcacgucaaguccagcgaccccgacgugguggccgcgagcaccucccucauggcccggaagcuggaguucggcaccgacagcacguucaaggccuucuccgccaugcccaagaccagccugugcuucuacaucgucgagcgcgaguacugcaaguccugcagcgaggacgacaccaagaagugcguggacaccaagcucgagcagccccaguccauccugaucgagcacaaggggaccaucaucggcaagcagaacgacacgugcaccgccaaggcgagcugcuggcuggaguccgucaagagcuucuucuacggccucaagaacaugcugggguccguguucggcaacuucuucaucgggauccuccucuuccuggccccguucgugcugcucgugcuguucuucauguucggcuggaagauccuguucugcuucaagugcugccgccggacccgcggccucuucaaguaccggcaccugaaggacgacgaggagaccggguaccgccggaucaucgagcgccugaacaacaagaagggcaagaaccggcuccuggacggggagcgccuggccgaccggaagaucgccgagcuguucagcacgaagacccacaucggc

SEQ ID NO: 12161 - RNA, 3495 nt, Artificial Sequence
  derived and/or modified CDS sequence (opt1) from CCHVF(CCHVF Gaib)__KX013445.1__Gn-NSm-Gc
agcgaggaguccagcgacgacugcaucucccgcacccagcugcuccggaccgagacggccgagauccacaacgacaacuacggcgggcccggcgacaagaucaccaucugcaacgggagcaccaucguggaccagcgccugggcuccgagcuggggugcuacaccaucaaccgggucaagagcuucaagcucugcgagaacuccgccacgggcaagagcugcgagaucgacuccaucccggugaagugccgccagggcuucugccugaagaucacccaggaggggcggggccacgugaagcugagccgcggguccgaggucgugcucgacgcgugcgacagcuccugcgagaucaugauccccaagggcaccggggacauccugguggacugcagcggcggccagcagcacuuccugaaggacaaccucaucgaccuggggugccccaacaucccccugcucggcaagauggccaucuacaucugccggauguccaaccacccgaagaccacgauggccuuccuguucugguucagcuucggguacgucaucacgugcaucuucugcaaggccaucuucuaccugcucaucaucgugggcacccugggcaagaaguucaagcaguaccgcgagcugaagccccagaccugcaccaucugcgagaccacccccgugaacgccaucgacgcggagaugcacgaccucaacugcuccuacaacaucugccccuacugcgccagccggcugaccuccgacgggcuggcccgccacgucgugcacugcccgaagcggaaggagaagaucgaggagacggagcucuaccugaaccuggagcgcgugcccugggucgugcggaagcuccuccaggugagcgagagcaccggcgucgcccugaagcgcuccagcuggcugaucgugcugcuggugcuccugaccgucucccugagccccgugcaguccgcgcccaucgggcacggcaagaccaucgagacguaccagacccgggagggguacaccagcaucugccucuucgugcugggcggcauccuguucaucgucuccugccucaugaaggggcugguggacagcgugggcaacaacuucuucccggggcugaccaucugcaagacgugcuccaucagcuccaucaacggcuucgagaucgagagccacaagugcuacugcucccuccugugcugccccuacugccgccacugcagcgccgaccgggagauccaccagcugcaccucuccaucugcaagaagcgcaagaccgggagcaacgucaugcuggccgugugcaagcggaugugccugcgcgucaccaccgagguguccaaccgggcccucuucauccgcagcaucaucaacacgaccuucgugaucugcauccugauccuggccgucugcgugaucuccaccagcgcgguggagauggagaaccuccccgccggcaccugggagcgcgaggaggaccugacgaacuucugccaccaggagugccaggucaccgagaccgagugccugugccccuacgaggcccuggugcuccggaagccgcuguucagcgacuccaucgugaagggcaugaagaaccugcucaacagcaccucccuggagacgagccuguccaucgaggcccccuggggcgccaucaacguccagagcaccuucaagcccaccguguccaccgcgaacaucgcccucagcugguccagcaucgagcaccgcgggaacaagauccugguguccgggcggagcgaguccaucaugaagcuggaggagcgcaccggcaucagcugggaccucggggucgaggacgccuccgagagccggcugcugacgguguccgugauggaccucagccagauguacagccccgucuucgaguaccuguccggcgaccgccagguggaggaguggccgaaggcgaccugcaccggcgacugccccgagcggugcgggugcaccagcuccacgugccugcacaaggaguggccccacagccgcaacuggcggugcaaccccaccuggugcuggggcguggggaccggcugcacgugcugcggccucgacgucaaggaccuguucaccgacuacauguucgugaaguggaagguggaguacaucaagaccgaggccaucgucugcguggagcugaccucccaggagcgccagugcagccucaucgaggccgggacccgguucaaccugggcccggugacgaucacccuguccgagccccgcaacauccagcagaagcucccgcccgagaucaucacccugcacccccggaucgaggagggguucuucgaccugaugcacguccagaaggugcucagcgccuccaccgugugcaagcugcagagcugcacgcacggcguccccggggaccuccagguguaccacaucggcaaccugcugaagggcgacaaggugaacgggcaccugauccacaagaucgagccccacuucaacaccuccuggaugagcugggacggcugcgaccucgacuacuacugcaacaugggggacuggccguccugcaccuacaccggcgucacgcagcacaaccacgccgccuucgugaaccugcugaacaucgagaccgacuacaccaagaacuuccacuuccacagcaagcgcgugaccgcccacggggacacgccccagcucgaccugaaggcgcggcccaccuacggcgccggcgagaucaccguccugguggagguggccgacauggagcuccacaccaagaagaucgagaucuccgggcugaaguucgccagccugacgugcaccggcugcuacgcgugcuccagcgggaucuccugcaagguccgcauccacguggacgagcccgacgagcucaccgugcacgucaagagcgaggacccggacaucguggccgccagcuccagccugauggcccggaagcuggaguucggcaccgacuccacguucaaggccuucagcgcgaugcccaagaccucccucugcuucuacaucguggagcgcgaguacugcaagagcugcucccgggaggacacccagaagugcgucagcaccaagcuggagcagccccaguccauccugaucgagcacaaggggacgaucaucggcaagcagaacaacacgugcaccaccaagacgaccugcuggcucgagagcgugaaguccuucuucuacggccugaagaacaugcugagcuccaucuucgggaacguguucgucggcaucuucagcuuccucgcccccuucauccugcugauccucuucuucauguucggguggcgcauccuguucugcuucaagugcugccgccggacccgcggccuguucaaguaccggcaccucaaggacgacgaggagaccggguaccgccggaucaucgagcgccugaacaacaagaagggcaaguccaagcugcucgacggcgagcggcuggccgaccgcaagaucgccgagcuguucagcaccaagacccacaucggg

SEQ ID NO: 12162 - RNA, 3495 nt, Artificial Sequence
  derived and/or modified CDS sequence (opt1) from CCHVF(CCHVF Hodzha)__KX013448.1__Gn-NSm-Gc
agcgaggaguccggcgacgacugcaucagccgcacccagcugcuccggaccgagacggccgagauccacggggacgacuacggcgggcccggcgacaagaucaccaucugcaacggguccaccaucguggaccagcgccugggcagcgagcugggcugcuacaccaucaaccgggucaaguccuucaagcucugcgagaacagcgccacggggaaguccugcgagaucgacagcaccccggugaagugccgccagggcuacugccugaagaucacccaggaggggcggggccacgugaagcugucccgcgggagcgaggucgugcucgacgcgugcgacuccagcugcgaggugaugauccccaagggcaccggcgacauccuggucgacugcuccgggggccagcagcacuuccugaaggacaaccucaucgaccuggggugcccccggaucccccugcucggcaagauggccaucuacaucugccgcaugagcaaccacccggagacgaccauggccuuccuguucugguucuccuucggcuacgugaucacgugcauccugugcaaggccaucuucuaccuccugaucaucguggggacccugggcaagcgguucaagcaguaccgcgagcucaagccccagaccugcaccaucugcgagaccacccccgccaacgcgaucgacgccgagaugcacgaccugaacugcagcuacaacaucugccccuacugcgccucccggcugacgagcgacgggcucgcccgccacgucacccagugcccgaagcggaaggagaagguggaggagaccgagcuguaccugaaccucgagcgcauccccuggaucgugcggaagcugcugcaggucuccgagagcaccggcguggcgcucaagcgcagcuccuggcugaucgugcugcucguccuguucgccgugagccugucccccgugcagagcgcccccaucgggcacggcaagacgaucgagaccuaccaggcccgggaggaguacaccuccaucugccucuucguccugggcagcauccuguucaucguguccugccucaugaaggggcugguggacagcaucggcaacaucuucuucccggggcugaccaucugcaagacgugcuccaucggcagcaucaacggguucgagaucgagucccacaagugcuacugcagccuccugugcugccccuacugccgccacugccccgccgaccgggagauccaccagcugcaccucuccaucugcaagaagcgcaagaccggcagcaacgucaugcuggcggugugcaagcggaugugcuuccgcgccaccauggagguguccaacaaggcccugcucauccgcagcaucaucaacaccacguucgucgugugcauccugauccuggccgucugcgugguguccaccagcgccgucgagauggagucccuccccgcgggcaccugggagcgggaggaggaccugaccaacuucugccaccaggagugccaggugacggagaccgagugccugugcccguacgaggcccuggugcuccgccggccccuguuccuggacagcaucgucaaggggaagaagaaccuccugaacagcaccucccuggagaccagccucuccaucgaggcccccuggggcgccaucaacgugcagagcacguacaagcccaccguguccaccgccaacaucgcgcugagcugguccagcgucgagcaccgcgggaacaagauccugguguccggccggagcgaguccaucaugaagcucgaggagcgcaccgggaucagcugggaccugggcguggaggacgccuccgagagcaagcugcucaccgucuccgugauggaccugagccagauguacuccccgguguucgaguaccugagcggcgaccggcaggucgaggaguggcccaaggccacgugcaccggggacugcagcgagcgcugcggcugcaccuccagcacgugccuccacaaggaguggccccacucccggaacuggcgcugcaaccccaccuggugcuggggcguggggaccggcugcacgugcugcgggcuggacgugaaggaccuguucaccgacuacauguucgucaaguggaagguggacuacaucaagaccgaggccaucgugugcgucgagcucaccagccaggagcggcagugcucccugguggaggccggcacccgcuucaaccuggggccggugaccaucacgcucagcgagccccggaacauccagcagaagcugccgcccgagaucaucacccugcacccccgcaucgaggagggcuucuucgaccucaugcacguccagaaggugcuguccgcgagcaccgugugcaagcugcaguccugcacccacgggguccccggcgaccuccagguguaccacaucggcaaccugcugaagggggacaaggugaacggccaccucauccacaagaucgagccccacuucaacacgagcuggauguccugggacgggugcgaccuggacuacuacugcaacaugggcgacuggccgagcugcaccuacaccggggucacccagcacaaccacgccuccuucgugaaccugcucaacaucgagacggacuacaccaagagcuuccacuuccacuccaagcgggugaccgcccacggcgacacgccccagcuggaccugaaggcccgccccaccuacggcgcgggggagaucaccguccucguggagguggccgacauggagcugcacaccaagaagaucgagaucaccggccugaaguucgccagccucacgugcaccgggugcuacgccugcuccagcggcaucuccugcaagguccggauccacguggacgagcccgacgagcugaccgugcacgucaagagcgacgacccggacgugguggccgcgagcuccagccugauggcccgcaagcucgaguucgggaccgacuccacguucaaggccuucagcgccaugcccaagaccucccugugcuucuacaucgucgagcgggaguacugcaagagcugcuccaaggaggacacccagaagugcgugaacaccaagcuggagcagccccagagcauccucaucgagcagaagggcacgaucaucggcaagcagaacaacacgugcaccgccaaggcguccugcuggcuggagagcgugaaguccuucuucuacgggcugaagaacaugcucagcggcaucuucgggaacgucuucgugggcaucuuccuguuccuggcccccuucauccuccugauccuguucuucauguucggguggcgcauccucuucugcuucaagugcugccgccggacccgcggccuguucaaguacaagcaccugaaggacgacgaggagaccggcuaccggcgcaucaucgagcggcucaacaacaagaaggggaagaacaagcugcuggacggcgagcgccucgccgaccggcgcaucgccgagcuguucuccaccaagacccacaucggg

SEQ ID NO: 12163 - RNA, 3495 nt, Artificial Sequence
  derived and/or modified CDS sequence (opt1) from CCHVF(CCHVF IbAn7620)__KX013451.1__Gn-NSm-Gc
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggucaaguccuucaagcucugcgagaacagcgccacgggcaagaacugcgagaucgacuccgugcccgugaagugccgccagggguacugccugcggaucacccaggagggccgcgggcacgucaagcugagccggggcuccgagaucgugcucgacgcgugcgacaccagcugcgagaucaugauccccaaggggaccggcgacauccugguggacugcuccggcgggcagcagcacuuccugaaggacaaccucaucgaccugggcugccccaagaucccgcugcucgggaagauggccaucuacaucugccgcaugagcaaccaccccaagacgaccauggccuuccuguucugguucuccuucggcuacgucaucacgugcauccugugcaaggccaucuucuaccuccugaucaucaucggcacccuggggaagcggcucaagcaguaccgcgagcugaagccccagaccugcaccaucugcgagaccacccccgugaacgccaucgacgcggagaugcacgaccugaacugcagcuacaacaucugcccguacugcgccucccggcucacgagcgacggccuggcccgccacgugauccagugccccaagcggaaggagaaggucgaggagaccgagcuguaccucaaccuggagcgcauccccuggguggugcggaagcugcuccaggucuccgagagcaccgggguggcccugaagcgcuccagcuggcugaucgugcuccugguccuguucaccgugagccucucccccgugcagagcgcgccgaucggccaggggaagacgaccgaggccuaccgggcccgcgagggcuacaccuccaucugccuguucguccugggcagcauccucuucaucguguccugccugaugaaggggcugguggacagcgucggcaacuccuucuuccccgggcucagcaucugcaagaccugcuccaucagcuccaucaacggcuucgagaucgagagccacaagugcuacugcucccuguucugcugccccuacugccggcacugcagcacggacaaggagauccacaagcugcaccucuccaucugcaagaagcgcaagaccgggagcaacgugaugcuggccgugugcaagcggaugugcuuccgcgccaccauggaggucuccaaccgcgcgcuguucauccggagcaucaucaacaccacguucgugcucugcauccugauccuggccgucugcgugguguccaccagcgccgucgagauggagaaccuccccgccggcaccugggagcgcgaggaggaccugaccaacuucugccaccaggagugccaggugacggagaccgagugccugugcccguacgaggcccuggugcuccggaagccccuguuccuggacagcaucgcgaagggcaugaagaacccccucaacuccaccagccuggagaccucccugagcaucgaggcccccuggggcgccaucgacguccaguccacguacaagccgaccgugagcaccgccaacaucgcccucuccuggagcuccguggagcaccgcgggaacaagauccuggucagcgggcgguccgagagcaucaugaagcuggaggagcgcaccggcaucuccugggaccucgggguggaggacgcgagcgaguccaagcugcugaccgugagcgucauggaccucucccagauguacagccccguguucgaguaccugagcggcgaccgccagguggaggaguggcccaaggccacgugcaccggcgacugccccgagcggugcgggugcaccuccagcacgugccugcacaaggaguggccgcacucccggaacuggcgcugcaaccccaccuggugcuggggcgucgggaccggcugcacgugcugcggccucgacgugaaggaccuguucaccgacuacauguucgugaaguggaaggucgaguacaucaagaccgaggccaucgugugcguggagcugaccagccaggagcggcagugcucccucaucgaggccgggacccgcuucaaccugggccccgucaccaucacgcugagcgagccccggaacauccagcagaagcucccgcccgagaucaucacccugcacccccgcaucgaggagggguucuucgaccugaugcacgugcagaaggugcucuccgccagcaccgucugcaagcugcaguccugcacccacggcgugccgggggaccuccagguguaccacaucggcaaccuccugaagggcgacaaggucaacgggcaccugauccacaagaucgagccccacuucaacacgagcuggauguccugggacggcugcgaccucgacuacuacugcaacaugggggacuggcccagcugcaccuacaccggcgugacccagcacaaccacgcguccuucgugaaccugcugaacaucgagacggacuacaccaagaacuuccacuuccacagcaagcgggucaccgcccacggggacacgccccagcucgaccugaaggcccgcccgaccuacggcgccggcgagaucaccgugcugguggaggucgcgaacauggagcuccacaccaagaagaucgagaucuccgggcugaaguucgccagccugaccugcacgggcugcuacgccugcuccagcgggaucuccugcaaggugcggauccacguggacgagcccgacgagcucaccguccacgucaagagcgacgaccccgacgugguggccgccagcuccagccugauggcgcgcaagcuggaguucggcaccgacuccaccuucaaggccuucagcgccaugcccaagacgucccucugcuucuacaucguggagcgggagcacugcaagagcugcuccgaggaggacaccaagaagugcgugaacaccaagcuggagcagccgcagagcauccugaucgagcacaaggggaccaucaucggcaagcagaacuccacgugcaccgccaaggccagcugcuggcucgaguccgucaagagcuucuucuacggccugaagaacaugcuguccgggaucuucggcaacguguucauggggaucuuccucuuccuggcgcccuucauccugcucauccuguucuucauguucggcuggcgcauccuguucugcuucaagugcugccgccggacccgcggccucuucaaguaccggcaccugaaggacgacgaggagaccggguaccgccggaucaucgagcgccugaacaacaagaagggcaagaacaagcuccuggacggggagcggcuggccgaccgccggaucgccgagcuguucagcaccaagacgcacaucggc

SEQ ID NO: 12164 - RNA, 3495 nt, Artificial Sequence
  derived and/or modified CDS sequence (opt1) from CCHVF(CCHVF K128_76)__KX013454.1__Gn-NSm-Gc
agcgacgaguccggcgacgacugcaucagccgcacccagcugcuccggaccgagacggccgagauccacggggacaacuacggcgggcccggcgacaagaucaccaucugcaacggguccaccaucguggaccagcgccugggcagcgagcugggcugcuacaccaucaaccgggucaaguccuucaagcucugcgagaacagcgccacggggaaguccugcgagaucgacagcaucccggugaagugccgccagggcuacugccugaagaucacccaggaggggcggggccacgugaagcugucccgcgggagcgaggucgugcucgacgcgugcgacuccagcugcgaggugaugauccccaagggcaccggcgacauccuggucgacugcuccgggggccagcagcacuuccugaaggacaaccucaucgaccuggggugccccaagaucccccugcucggcaagauggccaucuacaucugccggaugagcaaccacccgaagaccacgauggccuuccuguucugguucuccuucggcuacgugaucacgugcaucgugugcaaggccaucuucuaccugcucaucaucgucgggacccugggcaagcgcuucaagcaguaccgggagcugaagccccagaccugcaccaucugcgagaccacccccaccaacgccaucgacgcggagaugcacgaccucaacugcagcuacaacaucugccccuacugcgccucccgccugacgagcgacgggcuggcccggcacgugacccacugcccgaagcgcaaggagaagguggaggagaccgagcucuaccugaaccuggagcggauccccugggucgugcgcaagcuccuccagguguccgagagcaccggcgucgcccugaagcggagcuccuggcucaucgugcugcugguccucuucgcggugagccugucccccgugcagagcgcccccaucucccacgggaagacgaucgagaccuaccaggugcgcgaggaguacaccagcaucugccuguucguccucggcuccauccuguucaucgugagcugccugaugaagggccucgugaacuccgucgggaacaucuucuucccgggccugagcaucugcaagaccugcuccaucgggagcaucaacggcuucgagaucgagucccacaagugcuacugcagccugcucugcugccccuacugccggcacugcuccgccgaccgcgagauccaccagcugcaccugagcaucugcaagaagcggaagacgggguccaacgugaugcucgccgucugcaagcgcaugugcuuccgggccaccauggaggugagcaacaaggcgcuguucauccgcuccaucaucaacaccaccuucguggucugcauccugauccucgccgugugcguggucagcacgagcgccguggagauggagucccugcccgccggcaccugggagcgcgaggaggaccugaccaacuucugccaccaggagugccaggugaccgagacggagugccucugccccuacgaggcccugguccugcggcgcccgcuguuccaggacagcaucgugaagggcaugaagaaccuccugaacuccaccagccuggagaccucccucagcaucgaggcgcccuggggcgccaucaacgugcaguccaccuacaagcccgccgucagcgccgccaacaucgcgcuguccuggagcuccguggagcaccgggggagcaagauccugguguccgggcgcagcgaguccaucaugaagcucgaggagcggacgggcaucagcugggaccugggggucgaggacgccuccgagagcaagcugcucaccgugagcgugauggaccugucccagauguacagccccgucuucgaguaccuguccggcgaccgccagguggaggaguggccgaaggcgaccugcaccggcgacugccccgagcggugcgggugcaccagcuccacgugccuccacaaggaguggccccacagccgcaacuggcggugcaaccccaccuggugcuggggcguggggaccggcugcacgugcugcggccuggacgucaaggaccuguucaccgacuacauguucgugaaguggaagguggaguacaucaagaccgaggccaucgucugcguggagcucaccucccaggagcgccagugcagccugaucgaggccgggacccgguucaaccugggcccggugacgaucacccucuccgagccccgcaacauccagcagaagcugccgcccgagaucaucacccugcacccccggaucgaggagggguucuucgaccucaugcacguccagaaggugcugagcgccuccaccgugugcaagcugcagagcugcacgcacggcguccccggggaccuccagguguaccacaucggcaaccugcugaagggcgaccgcgugaacgggcaccucauccacaagaucgagccccacuucaacaccuccuggaugagcugggacggcugcgaccuggacuacuacugcaacaugggggacuggccguccugcaccuacaccggcgucacgcagcacaaccacgccagcuucgugaaccugcucaacaucgagaccgacuacaccaaguccuuccacuuccacagcaagcgggugaccgcccacggggacacgccccagcuggaccugaaggcccgccccaacuacggcgcgggcgagaucaccguccucguggagguggccgacauggagcugcacaccaagaagaucgagaucuccgggcugaaguucgccagccugaccugcacgggcugcuacgccugcagcuccgggaucagcugcaagguccggauccacguggacgagcccgacgagcugaccgugcacgucaaguccgacgacccggacgugguggccgcgagcuccagccugauggcccgcaagcucgaguucggcaccgacuccaccuucaaggccuucagcgccaugcccaagacgucccugugcuucuacaucgucgagcgggaguacugcaagagcugcuccaaggaggacacccagaagugcgugaacaccaagcuggagcagccccagagcauccucaucgagcacaaggggaccaucaucggcaagcagaacaacacgugcaccgccaagaccuccugcuggcuggagagcgugaaguccuucuucuacggccugaagaacaugcucagcgggaucuucggcaacgucuucguggggaucuuccuguuccuggcgcccuucauccuccugauccuguucuucauguucggcuggcgcauccucuucugcuucaagugcugccgccggacccgcgggcuguuccgguacaagcaccuggagaacgacgaggagacgggcuaccgccggaucaucgagcgccucaacaacaagaagggcaagaacaagcugcuggacggggagcggcucgccgaccgccggaucgccgagcuguucuccaccaagacccacaucggc

SEQ ID NO: 12165 - RNA, 3495 nt, Artificial Sequence
  derived and/or modified CDS sequence (opt1) from CCHVF(CCHVF K168_40)__KX013457.1__Gn-NSm-Gc
agcgacgaguccggcgacgacugcaucagccgcacccagcugcuccggaccgagacggccgagauccacggggacaacuacggcgggcccggcgacaagaucaccaucugcaacggguccaccaucguggaccagcgccugggcagcgagcugggcugcuacaccaucaaccgggucaaguccuucaagcucugcgagaacagcgccacggggaaguccugcgagguggacagcaucccggugaagugccgccagggcuacugccugaagaucacccaggaggggcggggccacgucaagcugucccgcgggagcgagguggugcucgacgcgugcgacuccagcugcgaggucaugauccccaagggcaccggcgacauccugguggacugcuccgggggccagcagcacuuccugaaggacaaccucaucgaccuggggugccccaagaucccccugcucggcaagauggccaucuacaucugccggaugagcaaccacccgaagaccacgauggccuuccuguucugguucuccuucggcuacgugaucaccugcaucgucugcaaggccaucuucuaccugcucaucaucguggggacccugggcaagcgcuucaagcaguaccgggagcugaagccccagaccugcacgaucugcgagaccacccccaccaacgccaucgacgcggagaugcacgaccucaacugcagcuacaacaucugccccuacugcgccucccgccugacgagcgacgggcuggcccggcacgugacccacugcccgaagcgcaaggagaaggucgaggagaccgagcucuaccugaaccuggagcggauccccuggguggugcgcaagcuccugcaggucuccgagagcaccggcguggcccugaagcggagcuccuggcucaucgugcugcugguccucuucgcggugagccugucccccgugcagagcgcccccaucgggcacggcaagacgaucgagaccuaccagguccgcgaggaguacaccuccaucugccuguucgugcucggcagcauccuguucaucguguccugccugaugaaggggcucgucaacagcgugggcaacaucuucuucccggggcuguccaucugcaagaccugcagcaucggcuccaucaacggguucgagaucgagagccacaagugcuacugcucccugcucugcugccccuacugccggcacugcagcgccgaccgcgagauccaccagcugcaccuguccaucugcaagaagcggaagacgggcagcaacgucaugcucgccgugugcaagcgcaugugcuuccgggccaccguggaggucuccaacaaggcgcugagcauccgcuccaucaucaacaccaccuucguggugugcauccugauccucgccgucugcguggugagcacgagcgccgucgagauggagucccugcccgccggcaccugggagcgcgaggaggaccugaccaacuucugccaccaggagugccaggugaccgagacggagugccucugccccuacgaggcccuggugcugcggcgcccgcuguuccucgacgggaucgucaagggcaugaagaaccugcugaacagcaccucccucgagaccagccuguccaucgaggcgcccuggggggccaucaacgugcagagcaccuacaagcccacgguguccgccgccaacaucgcccugagcugguccagcgucgagcaccggggcaacaagauccucguguccgggcgcagcgaguccaucaugaagcuggaggagcggaccggcaucagcugggaccugggcguggaggacgcguccgagagcaagcuccugaccgucuccgugauggaccugagccagauguacagccccguguucgaguaccucuccggggaccgccaggucgaggaguggccgaaggccaccugcaccggcgacugccccgagcggugcgggugcacgagcuccaccugccugcacaaggaguggccccacagccgcaacuggcggugcaaccccaccuggugcuggggcgugggcaccgggugcacgugcugcggccuggacgugaaggaccucuucaccgacuacauguucgucaaguggaagguggaguacaucaagaccgaggccaucgugugcgucgagcugaccucccaggagcgccagugcagccugaucgaggccgggacgcgguucaaccucggcccggugaccaucacccuguccgagccccgcaacauccagcagaagcugccccccgagaucaucacccuccacccgcggaucgaggagggguucuucgaccugaugcacgugcagaagguccugagcgccuccacggugugcaagcuccagagcugcacccacggcgugcccggcgaccugcaggucuaccacaucgggaaccugcucaagggcgacaaggugaacgggcaccugauccacaagaucgagccccacuucaacaccuccuggaugagcugggacggcugcgaccuggacuacuacugcaacaugggggacuggccguccugcaccuacacgggcgugacccagcacaaccacgcgagcuucaucaaccuccugaacaucgagaccgacuacaccaaguccuuccacuuccacagcaagcgcgucacggcccacggcgacaccccccagcuggaccucaaggcccggcccaacuacggggccggcgagaucaccgugcugguggaggucgcggacauggagcugcacaccaagaagaucgagaucuccgggcucaaguucgccagccugacgugcaccggcugcuacgccugcuccagcgggaucagcugcaaggugcgcauccacguggacgagcccgacgagcugaccguccacgugaaguccgacgacccggacguggucgccgccagcuccagccucauggcgcggaagcuggaguucggcaccgacuccacguucaaggccuucagcgccaugcccaagaccucccugugcuucuacaucguggagcgcgaguacugcaagagcugcuccaaggaggacacccagaagugcgugaacaccaagcucgagcacccccagagcauccugaucgagcacaagggcacgaucaucgggaagcagaacaacaccugcaccgccaagaccuccugcuggcuggagagcgucaaguccuucuucuacggccucaagaacaugcugagcgggaucuucggcaacguguucguggggaucuuccuguuccucgcccccuucauccugcugauccucuucuucauguucggcuggcggauccuguucugcuucaagugcugccgccgcacgcggggccuguuccgcuacaagcaccucgaggacgacgaggagaccggguaccggcgcaucaucgagcggcugaacaacaagaagggcaagaacaagcugcucgacggggagcgccuggcggaccggcgcaucgccgagcuguucuccaccaagacccacaucggc

SEQ ID NO: 12166 - RNA, 3495 nt, Artificial Sequence
  derived and/or modified CDS sequence (opt1) from CCHVF(CCHVF K168_125)__KX013460.1__Gn-NSm-Gc
agcgacgaguccggcgacgacugcaucagccgcacccagcugcuccggaccgagacggccgagauccacggggacaacuacggcgggcccggcgacaagaucaccaucugcaacggguccaccaucguggaccagcgccugggcagcgagcugggcugcuacaccaucaaccgggucaaguccuucaagcucugcgagaacagcgccacggggaaguccugcgagguggacagcaucccggugaagugccgccagggcuacugccugaagaucacccaggaggggcggggccacgucaagcugucccgcgggagcgagguggugcucgacgcgugcgacuccagcugcgaggucaugauccccaagggcaccggcgacauccugguggacugcuccgggggccagcagcacuuccugaaggacaaccucaucgaccuggggugccccaaggugccccugcucggcaagauggccaucuacaucugccggaugagcaaccacccgaagaccacgauggccuuccuguucugguucuccuucggcuacgucaucaccugcaucgugugcaaggccaucuucuaccugcucaucaucguggggacccugggcaagcgcuucaagcaguaccgggagcugaagccccagaccugcacgaucugcgagaccacccccaccaacgccaucgacgcggagaugcacgaccucaacugcagcuacaacaucugccccuacugcgccucccgccugacgagcgacgggcuggcccggcacgucacccacugcccgaagcgcaaggagaagguggaggagaccgagcucuaccugaaccuggagcggauccccugggugguccgcaagcuccugcagguguccgagagcaccggcguggcccugaagcggagcuccuggcucaucguccugcuggugcucuucgcggugagccugucccccguccagagcgcccccaucgggcacggcaagacgaucgagaccuaccaggugcgcgaggaguacaccuccaucugccuguucgugcucggcagcauccuguucaucgucuccugccugaugaaggggcucgugaacagcgucggcaacaucuucuucccggggcuguccaucugcaagaccugcagcaucggcuccaucaacggguucgagaucgagagccacaagugcuacugcucccugcucugcugccccuacugccggcacugcagcgccgaccgcgagauccaccagcugcaccuguccaucugcaagaagcggaagacgggcagcaacgugaugcucgccgugugcaagcgcaugugcuuccgggccaccgucgagguguccaacaaggcgcugagcauccgcuccaucaucaacaccaccuucguggucugcauccugauccucgccgugugcguggucagcacgagcgccguggagauggagucccugcccgccggcaccugggagcgcgaggaggaccugaccaacuucugccaccaggagugccaggugaccgagacggagugccucugccccuacgaggcccugguccugcggcgcccgcuguuccucgacagcaucgugaaggggaagaagaaccugcugaacuccaccagccucgagaccucccugagcaucgaggcgcccuggggcgccaucaacgugcaguccaccuacaagcccacggucagcgccgccaacaucgcccuguccuggagcuccguggagcaccgggggaacaagauccucgugagcggccgcuccgagagcaucaugaagcuggaggagcggaccgggaucuccugggaccugggcgucgaggacgcgagcgaguccaagcuccugaccgugagcgugauggaccugagccagauguacucccccgucuucgaguaccucagcggcgaccgccagguggaggaguggccgaaggccaccugcaccggggacugccccgagcggugcggcugcacguccagcaccugccugcacaaggaguggccccacucccgcaacuggcggugcaaccccaccuggugcuggggggugggcaccggcugcacgugcugcgggcuggacgucaaggaccucuucaccgacuacauguucgugaaguggaagguggaguacaucaagaccgaggccaucgucugcguggagcugaccagccaggagcgccagugcucccugaucgaggccggcacgcgguucaaccucgggccggugaccaucacccugagcgagccccgcaacauccagcagaagcugccccccgagaucaucacccuccacccgcggaucgaggagggcuucuucgaccugaugcacguccagaaggugcuguccgccagcacggugugcaagcuccaguccugcacccacgggguccccggcgaccugcagguguaccacaucggcaaccugcucaagggggacaaggugaacggccaccugauccacaagaucgagccccacuucaacaccagcuggauguccugggacgggugcgaccuggacuacuacugcaacaugggcgacuggccgagcugcaccuacacgggggucacccagcacaaccacgcguccuucaucaaccuccugaacaucgagaccgacuacaccaagagcuuccacuuccacuccaagcgcgugacggcccacggcgacaccccccagcuggaccucaaggcccggcccaacuacggcgccggggagaucaccgugcuggucgagguggcggacauggagcugcacaccaagaagaucgagaucagcggccucaaguucgccucccugacgugcaccgggugcuacgccugcagcagcggcaucuccugcaaggugcgcauccacgucgacgagcccgacgagcugaccgugcacgugaagagcgacgacccggacgucguggccgccuccagcucccucauggcgcggaagcuggaguucgggaccgacagcacguucaaggccuucuccgccaugcccaagaccagccugugcuucuacaucguggagcgcgaguacugcaaguccugcagcaaggaggacacccagaagugcgucaacaccaagcucgagcacccccaguccauccugaucgagcacaagggcacgaucaucggcaagcagaacaacaccugcaccgccaagaccagcugcuggcuggaguccgugaagagcuucuucuacgggcucaagaacaugcuguccggcaucuucgggaacguguucgucggcaucuuccuguuccucgcccccuucauccugcugauccucuucuucauguucggguggcggauccuguucugcuucaagugcugccgccgcacgcggggccuguuccgcuacaagcaccucgaggacgacgaggagaccggcuaccggcgcaucaucgagcggcugaacaacaagaaggggaagaacaagcugcucgacggcgagcgccuggcggaccggcgcaucgccgagcuguucagcaccaagacccacaucggg

SEQ ID NO: 12167 - RNA, 3495 nt, Artificial Sequence
  derived and/or modified CDS sequence (opt1) from CCHVF(CCHVF K229_194)__KX013463.1__Gn-NSm-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaagggcaaccucaucgaccuggggugcccccacaucccgcugcucggcaagauggccaucuacaucugccgcaugagcaaccacccccggaccaccauggccuuccuguucugguucuccuucggcuacgucaucacgugcaucuucugcaaggcccuguucuacagccucaucaucaucgggacccugggcaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacgggcuggcccgccacgugacccagugccccaagcggaaggagaaggucgaggagaccgagcucuaccugaaccuggagcgcauccccuggaucgugcggaagcuccuccaggugagcgaguccaccggcgucgcgcugaagcgcagcagcuggcugaucgugcugcuggugcuccugacggucucccugagccccgugcaguccgccccgguggggcacggcaagaccaucgagaccuaccagacccgggagggcuucacgaacaucugccucuucaugcuggggagcauccuguucaucgucuccugccucgugaagggccugguggacagcgucuccgacagcuucuuccccgggcuguccgugugcaagaccugcagcaucggcuccaucaacggguucgagaucgagagccacaagugcuacugcucccucuucugcugccccuacugccgccacugcagcgccgaccgggagauccaccagcugcaccugggcaucugcaagaagcgcaagaccggcuccaacgugaugcucgccgucugcaagcggaugugcuucaaggccaccaucgaggcgagccgccgggcccugcugauccgcuccaucaucaacacgaccuucgugaucugcauccucacccuggccaucugcgucgugagcaccuccgccguggagauggagaaccugcccgccgggacgugggagcgcgaggaggaccucaccagcuucugccaccaggagugccaggucaccgagaccgagugccugugcccguacgaggcgcuggugcugcggaagccccucuuccuggacagcaucgugaagggcaagaagaaccugcucaacuccacgagccuggagaccucccugagcaucgaggcccccuggggcgccaucaacguccaguccaccuucaagcccaccgugagcaccgccaacaucgcccucuccuggagcuccguggagcaccgcgggaacaagauccuggucacggggcggagcgaguccaucaugaagcuggaggagcgcaccggcgugagcugggaccucggcguggaggacgcguccgagagcaagcugcugaccgucuccaucauggaccucagccagauguacuccccgguguucgaguaccugagcggggaccgccagguggaggaguggcccaaggcgaccugcacgggcgacugccccgagcggugcgggugcaccagcuccacgugccugcacaaggaguggccccacagccggaacuggcgcugcaacccgaccuggugcuggggcgucggcaccgggugcacgugcugcggcguggacgugaaggaccucuucaccgaccacauguucaucaaguggaaggucgaguacaucaagaccgaggccaucgugugcguggagcugaccucccaggagcggcagugcagccugaucgaggccgggacccgcuucaaccucggccccgucaccaucacccuguccgagccccggaacauccagcagaagcugcccccggagaucaucacgcuccaccccaagaucgaggagggguucuucgaccugaugcacgugcagaaggugcugagcgccuccaccgucugcaagcuccagagcugcacccacggcauccccggcgaccugcagaucuaccacaucgggaaccugcucaagggcgaccgccugaacgggcaccugauccacaagaucgagccgcacuucaacaccuccuggaugagcugggacggcugcgaccucgacuacuacugcaacaugggggacuggcccuccugcacguacaccggcgugacccagcacaaccacgccgccuucgugaaccugcugaacaucgagaccgacuacacgaagaccuuccacuuccacagcaagcgggucaccgcccacggcgacacgccccagcucgaccugaaggcccgccccaccuacggggcgggcgagaucaccgugcugguggaggucgccgacauggagcuccacaccaagaagguggagaucuccgggcugaaguucgccagccuggccugcaccggcugcuacuccugcagcuccgggaucagcugcaaggugcggauccacgucgacgagccggacgagcucacggugcacgugaaguccagcgaccccgacgucguggccgcgagcaccucccugauggcccgcaagcuggaguucggcaccgacagcaccuucaaggccuucuccgccaugcccaagacgagccucugcuucuacaucguggagcgggaguacugcaaguccugcagcgaggacgacaccaagaagugcgucgacaccaagcuggagcagccccaguccauccugaucgagcacaagggcaccaucaucgggaagcagaacgacacgugcaccgccaaggcgagcugcuggcucgaguccgucaagagcuucuucuacggccugaagaacaugcugggguccguguucggcaacuucuucguggggauccuccuguuccuggccccguucgugcuccuggugcuguucuucauguucggcuggaagauccucuucugcuucaagugcugccgccggacccgcggccuguucaaguaccgccaccugaaggacgacgaggagaccggguaccggaagaucaucgagcgccucaacagcaagaagggcaagaaccggcugcuggacggggagcgccucgccgaccggaagaucgccgagcuguucuccaccaagacgcacaucggc

SEQ ID NO: 12168 - RNA, 3495 nt, Artificial Sequence
  derived and/or modified CDS sequence (opt1) from CCHVF(CCHVF K229_243)__KX013466.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugaccgugucccugagcccggugcaguccgcccccgucggccacgggaagacgaucgagaccuaccagacccgcgagggcuucaccagcaucugccucuucaugcugggcuccauccuguuccucgugagcugccuggugaaggggcuggucgacuccgugagcgacuccuucuuccccggccucagcgugugcaagacgugcuccaucgggagcaucaacggcuucgagaucgagucccacaagugcuacugcagccuguucugcugccccuacugccggcacugcuccgccgaccgcgagauccaccagcugcaccucagcaucugcaagaagcggaagaccggguccaacgucaugcuggccgugugcaagcgcaugugcuuccgggccaccaucgaggcgagccgccgcgcccugcucauccgguccaucaucaacaccacguucgucaucugcauccugacccugaccaucugcguggugagcaccagcgccgucgagauggagaaccucccggccggcacgugggagcgcgaggaggaccugaccaacuucugccaccaggagugccaggugaccgagaccgagugccugugccccuacgaggcccuggugcuccggaagccccuguuccuggacuccaucgucaagggcaugaagaaccuccugaacagcacgucccuggagaccagccucuccaucgaggcgcccuggggcgccaucaacgugcagagcaccuucaagccgaccguguccaccgccaacaucgcccugagcugguccagcgucgagcaccgcgggaacaagauccuggugacggggcgguccgagagcaucaugaagcucgaggagcgcaccggcguguccugggaccugggggucgaggacgccagcgaguccaagcugcucaccgugagcaucauggaccugucccagauguacagccccguguucgaguaccugagcggcgaccggcaggucgaggaguggcccaaggcgaccugcacgggcgacugccccgagcgcugcgggugcaccuccagcacgugccuccacaaggaguggccgcacucccggaacuggcgcugcaaccccaccuggugcuggggcguggggaccggcugcacgugcugcggcguggacgucaaggaccuguucaccgaccacauguucgugaaguggaagguggaguacaucaagaccgaggccaucgucugcguggagcugaccagccaggagcggcagugcucccucaucgaggccgggacccgcuucaaccugggccccgugaccaucacccugagcgagccccggaacauccagcagaagcucccgcccgagaucaucacgcugcaccccaaggucgaggagggguucuucgaccugaugcacgugcagaaggugcucuccgccagcaccgucugcaagcugcaguccugcacccacggcaucccgggggaccuccagguguaccacaucggcaaccugcugaagggcgaccgcgugaacgggcaccugauccacaagaucgagccccacuucaacaccagcuggauguccugggacggcugcgaccucgacuacuacugcaacaugggggacuggcccagcugcacguacaccggcgucacccagcacaaccacgccgcguucgugaaccugcugaacaucgagaccgacuacacgaagaccuuccacuuccacuccaagcgggugaccgcccacggggacacgccccagcucgaccugaaggcccgcccgaccuacggcgccggcgagaucaccguccugguggagguggcggacauggagcuccacaccaagaaggucgagaucagcgggcugaaguucgccucccuggccugcaccggcugcuacgccugcagcuccgggaucagcugcaaggugcggauccacguggacgagcccgacgagcucacgguccacgugaaguccagcgaccccgacguggucgccgcgagcaccucccugauggcccgcaagcuggaguucggcaccgacagcaccuucaaggccuucuccgccaugcccaagacgagccucugcuucuacaucguggagaaggaguacugcaaguccugcagcgaggaggacacccagaagugcguggacaccaagcuggagcagccgcaguccauccugaucgagcacaaggggaccaucaucggcaagcagaacgacacgugcaccgccaaggcgagcugcuggcucgaguccgucaagagcuucuucuacggccugaagaacaugcugggguccguguucggcaacuucuucaucgggauccuccuguuccugacccccuucgugcuccugguccuguucuucauguucggcuggaagauccucuucugcuucaagugcugccggcgcacccgcgggcugcugaaguaccggcaccucaaggacgacgaggagaccggcuaccgccggaucaucgagcgccugaacaacaagaagggcaagaaccggcugcucgacggggagcgccuggccgaccggaagaucgccgagcuguucagcacgaagacccacaucggc

SEQ ID NO: 12169 - RNA, 3495 nt, Artificial Sequence
  derived and/or modified CDS sequence (opt1) from CCHVF(CCHVF K315_14)__KX013469.1__Gn-NSm-Gc
agcgaggagcccggcgacgacugcaucucccgcacccagcugcucaagaccgagacggccgagauccacgacgacaacuacgggggcccgggggacaagaucaccaucugcaacggcagcaccguggucgaccagcggcugggguccgagcugggcugcuacaccaucaaccgcgucaagagcuucaagcucugcaagaacuccgccacgggcaagaccugcgagaucgacagcacccccgugaagugccggcagggguucugccugaagaucacccaggagggccgcgggcacgugaagcugucccggggcagcgagguggugcucgacgucugcgacuccagcugcgagaucaugauccccaaggggacgggcgacauccugguggacugcuccggcgggcagcagcacuuccugaaggacaaccucaucgaccugggcugcccccacaucccgcugcucgggaagauggcgaucuacaucugccgcaugagcaaccacccccggaccaccauggccuuccuguucugguucuccuucggcuacgugaucacgugcaucuucugcaaggcccuguucuacagccucaucaucaucggcacccuggggaagaagaucaagcaguaccgcgagcugaagccccagaccugcaccaucugcgagaccgcccccgucaacgccaucgacgcggagaugcacgaccucaacugcuccuacaacaucugcccguacugcgccagccggcugacguccgagggccuggcccgccacgugacccagugccccaagcggaaggagaagguggaggagaccgagcucuaccugaaccuggagcgcauccccuggaucguccggaagcuccuccaggugagcgaguccaccgggguggcccugaagcgcagcagcuggcucaucguccugcuggugcuccugacggugucccugagccccguccaguccgcgccggugggccacgggaagaccaucgagaccuaccagacccgggagggcuucacgagcaucugccucuucaugcugggcuccauccuguucaucgugagcugccucgucaaggggcugguguacuccgugagcgacuccuucuuccccggccugagcgucugcaagaccugcuccaucgggagcaucaacggcuucgagaucgagucccacaagugcuacugcagccucuucugcugccccuacugccgccacugcuccgccgaccgggagauccaccagcugcaccugagcaucugcaagaagcgcaagaccggguccaacgugaugcucgccgucugcaagcggaugugcuucaaggccaccaucgaggccagccgccgggcgcugcugauccgcuccaucaucaacacgaccuucgugaucugcauccucacccuggccaucugcguggucagcaccagcgccguggagauggaggaccugcccgccggcacgugggagcgcgaggaggaccucaccaacuucugccaccaggagugccaggugaccgagaccgagugccugugcccguacgaggcccugguccugcggaagccccucuuccuggacuccaucgugaagggcaugaagaagcugcucaacagcacgucccuggagaccagccuguccaucgaggcgcccuggggcgccaucaacgugcagagcaccuucaagcccaccgucuccaccgccaacaucgcccucagcugguccagcguggagcaccgcgggaacaagauccuggugacggggcgguccgagagcaucaugaagcuggaggagcgcaccggcgucuccugggaccucgggguggaggacgccagcgaguccaagcugcugaccgugagcaucauggaccucucccagauguacagcccggucuucgaguaccugagcggcgaccgccagguggaggaguggcccaaggcgaccugcacgggcgacugccccgagcggugcgggugcaccuccagcacgugccugcacaaggaguggccccacucccggaacuggcgcugcaacccgaccuggugcuggggcguggggaccggcugcacgugcugcggcgucgacgugaaggaccucuucaccgaccacauguucaucaaguggaagguggaguacaucaagaccgaggccaucgucugcguggagcugaccagccaggagcggcagugcucccugaucgaggccgggacccgcuucaaccucggccccgugaccaucacccugagcgagccccggaacauccagcagaagcugcccccggagaucaucacgcuccaccccaagaucgaggagggguucuucgaccugaugcacguccagaaggugcuguccgccagcaccgugugcaagcuccaguccugcacccacggcauccccggggaccugcagaucuaccacaucggcaaccugcucaagggcgaccgcgucaacgggcaccugauccacaagaucgagccgcacuucaacaccagcuggauguccugggacggcugcgaccuggacuacuacugcaacaugggggacuggcccagcugcacguacaccggcgugacccagcacaaccacgccgcguucgugaaccuccugaacaucgagaccgacuacacgaagaccuuccacuuccacuccaagcgggucaccgcccacggggacacgccccagcuggaccucaaggcccgccccaccuacggcgccggcgagaucaccgugcugguggaggucgcggacauggagcugcacaccaagaagguggagaucagcgggcucaaguucgccucccugaccugcacgggcugcuacgccugcagcuccgggaucagcugcaaggugcggauccacgucgacgagccggacgagcugaccgugcacgugaaguccagcgaccccgacgucguggccgccagcaccucccucauggcgcgcaagcuggaguucggcaccgacagcacguucaaggccuucuccgccaugcccaagaccagccugugcuucuacaucguggagcgggaguacugcaaguccugcagcgaggacgacaccaagaagugcgucgacaccaagcucgagcagccccaguccauccugaucgagcacaaggggaccaucaucggcaagcagaacgacacgugcaccgccaaggccagcugcuggcuggaguccgucaagagcuucuucuacggccucaagaacaugcugggguccguguucggcagcuucuucguggggauccuccucuuccuggcgccguucgugcugcucgugcuguucuucauguucggcuggaagauccuguucugcuucaagugcugccgccggacccgcgggcuguucaaguaccgccaccugaaggacgacgaggagaccggcuaccggcgcaucaucgagcggcugaacuccaagaagggcaagaaccgccuccuggacggggagcggcuggccgaccgcaagaucgccgagcuguucagcacgaagacccacaucggc

SEQ ID NO: 12170 - RNA, 3495 nt, Artificial Sequence
  derived and/or modified CDS sequence (opt1) from CCHVF(CCHVF K323_27)__KX013472.1__Gn-NSm-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucacgugcaucuucugcaaggcccuguucuaccuccugaucaucaucggcacccuggggaagaagaucaagcaguaccgcgagcucaagccccagaccugcaccaucugcgagaccgcccccgugaacgcgaucgacgccgagaugcacgaccugaacugcagcuacaacaucugcccguacugcgccucccggcugacgagcgacggccucgcccgccacgugacccagugccccaagcggaaggagaaggucgaggagaccgagcuguaccugaaccucgagcgcauccccuggaucgugcggaagcugcuccagguguccgagagcaccggggucgcgcugaagcgcuccagcuggcugacggugcugcucgugcugcugaccgucagccucucccccgugcagagcgccccggugggccacgggaacaccaucgagaccuaccagacgcgggagggcuucaccuccaucugccuguucaugcugggcagcauccucuucaucgucuccugccuggugaaggggcugguggacagcgucuccgacagcuucuuccccggccucuccgugugcaagaccugcagcaucggguccaucaacggcuucgagaucgagagccacaagugcuacugcucccuguucugcugcccccacugccgccaccggagcgccgaccgcgagauccaccagcugcaccucuccaucugcaagaagcggaagaccgggagcaacgugaugcuggccgucugcaagcgcaugugccccaaggccacgaucgaggcgucccggcgcgcccugccgauccgcagcaucaucaacaccacccucgugaugugcauccugacccuggccaucugcgucguguccacgagcgccguggagauggaggaccuccccgccggcaccugggagcgggaggaggaccugaccaacuucugccaccaggagugccaggucaccgagacggagugccugugccccuacgaggcgcuggugcuccgcaagccccuguuccuggacagcaucgccaagggcaugaagaaccuccugaacuccaccagccuggagaccucccucagcaucgaggccccguggggcgccaucaacgugcaguccaccuucaagcccaccgucagcacggccaacaucgcgcuguccuggagcuccguggagcaccgggggaacaagauccuggugaccgggcgcagcgaguccaucaugaagcucgaggagcggaccggcgucagcugggaccuggggguggaggacgccuccgagagcaagcugcucaccguguccaucauggaccugagccagauguacucccccgucuucgaguaccugagcggcgaccgccagguggaggaguggcccaaggccacgugcaccggcgacugcccggagcggugcgggugcaccagcuccacgugccuccacaaggaguggccccacagccgcaacuggcggugcaaccccaccuggugcuggggcguggggaccggcugcacgugcugcggcgucgacgugaaggaccuguucaccgaccacauguucaucaaguggaagguggaguacaucaagaccgaggccaucgucugcguggagcugaccgggcaggagcgccagugcucccucaucgaggccggcacccgguucaaccuggggcccgugaccaucacgcugagcgagccgcgcaacauccagcagaagcucccgcccgagaucaucacccugcaccccaagaucgaggagggcuucuucgaccugaugcacguccagaaggugcucuccgcgagcaccgugugcaagcugcaguccugcacccacgggauccccggcgaccugcagaucuaccacaucggcaaccuccugaagggggaccgggucaacggccaccugauccacaagaucgagccccacuucaacacgagcuggauguccugggacgggugcgaccucgacuacuacugcaacaugggcgacuggcccagcugcaccuacaccggggugacccagcacaaccacgccgccuucgugaaccugcugaacaucgagacggacuacaccaagaccuuccacuuccacuccaagcgcgucaccgcccacggcgacacgccgcagcucgaccugaaggcgcggcccaccuacggcgccggggagaucaccgugcugguggaggucgccgacauggagcuccacaccaagaagguggagaucagcggccugaaguucgccucccugacgugcaccgggugcuacgccugcagcuccggcaucagcugcaaggugcgcauccacgucgacgagcccgacgagcucaccgugcacgugaaguccagcgaccccgacgucguggcggccuccaccagccugauggcccggaagcuggaguucgggacggacagcaccuucaaggccuucuccgccaugccgaagaccagccucugcuucuacaucguggagcgcgaguacugcaaguccugcagcgaggacgacaccaagaagugcgucgacaccaagcuggagcagccccaguccauccugaucgagcacaagggcacgaucaucggcaagcagaacgacacgugcaccgcgaaggccagcugcuggcucgaguccgucaagagcuucuucuacgggcugaagaacaugcugggcuccguguucgggagcuucuucgugggcauccuccuguuccuggcccccuucgugcuccuggugcuguucuucauguucggguggaagauccucuucugcuucaagugcugccggcgcacccgcggccuguucaaguaccggcaccugaacgacgacgaggagaccggcuaccgccggaucaucgagcgccucaacuccaagaaggggaagaaccggcugcuggacggcgagcgccucgccgaccggaagaucgccgagcuguucagcaccaagacccacaucggg

SEQ ID NO: 12171 - RNA, 3495 nt, Artificial Sequence
  derived and/or modified CDS sequence (opt1) from CCHVF(CCHVF K340_6)__KX013475.1__Gn-NSm-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccacgaccggcaagaccugcgagaucgacagcacccccgugaagugccggcagggguucugccugaagaucacgcaggagggccgcgggcacgugaagcugucccggggcagcgaggucgugcucgacgccugcgacuccagcugcgagaucaugauccccaaggggaccggcgacauccugguggacugcuccggcgggcagcagcacuuccugaaggacaaccucaucgaccugggcugcccccacaucccgccccuggggaagauggcgaucuacaucugccgcaugagcaaccacccccggaccaccauggccuuccucuucugguucuccuucggcuacgucaucacgugcaucuucugcaaggcccuguucuacagccugaucaucaucggcacccucgggaagaagaucaagcaguaccgcgagcugaagccccagaccugcaccaucugcgagacggccccggugaacgccaucgacgcggagaugcacgaccugaacugcuccuacaacaucugccccuacugcgccagccggcucaccuccgacggccuggcccgccacgugacccagugccccaagcggaaggagaaggucgaggagaccgagcuguaccucaaccuggagcgcauccccuggaucgugcggaagcugcuccaggugagcgaguccacgggggucgcccugaagcgcagcagcuggcugaucgugcuccuggugcugcucaccgucucccugagcccggugcaguccgcgcccgugggccacgggaagaccaucgagaccuaccagacgcgggagggcuucaccagcaucugccuguucaugcucggcuccauccuguucaucgucagcugccuggugaaggggcucguggacuccgucagcgacuccuucuuccccggccugagcgugugcaagaccugcuccaucgggagcaucaacggcuucgagaucgagucccacaagugcuacugcagccuguucugcugccccuacugccgccacugcuccgccgaccgggagauccaccagcuccaccugagcaucugcaagaagcgcaagaccggguccaacgugaugcuggccgucugcaagcggaugugcuucaaggccacgaucgaggccagccgccgggcgcuccugauccgcuccaucaucaacaccaccuucgugaugugcauccugacccucgccaucugcgucgugagcacgagcgccguggagauggaggaccugccggccggcaccugggagcgcgaggaggaccugaccaacuucugccaccaggagugccaggucaccgagacggagugccucugccccuacgaggcccuggugcugcggaagccccugucccucgacagcaucgugaagggcaugaagaaccugcugaacuccaccagccucgagaccucccugagcaucgaggcgcccuggggcgccaucaacguccaguccaccuucaagccgaccgugagcacggccaacaucgcccuguccuggagcuccguggagcaccgcgggaacaagauccucgucaccgggcggagcgaguccaucaugaagcuggaggagcgcaccggcgugagcugggaccuggggguggaggacgccuccgagagcaagcuccugaccgucuccaucauggaccugagccagauguacagccccguguucgaguaccucuccggcgaccgccagguggaggaguggcccaaggcgacgugcaccggcgacugccccgagcggugcgggugcaccagcuccacgugccugcacaaggaguggccgcacagccggaacuggcgcugcaaccccaccuggugcuggggcgucgggaccggcugcacgugcugcggcguggacgugaaggaccuguucaccgaccacauguucaucaaguggaaggucgaguacaucaagaccgaggccaucgugugcguggagcucaccucccaggagcggcagugcagccugaucgaggccgggacccgcuucaaccugggccccgucaccaucacgcucuccgagccccggaacauccagcagaagcugccgcccgagaucaucacccugcaccccaagaucgaggagggguucuucgaccucaugcacgugcagaaggugcugagcgccuccaccgucugcaagcugcagagcugcacccacggcaucccgggggaccuccagaucuaccacaucggcaaccugcugaagggcgaccgcgugaacgggcaccucauccacaagaucgagccccacuucaacacguccuggaugagcugggacggcugcgaccuggacuacuacugcaacaugggggacuggcccuccugcaccuacaccggcgugacccagcacaaccacgccgcguucgucaaccugcucaacaucgagacggacuacaccaagaccuuccacuuccacagcaagcgggugaccgcccacggggacacgccccagcuggaccugaaggcccgcccgaccuacggcgccggcgagaucaccgugcucgucgaggugaccgacauggagcugcacacgaagaagguggagaucuccgggcugaaguucgcgagccugaccugcaccggcugcuacgccugcuccagcgggaucuccugcaagguccggauccacguggacgagcccgacgagcucaccgugcacgucaagagcagcgaccccgacgugguggccgccuccacgagccugauggcccgcaagcucgaguucggcaccgacuccaccuucaaggcguucagcgccaugcccaagaccucccugugcuucuacaucgucgagcgggaguacugcaagagcugcuccgaggacgacaccaagaagugcguggacacgaagcuggagcagccgcagagcauccucaucgagcacaaggggaccaucaucggcaagcagaacgacacgugcaccgccaaggccuccugcuggcuggagagcgugaaguccuucuucuacggccugaagaacaugcucgggagcgucuucggcuccuucuucguggggauccugcuguuccucgcccccuucgugcugcugguccucuucuucauguucggcuggaagauccuguucugcuucaagugcugccgccggacccgcgggcuguucaaguaccgccacuucaaggacgacgaggagaccggcuaccggcgcaucaucgagcggcucaacagcaagaagggcaagaaccgccugcuggacggggagcggcucgcggaccgcaagaucgccgagcuguucuccaccaagacccacaucggc

SEQ ID NO: 12172 - RNA, 3495 nt, Artificial Sequence
  derived and/or modified CDS sequence (opt1) from CCHVF(CCHVF Mamon)__KX013478.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucguguccgacgcgugcgacagcuccugcgaggugaugauccccaaggggacgggcgacauccucgucgacugcagcggcgggcagcagcacuuccugaaggacaaccugaucgaccucggcugcccccacaucccgcugcuggggaagauggccaucuacaucugccggauguccaaccacccccgcaccaccguggccuuccucuucugguucagcuucggcuacgugaucacgugcaucuucugcaaggcccuguucuacucccugaucaucaucggcacccucgggaagaagaucaagcaguaccgggagcugaagccccagaccugcaccaucugcgagaccgcccccgucaacgcgaucgacgccgagaugcacgaccugaacugcagcuacaacaucugcccguacugcgccucccgccucacgagcgacggccuggcccggcacgugccccagugccccaagcgcaaggagaagguggaggagaccgagcuguaccucaaccuggagcggauccccuggaucguccgcaagcugcuccagguguccgagagcaccgggguggcgcugaagcggagcuccuggcugaucguccuccuggugcugcucaccgugagccuguccccgguccagagcgcccccgugggccacgggaagacgaucgagaccuaccagacccgcgagggcuucaccuccaucugccuguucaugcucggcagcauccuguuccugguguccugccucgucaaggggcugguggacagcguguccgacagcuucuuccccggccuguccgucugcaagacgugcagcaucggguccaucaacggcuucgagaucgagagccacaagugcuacugcucccucuucugcugccccuacugccggcacugcagcgccgaccgcgagauccaccagcugcaccuguccaucugcaagaagcggaagaccgggagcaacgugaugcucgccgucugcaagcgcaugugcuuccgggccaccaucgaggcgucccgccgcgcccugcugauccggagcaucaucaacaccacguucgugaucugcauccucacccugaccaucugcguggucagcaccuccgccguggagauggagaaccugccgagcggcacgugggagcgcgaggaggaccucaccaacuucugccaccaggagugccaggugaccgagaccgagugccugugccccuacgaggcccugguccugcggaagccccucuuccuggacuccaucgugaagggcaugaagaaccugcucaacagcacgucccuggagaccagccuguccaucgaggcccccuggggcgcgaucaacgugcagagcaccuucaagccgaccgucuccaccgccaacaucgcccucagcugguccagcguggagcaccgcgggaacaagauccuggugacggggcgguccgagagcaucaugaagcuggaggagcgcaccggcgucuccugggaccucgggguggaggacgccagcgaguccaagcugcugaccgugagcaucauggaccucagccagauguacucccccgucuucgaguaccugagcggcgaccgccagguggaggaguggcccaaggcgaccugcacgggcgacugccccgagcggugcgggugcaccuccagcacgugccugcacaaggaguggccgcacucccggaacuggcgcugcaaccccaccuggugcuggggcguggggaccggcugcacgugcugcggcgucgacgugaaggaccucuucaccgaccacauguucgugaaguggaaggucgaguacaucaagaccgaggccaucgugugcguggagcugaccagccaggagcggcagugcucccugaucgaggccgggacccgcuucaaccucggccccgucaccaucacccugagcgagccccggaacauccagcagaagcugccgcccgagaucaucacgcuccaccccaagguggaggagggguucuucgaccugaugcacgugcagaagguccuguccgccagcaccgugugcaagcuccaguccugcacccacggcaucccgggggaccuccagguguaccacaucggcaaccugcucaagggcgaccgcgucaacgggcaccugauccacaagaucgagccccacuucaacaccagcuggauguccugggacggcugcgaccuggacuacuacugcaacaugggggacuggcccagcugcacguacaccggcgugacccagcacaaccacgccgccuucgugaaccuccugaacaucgagaccgacuacacgaagaccuuccacuuccacuccaagcgggucaccgcgcacggggacacgccccagcuggaccucaaggcccgcccgaccuacggcgccggcgagaucaccgugcugguggaggucgccgacauggagcugcacaccaagaagguggagaucagcgggcucaaguucgcgucccuggccugcaccggcugcuacgccugcagcuccgggaucagcugcaaggugcggauccacgucgacgagcccgacgagcugacggugcacgucaagagcuccgaccccgacgugguggccgccagcaccucccucauggcgcgcaagcuggaguucggcaccgacagcaccuucaaggccuucuccgccaugcccaagacgagccugugcuucuacaucguggagcgggaguacugcaaguccugcagcgaggaggacacccagaagugcgucgacaccaagcucgagcagccgcaguccauccugaucgagcacaaggggaccaucaucggcaagcagaacgacacgugcaccgccaagaccagcugcuggcuggaguccgucaagagcuucuucuacggccucaagaacaugcugggguccguguucggcaacuucuucaucgggauccugcuguuccuggcccccuucgugcugcucgugcuguucuucauguucggcuggaagauccuguucugcuucaagugcugccgccgcacccgggggcuccugaaguaccgccaccugaaggacgacgaggagaccggcuaccggcgcaucaucgagcggcucaacaacaagaagggcaagaaccgccugcuggacggggagcggcucgcggaccgcaagaucgccgagcuguucagcacgaagacccacaucggc

SEQ ID NO: 12173 - RNA, 3495 nt, Artificial Sequence
  derived and/or modified CDS sequence (opt1) from CCHVF(CCHVF Min)__KX013481.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugaccgugucccugagcccggugcaguccgcccccgucggccacgggaagacgaucgagaccuaccagacccgcgagggcuucaccagcaucugccucuucaugcugggcuccauccuguuccucgugagcugccuggugaaggggcuggucgacuccgugagcgacuccuucuuccccggccucagcgugugcaagacgugcaccaucggguccaucaacggcuucgagaucgagagccacaagugcuacugcucccuguucugcugccccuacugccggcacugcagcgccgaccgcgagauccaccagcugcaccucuccaucugcaagaagcggaagaccgggagcaacgucaugcuggccgugugcaagcgcaugugcuuccgggccaccaucgaggcgucccgccgcgcccugcucauccggagcaucaucaacacgaccuucgucaucugcauccugacccugaccaucugcgugguguccacgagcgccgucgagauggagaaccucccgagcggcaccugggagcgcgaggaggaccugaccaacuucugccaccaggagugccaggugaccgagacggagugccugugccccuacgaggcccuggugcuccggaagccccuguuccuggacuccaucgucaagggcaccaagaaccuccugaacagcaccucccuggagaccagccucuccaucgaggcccccuggggcgcgaucaacgugcagagcaccuucaagccgacgguguccaccgccaacaucgcccugagcugguccagcgucgagcaccgcgggaacaagauccuggugaccgggcgguccgagagcaucaugaagcucgaggagcgcaccggcguguccugggaccugggggucgaggacgccagcgaguccaagcugcucacggugagcaucauggaccugucccagauguacagccccguguucgaguaccugagcggcgaccggcaggucgaggaguggcccaaggcgaccugcaccggcgacugccccgagcgcugcgggugcaccuccagcacgugccuccacaaggaguggccgcacucccggaacuggcgcugcaaccccaccuggugcuggggcguggggaccggcugcacgugcugcggcguggacgucaaggaccuguucaccgaccacauguucgugaaguggaagguggaguacaucaagaccgaggccaucgucugcguggagcugaccagccaggagcggcagugcucccucaucgaggccgggacccgcuucaaccugggccccgugacgaucacccugagcgagccccggaacauccagcagaagcucccgcccgagaucaucacccugcaccccaaggucgaggagggguucuucgaccugaugcacgugcagaaggugcucuccgccagcaccgucugcaagcugcaguccugcacgcacggcaucccgggggaccuccagguguaccacaucggcaaccugcugaagggcgaccgcaucaacgggcaccugauccacaagaucgagccccacuucaacaccagcuggauguccugggacggcugcgaccucgacuacuacugcaacaugggggacuggcccagcugcaccuacaccggcgugacgcagcacaaccacgccgccuucgucaaccugcugaacaucgagaccgacuacaccaagaccuuccacuuccacuccaagcgggugacggcgcacggggacacgccccagcucgaccugaaggcccgcccgaccuacggcgccggcgagaucaccgugcuggucgagguggccgacauggagcuccacaccaagaagguggagaucagcgggcugaaguucgcgucccuggccugcaccggcugcuacgccugcagcuccgggaucagcugcaagguccggauccacguggacgagcccgacgagcucaccgugcacgucaaguccagcgaccccgacgugguggccgccagcaccucccugauggcgcgcaagcuggaguucggcacggacagcaccuucaaggccuucuccgccaugcccaagaccagccucugcuucuacaucgucgagcgggaguacugcaaguccugcagcgaggaggacacccagaagugcguggacaccaagcuggagcagccgcaguccauccugaucgagcacaaggggacgaucaucggcaagcagaacgacacgugcaccgccaaggccagcugcuggcucgaguccgucaagagcuucuucuacggccugaagaacaugcugggguccguguucggcaacuucuucaucgggauccuccuguuccuggcgcccuucgugcuccuggugcuguucuucauguucggcuggaagauccucuucugcuucaagugcugccgccgcacccgggggcugcugaaguaccgccaccucaaggacgacgaggagaccggcuaccggcgcaucaucgagcggcugaacaacaagaagggcaagaaccgccugcucgacggggagcggcuggccgaccgcaagaucgccgagcuguucagcaccaagacccacaucggc

SEQ ID NO: 12174 - RNA, 3495 nt, Artificial Sequence
  derived and/or modified CDS sequence (opt1) from CCHVF(CCHVF Nakiwogo)__KX013484.1__Gn-NSm-Gc
gccgagggcgugagcaacgacugcgucucccgcacccagcugaucaagaccgagguggccgagauccacgaggacagcuacgggggccccggggagaagaucacgaucugcaacggcuccaccaucguggaccagcggcucgggagcgagcugggcugcuacaccaucaaccgcgucaagaccuacaagcugugcgagaacuccgcgacggagaagggcugcgagaucgacagcgugccggugaagugcaagcagggguucugccucaaggucacccaggagggccgggggcacgugaagcugucccgcggcaccgagaucgugcuggacgucugcgacaccagcugcgagcucaugauccccaaggggacgggcgacauccugguggacugcuccggcgggcagcagcacuuccugcaggacaaccucaucgaccugggcugccccaacgugccccugcucgggaagauggccaucuacaucugccggaugagcaaccacccgaagaccaccauggccuuccuguucugguucuccuucggcuacgucaucacgugcguggugugcaagguccuguucuaccuccugaucgugaucggcacccuggggaagaagcucaagcaguaccgcgagcugaagccccagaccugcaucgugugcgagagcauccccgucaacgugaucgacgccgagaugcacgagcugaacugcaacuacaacaucugccccuacugcgccucccggcucaccagcgacggccuggugcgccacgucacccagugcccgaagcggaaggagaagguggaggagacggagcuguaccucaaccuggagcgcauccccuggcuggugcggcgccuccugcaggucuccgagagcaccgggauggcgcugaagcgguccugcuggaugaccacccuccugauccugcucguggucagccugucccccgugcagagcgcccccgugggccaggagaaggccaucgaggucuaccaggugcgcgagagcuacacguccaugugccuguucgugcucgggagcguccuguucgccguguccuggcuggugaagggccucaucgacggcaucgggaacagcuucuucccgggccuguccgucugcaagaccugcagcaucggguccaucaacggcuucgagaucgagagccacaagugcuacugcucccuguucugcugccccuacugccgggcgugcagcuccgacaagaucacccaccgcaugcaccucaacaucugcaagcggcgcaagguggggagcaacgugaugcuggccgucugcaagcggaugugcuucaaggccaccguggaggccuccaacagcgcccugcucauccgcuccaucaucaacagcacguucgugaucugcguccugauccuggugaucugcguggucuccaccagcgcgguggacauggagaaccuccccgccggcaucugggagcgggaggaggaccugaccaacuucugccaccaggagugccaggugaccgagacggagugccugugccccuacgaggcccugauccuccgcaagccgcuguaccuggacuccaucgccaagggcaugaagucccuccugaacagcaccaaccuggagaccagccucagcaucgaggcccccuggggcgcgaucaacguccaguccaccuucaagcccacggugagcgccgccaacaucgcccuguccuggagcuccguggagcaccgcgggaacaagauccuggucagcgggcgguccgagagcaucaugaagcucgaggagcgcaccggcaucuccuggagccuggggguggaggacgccuccgagagcaagacccugaccguguccgucauggaccucagccagauguacucccccguguucgaguaccugagcggcgaccgccagguggaggaguggccgaaggcgacgugcaccggcgacugccccgagcggugcgggugcaccagcuccacgugccugcacaaggaguggccccacagccggaacuggcgcugcaaccccaccuggugcuggggcgucgggaccggcugcacgugcugcggccucgacgugcgggaccuguucaccgacuacaugauggugaaguggaaggucgaguacgugaagaccgaggccaucaugugcguggagcugaccucccaggagcgccagugcagccucaucgaggccgggacccgguucaaccugggcccggucaccaucacccuguccgagccccgcaacgugcagcagcggcuccccagcgagaucgugacgcugcaccccaagaucgaggagggguucuucgaccugaugcacguccagaaggugcuguucugcaagcacucccuccaggccaccagcugcacccacggcgugccgggggaccugcaggucuaccacgugggcaaccuccugaagggcgacaaggugaacgggcacuccauccacaagaucgagagccacuucaacaccuccuggaugagcugggacggcugcgaccuggacuacuucugcaacaugggggacuggcccuccugcacguacaccggcgucacccagcacaaccgcgccgcguucgugaacaugcucaacaucgagaccgacuacacgaagaccuuccacuuccacagcaagcgggugaccgcccacggggacacgccccagcuggaccugaaggcccgcccgaccuacggcgccggcgaggucaccgugcucguggaggucgcggaccuggagcugcacaccaagaagaucgagguguccgggcucaaguucgccagccugaccugcuccggcugcuacgccugcagcuccgggaucagcugcaagguccggauccacgugaacgagcccgacgaguucacggugcacgucaagagcaacgaccccgacgugguggccgccggcuccagccugauggcgcgcaagaucgagcucggggccgacuccaccuucaaggccuucagcuccaugcccaagaacagccugugcuucuacaucgucgagcgggacuacugcuccagcugcaccgacgacgacacccagaagugcgugaacacgaagcuggagcacccgcaguccauccucaucgagcacaagggcaccaucaucggcaagcagaacgacacgugccccaccaagaccagcugcuggcuggaguccgucaagagcuucuucuacgggcugaagaacaugcucggcgggaucuucggcaacguguuccuggggaucuuccuguuccucgcccccuucgcccugcugauccucuucuucuucuucggcuggcgccugcuguucugccucaagugcugccggcgcacccgcggccugcugaaguacaagcagcucaaggacgaggaggaggcgggguacaagaagaucaucgagcggcugaacgacaagaagggcaagucccgccuguucgacggggagcggcucgccgaccgcaagaucgccgagcuguucagcaccaagacccacaucggc

SEQ ID NO: 12175 - RNA, 3495 nt, Artificial Sequence
  derived and/or modified CDS sequence (opt1) from CCHVF(CCHVF Saf)__KX013487.1__Gn-NSm-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuaccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugaccgugucccugagcccggugcaguccgcccccgucggccacgggaagacgaucgagaccuaccagacccgcgagggcuucaccagcaucugccucuucaugcugggcuccauccuguuccucgugagcugccuggugaaggggcuggucgacuccgugagcgacuccuucuuccccggccucagcgugugcaagacgugcuccaucgggagcaucaacggcuucgagaucgagucccacaagugcuacugcagccuguucugcugccccuacugccggcacugcuccgccgaccgcgagauccaccagcugcaccucagcaucugcaagaagcggaagaccggguccaacgucaugcuggccgugugcaagcgcaugugcuuccgggccaccaucgaggcgagccgccgcgcccugcucauccgguccaucaucaacaccacguucgucaucugcauccugacccugaccaucugcguggugagcaccagcgccgucgagauggagaaccucccguccggcacgugggagcgcgaggaggaccugaccaacuucugccaccaggagugccaggugaccgagaccgagugccugugccccuacgaggcccuggugcuccggaagccccuguucagcgacuccaucgucaagggcaugaagaaccugcucaacagcacgucccuggagaccagccuguccaucgaggcccccuggggcgcgaucaacgugcagagcaccuucaagccgaccguguccaccgccaacaucgcccucagcugguccagcgucgagcaccgcgggaacaagauccuggugacggggcgguccgagagcaucaugaagcuggaggagcgcaccggcguguccugggaccucggggucgaggacgccagcgaguccaagcugcugaccgugagcaucauggaccucagccagauguacucccccguguucgaguaccugagcggcgaccggcaggucgaggaguggcccaaggcgaccugcacgggcgacugccccgagcgcugcgggugcaccuccagcacgugccugcacaaggaguggccgcacucccggaacuggcgcugcaaccccaccuggugcuggggcguggggaccggcugcacgugcugcggcguggacgucaaggaccucuucaccgaccacauguucgugaaguggaagguggaguacaucaagaccgaggccaucgucugcguggagcugaccagccaggagcggcagugcucccugaucgaggccgggacccgcuucaaccucggccccgugaccaucacccugagcgagccccggaacauccagcagaagcugccgcccgagaucaucacgcuccaccccaaggucgaggagggguucuucgaccugaugcacgugcagaaggugcuguccgccagcaccgucugcaagcuccaguccugcacccacggcaucccgggggaccuccagguguaccacaucggcaaccugcucaagggcgaccgcgugaacgggcaccugauccacaagaucgagccccacuucaacaccagcuggauguccugggacggcugcgaccuggacuacuacugcaacaugggggacuggcccagcugcacguacaccggcgucacccagcacaaccacgccgccuucgugaaccuccugaacaucgagaccgacuacaugaagacguuccacuuccacuccaagcgggugaccgcgcacggggacacgccccagcuggaccucaaggcccgcccgaccuacggcgccggcgagaucaccguccugguggagguggccgacauggagcugcacaccaagaaggucgagaucagcgggcucaaguucgugucccuggcgugcaccggcugcuacgccugcagcuccgggaucagcugcaaggugcggauccacgucgacgagcccgacgagcugaccgugcacgucaagagcuccgaccccgacgugguggccgccagcacgucccucauggcccgcaagcuggaguucggcaccgacagcaccuucaaggcguucuccgccaugcccaagaccagccugugcuucuacaucguggagcgggaguacugcaaguccugcagcgaggaggacacgcagaagugcgucgacaccaagcucgagcagccgcaguccauccugaucgagcacaaggggaccaucaucggcaagcagaacgacacgugcaccgccaaggccagcugcuggcuggaguccgucaagagcuucuucuacggccucaagaacaugcugggguccguguucggcaacuucuucaucgggauccugcuguuccuggcccccuucgugcugcucgugcuguucuucauguucggcuggaagauccuguucugcuucaagugcugccgccgcacccgggggcuccugaaguaccgccaccugaaggacgacgaggagaccggcuaccggcgcaucaucgagcggcucaacaacaagaagggcaagaaccgccugcuggacggggagcggcucgcggaccgcaagaucgccgagcuguucagcaccaagacccacaucggc

SEQ ID NO: 12176 - RNA, 3495 nt, Artificial Sequence
  derived and/or modified CDS sequence (opt1) from CCHVF(CCHVF Ast199)__KX056051.1__Gn-NSm-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccuccaggugagcgaguccaccggggucgcgcugaagcgcugcagcuggcugaucgugcugcuggugcuccugacggucagccugucccccgugcagagcgccccggugggccacgggaagaccaucgagaccuaccagacccgggagggcuucacgaacaucugccucuucaugcugggcuccauccuguucaucgucagcugccucgugaaggggcugguggacuccgucagcgacuccuucuuccccggccugagcgugugcaagaccugcuccaucgggagcaucaacggcuucgagaucgagucccacaagugcuacugcagccucuucugcugccccuacugccgccacugcuccgccgaccgggagauccaccagcugcaccuggggaucugcaagaagcgcaagaccggcagcaacgugaugcucgccgucugcaagcggaugugcuucaaggccaccaucgaggcgucccgccgggcccugcugauccgcagcaucaucaacacgaccuucgugaucugcauccucacccuggccaucugcgucguguccaccagcgccguggagauggagaaccugcccgccggcacgugggagcgcgaggaggaccucaccaacuucugccaccaggagugccaggucaccgagaccgagugccugugcccguacgaggcgcuggugcugcggaagccccucuuccuggacuccaucgugaaggggaugaagaaccugcucaacagcacgagccuggagaccucccugagcaucgaggcccccuggggcgccaucaacguccaguccaccuucaagcccaccgugagcaccgccaacaucgcccucuccuggagcuccguggagcaccgcgggaacaagauccuggucacgggccggagcgaguccaucaugaagcuggaggagcgcaccggggugagcugggaccucggcguggaggacgcguccgagagcaagcugcugaccgucuccaucauggaccucagccagauguacuccccgguguucgaguaccugagcggcgaccgccagguggaggaguggcccaaggcgaccugcacgggggacugccccgagcggugcggcugcaccuccagcacgugccugcacaaggaguggccccacagccggaacuggcgcugcaacccgaccuggugcuggggcgucgggaccggcugcacgugcugcgggguggacgugaaggaccucuucaccgaccacauguucaucaaguggaaggucgaguacaucaagaccgaggccaucgugugcguggagcugaccucccaggagcggcagugcagccugaucgaggccggcacccgcuucaaccucgggcccgucaccaucacccuguccgagccccggaacauccagcagaagcugcccccggagaucaucacgcuccaccccaagaucgaggagggcuucuucgaccugaugcacgugcagaaggugcugagcgccuccaccgucugcaagcuccagagcugcacccacgggauccccggcgaccugcagaucuaccacaucggcaaccugcucaagggggaccgccugaacggccaccugauccacaagaucgagccgcacuucaacaccuccuggaugagcugggacgggugcgaccucgacuacuacugcaacaugggcgacuggcccuccugcacguacaccggggugacccagcacaaccacgccgccuucgugaaccugcugaacaucgagaccgacuacacgaagaccuuccacuuccacagcaagcgggucaccgcccacggcgacacgccccagcucgaccugaaggcccgccccaccuacggcgcgggggagaucaccgugcugguggaggucgccgacauggagcuccacaccaagaagguggagguguccggccugaaguucgccagccuggccugcaccgggugcuacgccugcuccagcggcaucuccugcaagguccggauccacguggacgagccggacgagcucacggugcacgucaagagcuccgaccccgacgugguggcggccagcaccucccugauggcccgcaagcuggaguucgggaccgacagcaccuucaaggccuucagcgccaugcccaagacgucccucugcuucuacaucgucgagcgggaguacugcaagagcugcuccgaggacgacaccaagaagugcguggacaccaagcuggagcagccccagagcauccugaucgagcacaagggcaccaucaucggcaagcagaacgacacgugcaccgcgaaggccuccugcuggcucgagagcgugaaguccuucuucuacgggcugaagaacaugcugggcagcgucuucgggaacuucuucgugggcauccuccuguuccuggccccguucgugcuccugguccuguucuucaucuucggguggaagauccucuucugcuucaagugcugccgccggacccgcggccuguucaaguaccgccaccugaaggacgacgaggagaccggcuaccggaagaucaucgagcgccucaacuccaagaaggggaagaaccggcugcuggacggcgagcgccucgccgaccggaagaucgccgagcuguucagcaccaagacgcacaucggg

SEQ ID NO: 12177 - RNA, 3495 nt, Artificial Sequence
  derived and/or modified CDS sequence (opt1) from CCHVF(CCHVF Ast149)__KX056054.1__Gn-NSm-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccuccaggugagcgaguccaccggggucgcgcugaagcgcagcagcuggcucaucgugcugcuggugcuccugacggucucccugagccccgugcaguccgccccggugggccacgggaagaccaucgagaccuaccagacccgggagggcuucacgaacaucugccucuucaugcugggcagcauccuguucaucgucuccugccucgugaaggggcugguggacagcgucuccgacagcuucuuccccggccuguccgugugcaagaccugcagcaucggguccaucaacggcuucgagaucgagagccacaagugcuacugcucccucuucugcugccccuacugccgccacugcagcgccgaccgggagauccaccagcugcaccuggggaucugcaagaagcgcaagaccggcuccaacgugaugcucgccgucugcaagcggaugugcuucaaggccaccaucgaggcgagccgccgggcccugcccauccgcuccaucaucaacacgaccuucgugaucugcauccugacccucgccaucugcgucgugagcaccuccgccguggagauggagaaccugccggccggcacgugggagcgcgaggaggaccugaccaacuucugccaccaggagugccaggucaccgagaccgagugccucugccccuacgaggcgcuggugcugcggaagccccuguuccucgacagcaucgugaaggggaugaagaaccugcugaacagcacgucccucgagaccagccuguccaucgaggcccccuggggcgccaucaacguccagagcaccuucaagccgaccguguccaccgccaacaucgcccugagcugguccagcguggagcaccgcgggaacaagauccucgucacgggccgguccgagagcaucaugaagcuggaggagcgcaccgggguguccugggaccugggcguggaggacgcgagcgaguccaagcuccugaccgucagcaucauggaccugucccagauguacagccccguguucgaguaccucuccggcgaccgccagguggaggaguggcccaaggcgaccugcacgggggacugccccgagcggugcggcugcaccagcagcacgugccugcacaaggaguggccgcacucccggaacuggcgcugcaaccccaccuggugcuggggcgucgggaccggcugcacgugcugcgggguggacgugaaggaccuguucaccgaccacauguucaucaaguggaaggucgaguacaucaagaccgaggccaucgugugcguggagcucaccagccaggagcggcagugcucccugaucgaggccggcacccgcuucaaccuggggcccgucaccaucacccucagcgagccccggaacauccagcagaagcugccgcccgagaucaucacgcugcaccccaagaucgaggagggcuucuucgaccucaugcacgugcagaaggugcuguccgccagcaccgucugcaagcugcaguccugcacccacgggaucccgggcgaccuccagaucuaccacaucggcaaccugcugaagggggaccgccucaacggccaccugauccacaagaucgagccccacuucaacaccagcuggauguccugggacgggugcgaccuggacuacuacugcaacaugggcgacuggcccagcugcacguacaccggggugacccagcacaaccacgccgccuucgugaaccuccugaacaucgagaccgacuacacgaagaccuuccacuuccacuccaagcgggucaccgcccacggcgacacgccccagcuggaccucaaggcccgcccgaccuacggcgcgggggagaucaccgugcugguggaggucgccgacauggagcugcacaccaagaagguggaggugagcggccucaaguucgccucccuggccugcaccgggugcuacgccugcagcuccggcaucagcugcaagguccggauccacguggacgagcccgacgagcugacggugcacgucaaguccagcgaccccgacgugguggcggccuccaccagccucauggcccgcaagcuggaguucgggaccgacagcaccuucaaggccuucuccgccaugcccaagacgagccugugcuucuacaucgucgagcgggaguacugcaaguccugcagcgaggacgacaccaagaagugcguggacaccaagcucgagcagccgcaguccauccugaucgagcacaagggcaccaucaucggcaagcagaacgacacgugcaccgcgaaggccagcugcuggcuggaguccgucaagagcuucuucuacgggcucaagaacaugcugggcuccguguucgggaacuucuucgugggcauccuccuguuccuggcccccuucgugcugcucgcccuguucuucaucuucggguggaagauccuguucugcuucaagugcugccgccggacccgcggccucuucaaguaccgccaccugaaggacgacgaggagaccggcuaccggaagaucaucgagcgccugaacagcaagaaggggaagaaccggcuccuggacggcgagcgccuggccgaccggaagaucgcggagcuguucuccaccaagacgcacaucggg

SEQ ID NO: 12178 - RNA, 3495 nt, Artificial Sequence
  derived and/or modified CDS sequence (opt1) from CCHVF(CCHVF Ast137)__KX056057.1__Gn-NSm-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccauccacaucugccgcaugagcaaccacccccggaccaccauggccuuccuguucugguucuccuucggcuacgucaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccuccaggugagcgaguccaccggggucgcgcugaagcgcagcagcuggcugaucgugcugcuggugcuccugacggucucccugagccccgugcaguccgccccggugggccacgggaagaccaucgagaccuaccagacccgggagggcuucacgaacaucugccucuucaugcugggcagcauccuguucaucgucuccuaccucgugaaggggcugguggacagcgucuccgacagcuucuuccccggccuguccgugugcaagaccugcagcaucggguccaucaacggcuucgagaucgagagccacaagugcuacugcucccucuucugcugccccuacugccgccacugcagcgccgaccgggagauccaccagcugcaccuggggaucugcaagaagcgcaagaccggcuccaacgugaugcucgccgucugcaagcggaugugcuucaaggccaccaucgaggcgagccgccgggcccugcugauccgcuccaucaucaacacgaccuucgugaucugcauccucacccuggccaucugcgucgugagcaccuccgccguggagauggagaaccugcccgccggcacgugggagcgcgaggaggaccucaccaacuucugccaccaggagugccaggucaccgagaccgagugccugugcccguacgaggcgcuggugcugcggaagccccucuuccuggacagcaucgugaaggggacgaagaaccugcucaacagcaccucccuggagaccagccuguccaucgaggcccccuggggcgccaucaacguccagagcaccuucaagcccaccguguccacggccaacaucgcccucagcugguccagcguggagcaccgcgggaacaagauccuggucaccggccgguccgagagcaucaugaagcuggaggagcgcaccgggguguccugggaccucggcguggaggacgcgagcgaguccaagcugcugaccgucagcaucauggaccucucccagauguacagcccgguguucgaguaccuguccggcgaccgccagguggaggaguggcccaaggccacgugcaccggggacugccccgagcggugcggcugcaccagcagcacgugccugcacaaggaguggccccacucccggaacuggcgcugcaacccgaccuggugcuggggcgucgggaccggcugcacgugcugcgggguggacgugaaggaccucuucaccgaccacauguucaucaaguggaaggucgaguacaucaagaccgaggccaucgugugcguggagcugaccagccaggagcggcagugcucccugaucgaggccggcacccgcuucaaccucgggcccgucaccaucacgcugagcgagccccggaacauccagcagaagcugcccccggagaucaucacccuccaccccaagaucgaggagggcuucuucgaccugaugcacgugcagaaggugcuguccgccagcaccgucugcaagcuccaguccugcacccacgggauccccggcgaccugcagaucuaccacaucggcaaccugcucaagggggaccgccugaacggccaccugauccacaagaucgagccgcacuucaacacgagcuggauguccugggacgggugcgaccucgacuacuacugcaacaugggcgacuggcccagcugcaccuacaccggggugacccagcacaaccacgcggccuucgugaaccugcugaacaucgagacggacuacaccaagaccuuccacuuccacuccaagcgggucaccgcccacggcgacacgccccagcucgaccugaaggcccgccccaccuacggcgcgggggagaucaccgugcugguggaggucgccgacauggagcuccacaccaagaagguggaggugagcggccugaaguucgccucccuggccugcacggggugcuacgccugcagcuccggcaucagcugcaagguccggauccacguggacgagccggacgagcucaccgugcacgucaaguccagcgaccccgacgugguggcggccuccaccagccugauggcccgcaagcuggaguucgggaccgacagcacguucaaggccuucuccgccaugcccaagaccagccucugcuucuacaucgucgagcgggaguacugcaaguccugcagcgaggacgacaccaagaagugcguggacaccaagcuggagcagccccaguccauccugaucgagcacaagggcaccaucaucggcaagcagaacgacacgugcaccgcgaaggccagcugcuggcucgaguccgucaagagcuucuucuacgggcugaagaacaugcugggcuccguguucgggaacuucuucgugggcauccuccuguuccuggccccguucgugcuccugguccuguucuucaucuucggguggaagauccucuucugcuucaagugcugccgccggacccgcggccuguucaaguaccgccaccugaaggacgacgaggagaccggcuaccggaagaucaucgagcgccucaacagcaagaaggggaagaaccggcugcuggacggcgagcgccucgccgaccggaagaucgccgagcuguucuccacgaagacccacaucggg

SEQ ID NO: 12179 - RNA, 3495 nt, Artificial Sequence
  derived and/or modified CDS sequence (opt1) from CCHVF(CCHVF Ast133)__KX056060.1__Gn-NSm-Gc
agcgaggagcccgacgacgacugcaucucccgcacccagcugcucaagaccgagacggccgagauccacgacgacaacuacggcgggccgggcgacaagaucaccaucugcaacgggagcaccaucguggaccagcggcugggcuccgagcuggggugcuacaccaucaaccgcgucaagagcuucaagcucugcgagaacuccgccacgggcaagaccugcgagaucgacagcacccccgugaagugccggcagggcuucugccugaagaucacccaggaggggcgcggccacgugaagcugucccgggggagcgaggucgugcucgacgcgugcgacuccagcugcgagaucaugauccccaagggcacgggggacauccugguggacugcuccggcggccagcagcacuuccugaaggacaaccucaucgaccuggggugcccccacaucccgcugcucggcaagauggccaucuacaucugccgcaugagcaaccacccccggaccaccauggccuuccuguucugguucuccuucggguacgucaucacgugcaucuucugcaaggcccuguucuaccuccugaucaucaucggcacccugggcaagaagaucaagcaguaccgcgagcucaagccccagaccugcaccaucugcgagaccgcccccgugaacgcgaucgacgccgagaugcacgaccugaacugcagcuacaacaucugcccguacugcgccucccggcugacgagcgacgggcucgcccgccacgugacccagugccccaagcggaaggagaaggucgaggagaccgagcuguaccugaaccucgagcgcauccccuggaucgugcggaagcugcuccagguguccgagagcaccggcgucgcgcucaagcgcuccagcuggcugaucgugcugcucgugcugcugacggucagccucucccccgugcagagcgccccgguggggcacggcaagaccaucgagaccuaccagacccgggagggguucacguccaucugccuguucaugcugggcagcauccucuucaucgucuccugccuggugaagggccugguggacagcgucuccgacagcuucuuccccgggcucuccgugugcaagaccugcagcaucggcuccaucaacggguucgagaucgagagccacaagugcuacugcucccuguucugcugccccuacugccgccacugcagcgccgaccgggagauccaccagcugcaccucuccaucugcaagaagcgcaagaccggcagcaacgugaugcuggccgucugcaagcggaugugcuucaaggccaccaucgaggcgucccgccgggcccugcucauccgcagcaucaucaacacgaccuucgugaugugcauccugacccuggccaucugcgucguguccaccagcgccguggagauggaggaccuccccgccgggacgugggagcgcgaggaggaccugaccaacuucugccaccaggagugccaggucaccgagaccgagugccugugcccguacgaggcgcuggugcuccggaagccccuguucagcgacuccaucgugaagggcaugaagaaccugcucaacagcacgucccuggagaccagccuguccaucgaggcccccuggggcgccaucaacguccagagcaccuucaagcccaccguguccaccgccaacaucgcccucagcugguccagcguggagcaccgcgggaacaagauccuggucacgggccgguccgagagcaucaugaagcuggaggagcgcaccgggguguccugggaccucggcguggaggacgcgagcgaguccaagcugcugaccgucagcaucauggaccucucccagauguacagcccgguguucgaguaccugagcggggaccgccagguggaggaguggcccaaggcgaccugcacgggcgacugccccgagcggugcggcugcaccuccagcacgugccugcacaaggaguggccccacucccggaacuggcgcugcaacccgaccuggugcuggggcgucgggaccgggugcacgugcugcggcguggacgugaaggaccucuucaccgaccacauguucaucaaguggaaggucgaguacaucaagaccgaggccaucgugugcguggagcugaccagccaggagcggcagugcucccugaucgaggccggcacccgcuucaaccucgggcccgucaccaucacccugagcgagccccggaacauccagcagaagcugcccccggagaucaucacgcuccaccccaagaucgaggagggcuucuucgaccugaugcacgugcagaaggugcuguccgccagcaccgucugcaagcuccaguccugcacccacgggauccccggcgaccugcagaucuaccacaucgggaaccugcucaagggcgaccgcgugaacggccaccugauccacaagaucgagccgcacuucaacaccagcuggauguccugggacgggugcgaccuggacuacuacugcaacaugggcgacuggcccagcugcacguacaccggggugacccagcacaaccacgccgccuucgucaaccuccugaacaucgagaccgacuacacgaagaccuuccacuuccacuccaagcgggugaccgcccacggcgacacgccccagcuggaccucaaggcccgccccaccuacggggcgggcgagaucaccgugcuggucgagguggccgacauggagcugcacaccaagaagguggagaucagcggccucaaguucgccucccugaccugcacggggugcuacgccugcagcuccggcaucagcugcaagguccggauccacguggacgagccggacgagcugaccgugcacgucaaguccagcgaccccgacgugguggccgcgagcaccucccucauggcccgcaagcuggaguucgggaccgacagcacguucaaggccuucuccgccaugcccaagaccagccugugcuucuacaucgucgagcgggaguacugcaaguccugcagcgaggacgacaccaagaagugcguggacaccaagcucgagcagccccaguccauccugaucgagcacaagggcaccaucaucgggaagcagaacgacacgugcaccgccaaggcgagcugcuggcuggaguccgucaagagcuucuucuacggccucaagaacaugcugggcuccguguucgggagcuucuucgugggcauccuccuguuccuggccccguucgugcugcucguccuguucuucauguucggguggaagauccuguucugcuucaagugcugccgccggacccgcggccucuucaaguaccgccaccugaaggacgacgaggagaccggguaccggcgcaucaucgagcggcugaacuccaagaagggcaagaaccgccuccuggacggcgagcggcuggccgaccgcaagaucgccgagcuguucagcuccaagacgcacaucggg

SEQ ID NO: 12180 - RNA, 3495 nt, Artificial Sequence
  derived and/or modified CDS sequence (opt1) from CCHVF(CCHVF SK/2015/human)__KX458183.1__Gn-NSm-Gc
agcgaggaguccggcgacgacugcaucagccgcacccggcugcuccgcaccgagacggccgagauccacggggacuccuacggcgggcccggcgacaagaucaccaucugcaacgggagcaccaucguggaccagcggcugggcuccgagaugggcugcuacaccaucaaccgcgucaagagcuucaagcugugcgagaacuccgccacgggcaagagcugcgagaucgacuccaucccggugcggugccgccagggguacugccucaagaucacccaggaggggcggggccacgugaagcugagccgcggguccgaggucgugcuggacgcgugcgacagcuccugcgaggugaugauccccaagggcaccggcgacauccucgucgacugcagcgggggccagcagcacuuccugaaggacaaccugaucgaccucgggugccccaacaucccccugcugggcaagauggccaucuacaucugccggauguccaaccacccgaagaccacgauggccuuccucuucugguucagcuucggcuacgugaucacgugcauccugugcaaggccaucuucuaccugcucaucaucguggggacccugggcaagcgcuucaagcaguaccgggagcugaagccccagaccugcaccaucugcgagaccacccccgccaacgcgaucgacgccgagaugcacgaccucaacugcuccuacaccaucugccccuacugcgccagccgccugacguccgacgggcuggcccggcacgucacccagugcccgaagcgcaaggagaagguggaggagaccgagcucuaccugaaccuggagcggauccccugggugguccgcaagcuccuccaggugagcgagagcaccggcguggcgcugaagcgguccagcuggcucaucguccugcuggugcuguucacggugucccugagccccguccaguccgcccccaucgggcacggcaagaccaucgagaccuaccaggcccgcgaggaguacaccggcaucugccuguucgugcucgggagcauccuguucaucguguccugccuggucaagggccucguggacggggugggcaacaucuucuucccggggcugagcaucugcaagacgugcuccaucggcagcaucaacggcuucgagaucgagucccacaagugcuacugcagccugcucugcugccccuacugccggcacugcuccgccgaccgcgagauccaccagcugcaccugagcaucugcaagaagcggaagaccggguccaacgucaugcucgccgugugcaagcgcaugugcuuccgcgcgaccauggaggucagcaacaaggcccugcugauccgguccaucaucaacaccacguucguggugugcauccucauccuggccgucugcguggugagcaccuccgccgucgagauggagagccugcccgccggcaccugggagcgcgaggaggaccucaccaacuucugccaccaggagugccaggugacggagaccgagugccugugccccuacgaggcgcuggugcugcggcgcccccucuuccuggacagcaucguccgggggaugaagaaccugcucaacuccaccagccuggagaccucccugagcaucgaggcccccuggggcgccaucaacgugcaguccacguacaagcccaccgugagcaccgccaacaucgcccucuccuggagcuccgucgagcaccgcgggaacaagauccuggugagcggccgguccgagagcaucaugaagcuggaggagcgcaccggcguguccugggaccucggggucgaggacgcgagcgaguccaagcugcugaccgugagcgugauggaccucucccagauguacagccccgucuucgaguaccugagcggcgaccgccagguggaggaguggccgaaggccacgugcaccggggacugccccgagcggugcggcugcaccaccuccacgugccugcacaaggaguggccccacagccggaacuggcgcugcaaccccaccuggugcuggggcguggggaccggcugcacgugcugcgggcucgacgucaaggaccuguucaccgacuacauguucgugaaguggaagguggaguacaucaagaccgaggccaucgucugcguggagcugaccucccagggccggcagugcagccucaucgaggccgggacccgcuucaaccugggcuccgugacgaucacccugagcgagccgcggaacauccagcacaagcucccgcccgagaucaucacccugcacccccgcaucgaggagggcuucuucgaccugaugcacguccagaaggugcucuccgccagcaccgugugcaagcugcaguccugcacgcacggggucccgggcgaccuccagguguaccacaucgggaaccugcugaagggcgacaaggugaacgggcaccugauccacaagaucgagccccacuucaacaccagcuggauguccugggacggcugcgaccucgacuacuacugcaacaugggcgacuggcccagcugcaccuacaccggggucacgcagcacaaccacgcguccuucgugaaccugcugaacaucgagaccgacuacaccaagaacuuccacuuccacagcaagcgggugaccgcccacggcgacacgccgcagcucgaccugaaggcccgccccaccuacggggccggcgagaucaccguccugguggagguggcggacauggagcuccacaccaagaagaucgagaucuccgggcugaaguucgccagccugacgugcaccggcugcuacgccugcuccagcggcaucuccugcaagguccggauccacguggacgagcccgacgagcucaccgugcacgucaagagcgacgaccccgacgugguggccgccagcuccagccugauggcgcgcaagcuggaguucgggaccgacuccacguucaaggccuucagcgccaugccgaagaccucccucugcuucuacaucgucgagcgcgaguacugcaagagcugcuccaaggaggacacccagaagugcgugaacaccaagcuggagcagccccagagcauccugaucgagcaccggggcacgaucaucgggaagcagaacaacacgugcaucgccaaggccuccugcuggcucgagagcgugaaguccuucuucuacggccugaagaacaugcugagcgggaucuucggcaaccucuuccugggcaucuuccuguuccucgcgcccuucauccugcugauccucuucuucauguucggguggcgcauccuguucugcuucaagugcugccggcgcacccggggccuguucaaguaccgccaccucaaggacgacgaggagaccggguaccggcgcaucaucgagcggcugaacaacaagaagggcaagaacaagcugcucgacggcgagcgccuggccgaccggcgcaucgccgagcuguucuccaccaagacccacaucggg

SEQ ID NO: 12181 - RNA, 3495 nt, Artificial Sequence
  derived and/or modified CDS sequence (opt1) from CCHVF(CCHVF YL16070)__KY354081.1__Gn-NSm-Gc
gccgagggcgggagcuccgacugcaucagccgcacccagcuggugaagaccgaggucgccgagauccacgaggacuccuacggcgggcccggcgagaagaucacgaucugcaacgggagcaccaucguggaccagcggcucggcuccgagcugggcugcuacaccaucaaccgcgugaagagcuacaagcugugcgagaacuccgcgagcgggaaguccugcgagaucgacagcaucccggucaagugcaagcagggcuucugccucaagaucacccaggaggggcggggccacgugaagcugucccgcgggacggagaucgugcuggacgucugcgacagcuccugcgagcucaugauccccaagggcaccggcgacauccugguggacugcagcgggggccagcagcacuuccugcagaacaaccucaucgaccuggggugccccaacgugccccugcucggcaagauggccaucuacgucugccggauguccaaccacccgaagaccaccauggccuuccuguucugguucagcuucggcuacgugaucacgugcaucgugugccgcguccuguucuaccuccugaucgccaucgggaccgugggcaagaagcugaagcaguaccgggagcucaagccccagaccugcaucgugugcgaguccguccccgugaacgccaucgacgcggagaugcacgagcugaacugcagcuacaacaucugccccuacugcgccucccgccugagcaccgacgggcucauccggcacgugacgcagugcccgaagcgccgggagaaggucgaggagaccgagcuguuccugaaccucgagcgcauccccuggcuggugcggaagcugcuccaggugagcgaguccaccggcauggcccugaagcgcagcugcuggaugaucacccugcucauccugcugcucgucuccaugagccccgugcaguccgcccccguggggaaggagcgggcgaucgagacguaccaggcccgcgaggccuacaccggcaucugccuguucguccugggcagcgugcucuucgccgucuccuggcugaccaaggcccugaucgacgggaucggcaacagcuucuucccggggcucuccgugugcaagaccugcagcaucggcuccaucaacggguucgagaucgagagccacaagugcuacugcucccuguucugcugccccuacugccgggcgugcagcuccgacaagaacacgcaccgcaugcaccugaacgugugcaagaagcggaagaugggcagcaacgucaugcucgccgugugcaagcgcaugugcuuccgggccaccaucgaggccuccaacaaggcccugcugauccgcagcaucaucaacuccaccuucgugaucugcauccucauccugaccaucugcgucgugagcacgagcgcgguggacauggagaaccugcccgccggcaucugggagaaggaggaggaccucaccaacuucugccaccaggagugccaggucaccgagaccgagugccugugccccuacgaggccauggugcugcgcaagccgcuguuccucgacuccaucgccaaggggaugaagagccugcugaacuccacgagccucgagaccucccugagcaucgaggcccccuggggcgcgaucaacgugcaguccaccuucaagcccaccgucagcgccgccaacaucgcccuguccuggagcuccguggagcaccgggggaacaagauccucgugagcggccgcuccgagagcaucaugaagcuggaggagcggacgggggucuccuggaaccugggcguggaggacgccagcgaguccaagacccucaccgugagcgucauggaccugagccagauguacucccccguguucgaguaccugagcggcgaccgccagguggaggaguggccgaaggcgaccugcacgggggacugccccgagcggugcggcugcaccuccagcaccugccuccacaaggaguggccccacucccgcaacuggcggugcaaccccaccuggugcuggggggucggcaccggcugcacgugcugcgggcuggacgugaaggacuucuucaccgacuacaugcuggugaaguggaaggucgaguacaucaagaccgaggccaucgugugcguggagcucaccagccaggagcgccagugcucccugaucgaggccggcacgcgguucaaccuggggccggucaccaucacccucagcgagccccgcaacgugcagcagcggcugccccccgagaucgugacccugcacccgaagaucgaggagggcuucuucgaccucaugcacguccagaagauccuguccgccagcacggugugcaagcugcaguccugcacccacggggugcccggcgacuuccaggucuaccacgugggcaaccuccugcgcggggacaaggugaacggccacagcauccacaagaucgagccccacuucaacaccuccuggaugagcugggacgggugcgaccuggacuacuucugcaacaugggcgacuggccguccugcaccuacacgggggucacccagcacaaccgggcggccuucaucaacaugcucaacaucgagaccgacuacaccaagacguuccacuuccacagcaagcgcgugaccgcccacggcgacaccccccagcuggaccugaaggcccggcccgccuacggcgcgggggaggugaccguccucguggagguggccgaccuggagcugcacacgaagaagcucgaggucuccggccugaagaucgccagccugaccugcuccgggugcuacgccugcagcagcggcaucuccugcaaggugcgcauccacgugaacgagcccgacgaguucaccguccacgugcggagcuccgacccggacguggucgccgcggggagcucccucauggcccgcaagaucgaguucggcgccgacagcaccuucaaggccuucuccagcaugcccaaggacucccugugcuucuacaucguggagaaggacuacugcagcuccugcacggacgacgacacccagaagugcgugaacaccaagcuggaccacccccagagcauccucaucgagcacaagggcaccaucaucgggaagcagaacgacacgugcuccaccaagaccagcugcuggcugaaguccuucaagggcuucuucuacgggcugaagaacaugcucagcggcaucuucgggaacgucuuccugggcauccugcucuuccuggcccccuucgugcugcucaucuucuucuucuucuucggcuggcggcugcuguucugccucaagugcugcaagaagaccaaggggcugcugaaguacaagcaccucaaggacaaggaggaggcgggcuacaagaagaucaucgagcgccugaacgggaagaagggcaagucccagcuguucgacggcgagcgccucgccaaccggaagaucgccgagcuguucagcacgaagauccacaucggg

SEQ ID NO: 12182 - RNA, 3495 nt, Artificial Sequence
  derived and/or modified CDS sequence (opt1) from CCHVF(CCHVF Oman_812956)__KY362518.1__Gn-NSm-Gc
agcgaggaguccggcgaggacugcaucagccgcacccagcugcuccggaccgagacggccgagauccacggggacaacuacggcgggcccggcgacaagaucaccaucugcaacggguccaccaucguggaccagcgccugggcagcgagcugggcugcuacaccaucaaccgggucaaguccuucaagcucugcgagaacagcgccacggggaaguccugcgagaucgacaacaccccggugaagugcaagcagggcuucugccugaagaucacccaggaggggcgcggccacgugaagcugagccgggacuccgaggucgugcucgacgcgugcgacagcuccugcgagaucaugauccccaaggggaccggcgacauccugguggacugcagcggcgggcagcagcacuuccugaaggacaaccucaucgaccugggcugccccaacaucccccugcucgggaagauggccaucuacaucugccgcauguccaaccacccgaagacgaccauggccuuccuguucugguucagcuucggcuacgucaucacgugcauccugugcaaggugaucuucuaccuccugaucguggucggcacccuggggaagaaguucaagcaguaccgggagcucaagccccagaccugcaccaucugcgagaccacccccgugaacgccaucgacgccgagaugcacgaccugaacugcuccuacaacaucugccccuacugcgcgagccgccugacguccgacggccucgcccggcacgugaugcagugcccgaagcgcaaggagaagaucgaggagaccgagcuguaccugaaccucgagcggauccccugggucgugcgcaagcugcuccaggugagcgaguccaccggggucgcccucaagcggagcagcuggcugaucgugcugcucgugcugcugaccgucucccucagccccgugcaguccgcccccaucggccacgggaagacgaucgagaccuaccagacccgcgagggcuacaccagcaucugccuguucgugcugggcuccauccucuucaucgucagccaccugaugaaggggcugguggacuccgugggcaacagcuucuucccggggcucuccaucugcaagacgugcagcaucggcuccaucaacggguucgagaucgagagccacaagugcuacugcucccuguucugcugccccuacugccggcacugcagcgcggacaaggagauccacaagcugcaccucuccaucugcaagaagcgcaaggccggcagcaacgucaugcuggccgugugcaagcggaugugcuuccgcgccaccauggaggucuccaacaaggcccugcucauccggagcgugaucaacaccaccuucguggucugcauccugauccuggcggugugcguggucuccacgagcgccguggagauggagagccuccccgccggcaccugggagcgcgaggaggaccugaccaacuucugccaccaggagugccaggugaccgagacggagugccugugccccuacgaggcccugguccuccggaagccgcuguucuucgacuccaucgccaaggggaugaagaaccugcucaacagcaccucccuggagaccagccuguccaucgaggcgcccuggggcgccaucaacgugcagagcaccuucaagcccacgguguccaccgccaacaucgcccucagcugguccagcgucgagcaccgcgggaacaagauccugguguccggccgcagcgaguccaucaugaagcuggaggagcggaccgggaucagcugggaccucggcguggaggacgccuccgagagcaagcugcugaccgucuccgugauggaccucagccagauguacagccccguguucgaguaccuguccggcgaccgccaggucgaggaguggccgaaggcgaccugcacgggggacugccccgagcggugcggcugcaccagcuccacgugccugcacaaggaguggccccacagccgcaacuggcggugcaaccccaccuggugcuggggcguggggaccggcugcacgugcugcgggcucgacgugaaggaccuguucaccgacuacauguucgucaaguggaagguggaguacaucaagaccgaggccaucgugugcgucgagcugaccucccaggagcgccagugcagccucaucgaggccggcacccgguucaaccuggggccggugaccaucacccuguccgagccccgcaacauccagcagaagcucccgcccgagaucgugacgcugcacccccggaucgaggagggcuucuucgaccugaugcacguccagaaggugcucagcgccuccaccgugugcaagcugcagagcugcacccacgggguccccggcgaccuccagguguaccacaucggcaaccugcugaagggggacaaggugaacggccaccugauccacaaggucgagccccacuucaacaccuccuggaugagcugggacgggugcgaccucgacuacuacugcaacaugggcgacuggccguccugcacguacaccggggugacccagcacaaccacgccgcguucgugaaccugcugaacaucgagaccgacuacacgaagaacuuccacuuccacagcaagcgcgucaccgcccacggcgacacgccccagcucgaccugaaggcccggcccaacuacggcgccggggagaucaccgugcugguggaggucgcggacauggagcuccacaccaagaagaucgagaucuccggccugaaguucgccagccugaccugcaccgggugcuacgccugcuccagcggcaucuccugcaaggugcgcauccacguggacgagcccgacgagcucaccguccacgucaagagcgaggacccggacaucguggccgccagcuccagccugauggcgcggaagcuggaguucgggacggacuccaccuucaaggccuucagcgccaugcccaagaccucccucugcuucuacaucguggagcgcgaguacugcaagagcugcuccaaggaggacacccagaagugcgugaacgccaagcuggagcggccccagagcauccugaucgagcacaagggcacgaucaucggcaagcagaacgacacgugcaccgccaaggcguccugcuggcucgagagcgugaaguccuucuucuacgggcugaagaacaugcugagcggcaucuucgggaacgucuucaucggcaucuuccucuuccuggcccccuucauccugcucauccuguucuucauguucggguggcgcauccuguucugcuucaagugcugccggcgcacccggggccucuucaaguaccgccaccugaaggacgacgaggagaccggcuaccgcaagaucaucgagcggcugaacaacaagaaggggaagaacaagcuccuggacggcgagcgccuggccgaccggaagaucgccgagcuguucuccaccaagacccacaucggg

SEQ ID NO: 12183 - RNA, 3495 nt, Artificial Sequence
  derived and/or modified CDS sequence (opt1) from CCHVF(CCHVF UCCR4405)__KY484029.1__Gn-NSm-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgugaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaagugcuccuacaacaucugcccguacugcgccagccggcugacguccgacggccuggcccgccacgucacccagugccccaagcggaaggagaagguggaggagaccgagcucuaccugaaccuggagcgcauccccuggaucgugcggaagcuccugcaggucagcgaguccaccgggguggcgcugaagcgcagcagcuggcucaucgugcugcugguccuccugacggugucccugagccccgugcaguccgccccggucggccacgggaagaccaucgagaccuaccagacccgggagggcuucacgagcaucugccucuucaugcugggcuccauccuguucaucgugagcugccucgugaaggggcuggucgacuccgugagcgacuccuucuuccccggccugagcgugugcaagaccugcuccaucgggagcaucaacggcuucgagaucgagucccacaagugcuacugcagccucuucugcugccccuacugccgccacuacuccgccgaccgggagauccaccagcugcaccugagcaucugcaagaagcgcaagaccggguccaacgucaugcucgccgugugcaagcggaugugcuucaaggccaccaucgaggcgagccgccgggcccugcugauccgcuccaucaucaacacgaccuucgucaucugcauccucauccuggccaucugcguggugagcaccagcgccgucgagauggagaaccugcccgccggcaccugggagcgcgaggaggaccucacgaacuucugccaccaggagugccaggugaccgagaccgagugccugugcccguacgaggcgcuggugcugcggaagccccucuuccuggacuccaccgucaagggcaugaagaaccugcucaacagcacgucccuggagaccagccuguccaucgaggcccccuggggcgccaucaacgugcagagcaccuucaagcccaccguguccaccgccaacaucgcccucagcugguccagcgucgagcaccgcgggaacaagauccuggugacggggcgguccgagagcaucaugaagcuggaggagcgcaccggcguguccugggaccucggggucgaggacgcgagcgaguccaagcugcugaccgugagcaucauggaccucucccagauguacagcccgguguucgaguaccugagcggcgaccggcaggucgaggaguggcccaaggcgaccugcacgggcgacugccccgagcgcugcgggugcaccuccagcacgugccugcacaaggaguggccccacucccggaacuggcgcugcaacccgaccuggugcuggggcguggggaccggcugcacgugcugcggcguggacgucaaggaccucuucaccgaccacauguucgugaaguggaagguggaguacaucaagaccgaggccaucgucugcguggagcugaccagccaggagcggcagugcucccugaucgaggccgggacccgcuucaaccucggccccgugaccaucacccugagcgagccccggaacauccagcagaagcugcccccggagaucaucacgcuccaccccaagaucgaggagggguucuucgaccugaugcacguccagaaggugcuguccgccagcaccgugugcaagcuccaguccugcacccacggcauccccggggaccugcagaucuaccacaucggcaaccugcucaagggcgaccgcgucaacgggcaccugauccacaagaucgagccgcacuucaacaccagcuggauguccugggacggcugcgaccuggacuacuacugcaacauggggaacuggcccagcugcacguacaccggcgugacccagcacaaccacgccgccuucgugaaccuccugaacaucgagaccgacuacacgaagaccuuccacuuccacuccaagcgggucaccgcccacggggacacgccccagcuggaccucaaggcccgccccaccuacggcgcgggcgagaucaccgugcugguggaggucgccgacauggagcugcacaccaagaagguggagaucagcgggcucaaguucgccucccuggugugcaccggcugcuacgccugcagcuccgggaucagcugcaagguccggauccacguggacgagccggacgagcugacggugcacgucaaguccagcgaccccgacgugguggccgcgagcaccucccucauggcccgcaagcuggaguucggcaccgacagcaucuucaaggccuucuccgccaugcccaagaccagccugugcuucuacaucgucgagcgggaguacugcaaguccugcagcgaggacgacacgaagaagugcguggacaccaagcucgagcagccccaguccauccugaucgagcacaaggggaccaucaucggcaagcagaacgacacgugcaccgccaaggcgagcugcuggcuggaguccgucaagagcuucuucuacggccucaagaacaugcugggguccguguucggcaacuucuucguggggauccuccucuuccuggccccguucgugcugcucguccuguucuucauguucggcuggaagauccuguucugcuucaagugcugccgccggacccgcggccucuucaaguaccgccaccugaaggacgacgaggagaccggguaccggcgcaucaucgagcggcugaacagcaagaagggcaagaaccgccuccuggacggggagcggcuggccgaccgcaagaucgccgagcuguucuccaccaagacccacaucggc

SEQ ID NO: 12184 - RNA, 3495 nt, Artificial Sequence
  derived and/or modified CDS sequence (opt1) from CCHVF(CCHVF UCCR4459)__KY484032.1__Gn-NSm-Gc
agcgaggaguccggcgacgacugcaucagccgcacccagcugucccggaccgagacggccgagauccacagcgacaacuacgggggccccggggacaagaucaccaucugcaacggcuccaccaucguggaccagcgccucgggagcgagcugggcugcuacaccaucaaccgggucaaguccuucaagcugugcgagaacagcgccacgggcaaguccugcgagaucgacagcaccccgaucaagugccgccagggguucugccucaagaucacccaggagggccgggggcacgugaagcugucccgcggcagcgaggugguccuggacgcgugcgacuccagcugcgagaucaugauccccaaggggaccggcgacauccucguggacugcuccggcgggcagcagcacuuccugaaggacaaccugaucgaccucggcugccccaacaucccccugcuggggaagauggccaucuacaucugccggaugagcaaccacccgaagacgaccauggccuuccucuucugguucuccuucggcuacgugaucacgugcauccugugcaaggucaucuucuaccugcucaucguggugggcacccuggggaagaaguucaagcaguaccgcgagcugaagccccagaccugcaccaucugcgagaccacccccgucaacgccaucgacgccgagaugcacgaccucaacugcagcuacaacaucugccccuacugcgcgucccggcugacgagcgacggccuggcccgccacgugaugcagugcccgaagcggaaggagaagguggaggagaccgagcucuaccugaaccuggagcgcauccccugggucgugcggaagcuccuccaggugagcgaguccaccggggucgcccugaagcgcagcuccuggcucguggugcugcugguccuccugaccgugagccugucccccgugcagagcgcccccaucggccacgggaagacggucgagaccuaccagacccgggagggcuacaccuccaucugccucuucgugcugggcagcauccuguucaucguguccugccucaugaaggggcuggucgacagcgugggcaacuccuucuucccggggcugagcaucugcaagacgugcuccaucggcagcaucaacggguucgagaucgagucccacaagugcuacugcagccucuucugcugccccuacugccgccacugcuccgcggaccgggagauccacaagcugcaccugagcaucugcaagaagcgcaagaccggcuccaacgucaugcucgccgugugcaagcggaugugcuuccgcgccaccguggaggucagcaacaaggcccugcugauccggaacaucaucaacaccacguucguggugugcauccucauccuggccgucugcguggugagcaccuccgcggucgagauggagagccugcccgccggcaccugggagcgcgaggaggaccucaccaacuucugccaccaggagugccaggugacggagaccgagugccugugccccuacgaggcccuggugcugcgcaagccccucuucuccgacagcaucgucaaggggaugaagaaccugcugaacuccaccagccucgagaccucccugagcaucgaggcccccuggggcgccaucaacgugcaguccacguucaagcccaccgugagcgcggccaacaucgcccuguccuggagcuccgucgagcaccgggggaacaagauccucgugagcggccgcuccgagagcaucaugaagcuggaggagcggaccgggaucuccugggaccugggcguggaggacgccagcgagagcaagcuccugaccgucuccaucauggaccugagccagauguacucccccguguucgaguaccucagcggcgaccgccagguggaggaguggccgaaggcgaccugcacgggggacugccccgagcggugcggcugcaccuccagcacgugccugcacaaggaguggccccacucccgcaacuggcggugcaaccccaccuggugcuggggcgucgggaccggcugcacgugcugcgggcuggacgugaaggaccucuucaccgacuacauguucgugaaguggaaggucgaguacaucaagaccgaggccaucgugugcguggagcugaccagccaggagcgccagugcucccugaucgaggccggcacccgguucaaccucgggccggucaccaucacccugagcgagccccgcaacauccagcagaagcugccgcccgagaucgugacgcuccacccgcggaucgaggagggcuucuucgaccugaugcacgugaagaagguccuguccgccagcaccgugugcaagcuccaguccugcacccacggggugcccggcgaccugcaggucuaccacaucggcaaccugcucaagggggacaaggugaacggccaccugauccacaagaucgagccccacuucaacaccagcuggauguccugggacgggugcgaccuggacuacuacugcaacaugggcgacuggccgagcugcuccuacacgggggugacccagcacaaccacgccgccuucgucaacaugcucaacaucgagaccgacuacaccaagaucuuccacuuccacagcaagcgcgugacggcgcacggcgacacgccccagcuggaccugaaggcccggcccaccuacggcgccggggagaucaccgugcucgucgagguggccgacauggagcugcacaccaagaagaucgagaucuccggccugaaguucgcgagccugaccugcaccgggugcuacgccugcagcuccggcaucagcugcaaggugcgcauccacgucgacgagcccgacgagcugaccgugcacgugaaguccgaggacccggacaucgucgccgccagcuccagccugauggcccggaagcucgaguucgggacggacuccaccuucaaggcguucagcgccaugcccaagaccucccugugcuucuacaucguggagcgcgaguacugcaagagcugcuccaaggaggacacccagaagugcgugaacacgaagcuggagcagccccagagcauccucaucgagcacaagggcaccaucaucggcaagcagaacgacacgugcaccuccaaggccgggugcuggcuggagagcgucaaguccuucuucuacggccugaagaacaugcucagcgggaucuucggcaacguguucaucgggaucuuccuguuccuggcccccuucauccuccugauccuguucuucauguucggcuggcggauccucuucugcuucaagugcugccgccggacccgcggccuguucaaguaccgccaccugaaggacgacgaggagaccggguaccggaagaucaucgagcgccucaacaacaagaagggcaagaacaagcugcuggacggggagcggcucgccgaccgcaagaucgcggagcuguucuccaccaagacccacaucggc

SEQ ID NO: 12185 - RNA, 3495 nt, Artificial Sequence
  derived and/or modified CDS sequence (opt1) from CCHVF(CCHVF UCCR4401)__KY484035.1__Gn-NSm-Gc
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccggguccgcuccuucaagcucugcgagaacagcgccacgggcaagaacugcgagaucgacuccgugcccgugaagugccggcagggguacugccugcgcaucacccaggagggccgggggcacgucaagcugagccgcggcuccgagguggugcucgacgcgugcgacaccagcugcgagaucaugauccccaaggggaccggcgacauccuggucgacugcuccggcgggcagcagcacuuccugaaggacaaccucaucgaccugggcugccccaagaucccgcugcucgggaagauggccaucuacaucugccggaugagcaaccaccccaagacgaccauggccuuccuguucugguucuccuucggcuacgugaucacgugcauccugugcaaggccaucuucuaccuccugaucaucgugggcacccuggggaagcgccucaagcaguaccgggagcugaagccccagaccugcaccaucugcgagaccacccccgucaacgccaucgacgcggagaugcacgaccugaacugcagcuacaacaucugcccguacugcgccucccgccucacgagcgacggccuggcccggcacgugauccagugccccaagcgcaaggagaagguggaggagaccgagcuguaccucaaccuggagcggauccccugggucgugcgcaagcugcuccagguguccgagagcaccggggucgcccugaagcgguccagcuggcugaucgugcuccuggugcuguucaccgucagccucucccccgugcagagcgcgccgaucggccaggggaagacgaucgaggccuaccgcgcccgggagggcuacaccuccaucugccuguucgugcugggcagcauccucuucaucgucuccugccugaugaaggggcugguggacagcgugggcaacuccuucuuccccgggcucagcaucugcaagaccugcuccaucagcuccaucaacggcuucgagaucgagagccacaagugcuacugcucccuguucugcugccccuacugccgccacugcagcaccgacaaggagauccacaagcugcaccucuccaucugcaagaagcggaagacggggagcaacgucaugcuggccgugugcaagcugaugugcuuccgcgccaccauggaggucuccaaccgcgcgcuguucauccggagcaucaucaacaccaccuucgugcugugcauccugauccucgccgugugcgucguguccacgagcgccguggagauggagaaccugcccgccggcaccugggagcgcgaggaggaccugaccaacuucugccaccaggagugccaggucaccgagacggagugccugugcccguacgaggcccucgugcugcggaagccccuguuccucgacagcaccgcgaagggcaugaagaaccugcugaacuccaccagccucgagaccucccugagcaucgaggcccccuggggcgccaucaacgugcaguccacguacaagcccaccgucagcaccgccaacaucgcccuguccuggagcuccguggagcaccgcgggaacaagauccucgugagcgggcgguccgagagcaucaugaagcuggaggagcgcaccggcaucuccugggaccugggggucgaggacgcgagcgaguccaagcuccugaccgugagcgugauggaccugucccagauguacagcccggucuucgaguaccucagcggcgaccgccagguggaggaguggcccaaggccacgugcaccggcgacugccccgagcggugcgggugcaccuccagcacgugccugcacaaggaguggccccacucccggaacuggcgcugcaacccgaccuggugcuggggcguggggaccggcugcacgugcugcggccuggacgucaaggaccucuucaccgacuacauguucgugaaguggaagguggaguacaucaagaccgaggccaucgucugcguggagcugaccagccaggagcggcagugcucccugaucgaggccgggacccgcuucaaccucggccccgugaccaucacgcugagcgagccccggaacauccagcagaagcugcccccggagaucaucacccuccacccccgcaucgaggagggguucuucgaccugaugcacguccagaaggugcuguccgccagcaccgugugcaagcuccaguccugcacccacggcguccccggggaccuccagguguaccacaucggcaaccugcucaagggcgacaaggugaacgggcaccugauccacaagaucgagccgcacuucaacacgagcuggauguccugggacggcugcgaccuggacuacuacugcaacaugggggacuggcccagcugcaccuacaccggcgucacccagcacaaccacgcguccuucgugaaccuccugaacaucgagacggacuacaccaagaacuuccacuuccacagcaagcgggugaccgcccacggggacacgccccagcuggaccucaaggcccgccccaccuacggcgccggcgagaucaccguccugguggagguggcggacauggagcugcacaccaagaagaucgagaucuccgggcucaaguucgccagccuggccugcaccggcugcuacgccugcuccagcgggaucuccugcaagguccggauccacguggacgagccggacgagcugacggugcacgucaagagcgacgaccccgacgugguggccgcgagcuccagccucauggcccgcaagcuggaguucggcaccgacuccaccuucaaggccuucagcgccaugcccaagaccucccugugcuucuacaucgucgagcgggagcacugcaagagcugcuccgaggaggacacgaagaagugcgugaacaccaagcucgagcagccccagagcauccugaucgagcacaaggggaccaucaucggcaagcagaacuccacgugcaccgccaaggcgagcugcuggcuggaguccgucaagagcuucuucuacggccucaagaacaugcuguccgggaucuucggcaacguguucauggggaucuuccuguuccucgccccguucauccugcugauccucuucuucauguucggcuggcgcauccuguucugcuucaagugcugccgccggacccgcgggcuguucaaguaccggcaccucaaggacgacgaggagaccggcuaccgccggaucaucgagaagcugaacaacaagaagggcaagaacaagcugcucgacggggagcgccuggccgaccggcgcaucgccgagcuguucagcaccaagacccacaucggc

SEQ ID NO: 12186 - RNA, 3495 nt, Artificial Sequence
  derived and/or modified CDS sequence (opt1) from CCHVF(CCHVF UCCR4448)__KY484042.1__Gn-NSm-Gc
agcgaggagaccuccgacgacugcaucagccgcacccagcugcuccggacggagaccgccgagauccacggcgacaacuacgggggccccggggacaagaucaccaucugcaacggcuccaccaucguggaccagcgccuggggagcgagcugggcugcuacacgaucaaccgggugaaguccuucaagcucugcgagaacagcgccaccggcaaguccugcgagaucgacagcgugccggugaagugccgccagggguacugccugcggaucacccaggagggccgcgggcacgucaagcugucccggggcagcgagguggugcucgacgcgugcgacaccuccugcgagaucaugauccccaaggggacgggcgacauccuggucgacugcagcggcgggcagcagcacuuccugaaggacaaccucaucgaccugggcugccccaagaucccccugcucgggaagauggccaucuacaucugccgcauguccaaccacccgaagaccaccauggccuuccuguucugguucagcuucggcuacgugaucacgugcauccugugcaaggccaucuucuaccuccugaucaucaucggcacccuggggaagcgguucaagcaguaccgcgagcucaagccccagaccugcaccaucugcgagaccacgcccgugaacgccaucgacgcggagaugcacgaccugaacugcuccuacaacaucugccccuacugcgccagccggcugaccuccgacggccucgcccgccacgucacccagugcccgaagcggaaggagaagguggaggagaccgagcuguaccugaaccucgagcgcauccccugggugguccggaagcugcuccaggugagcgaguccacggggguggcccucaagcgcagcagcuggcugaucguccugcucgugcuguucaccaucucccugagccccgugcaguccgcgcccaucagccacggcaagaccaucgaggccuaccgggcccgcgagggguacaccuccaucugccucuucguccugggcagcauccuguucaucguguccuaccucaugaagggccugguggacagcgucgggaacuccuucuucccgggccugagcaucugcaagacgugcuccaccagcuccaucaacggguucgagaucgagagccacaagugcuacugcucccucuucugcugccccuacugccggcacugcagcgccgacaaggagauccacaagcugcaccuguccaucugcaagaagcgcaagaccggcagcaacgugaugcucgccgugugcaagcggaugugcuuccgcgcgaccauggaggucuccaaccgcgcccuguucauccggagcaucaucaacacgaccuucgugcugugcauccucauccuggccgucugcguggugagcaccuccgccgucgagauggagaaccugcccgccgggaccugggagcgcgaggaggaccucacgaacuucugccaccaggagugccaggugaccgagaccgagugccugugccccuacgaggcgcuggugcugcggaagccccucuuccuggacagcaucgucaagggcaugaagaaccugcucaacuccaccagccuggagacgucccugagcaucgaggcccccuggggcgccaucaacgugcaguccaccuacaagcccaccgugagcaccgccaacaucgcccucuccuggagcuccgucgagcaccgcgggaacaagauccuggugagcggccgguccgagagcaucaugaagcuggaggagaagaccgggaucuccugggaccucggcguggaggacgcgagcgaguccaagcugcugacggucagcgugauggaccucagccagauguacucccccguguucgaguaccugagcggggaccgccaggucgaggaguggccgaaggcgaccugcaccggcgacugccccgagcggugcggcugcaccuccagcacgugccugcacaaggaguggccccacucccgcaacuggcggugcaaccccaccuggugcuggggcguggggaccgggugcacgugcugcggccucgacgugaaggaccuguucaccgacuacauguucgucaaguggaagguggaguacaucaagaccgaggccaucgugugcgucgagcugaccagccaggagcgccagugcucccucaucgaggccggcacccgguucaaccuggggccggugacgaucacccugagcgagccccgcaacauccagcagaagcucccgcccgagaucaucacccugcacccgcggaucgaggagggcuucuucgaccugaugcacgugcagaagguccucuccgccagcaccgugugcaagcugcaguccugcacgcacggggugcccggcgaccugcaggucuaccacaucgggaaccuccugaagggcgacaaggugaacggccaccugauccacaagaucgagccccacuucaacaccagcuggauguccugggacgggugcgaccucgacuacuacugcaacaugggcgacuggccgagcugcaccuacaccggggugacgcagcacaaccacgccuccuucgucaaccugcugaacaucgagaccgacuacaccaagaacuuccacuuccacagcaagcgcgugaccgcccacggcgacacgccccagcucgaccugaaggcccggcccaccuacggggccggcgagaucaccgugcuggucgagguggcggacauggagcuccacaccaagaagaucgagaucuccggccugaaguucgccagccugacgugcaccgggugcuacgccugcuccagcggcaucagcugcaaggugcgcauccacgucgacgagcccgacgagcucaccgugcacgugaaguccgacgacccggacgucguggccgccagcuccagccugauggcgcggaagcuggaguucgggaccgacuccacguucaaggccuucagcgccaugcccaagaccucccucugcuucuacaucguggagcgcgagcacugcaagagcugcuccgaggaggacaccaagaagugcgucaacaccaagcuggagcagccccagagcauccugaucgagcacaagggcacgaucaucgggaagcagaacuccacgugcaccgccaaggccagcugcuggcucgaguccgucaagagcuucuucuacggccugaagaacaugcuguccggcaucuucgggaacguguucaucggcaucuuccucuuccuggcgcccuucauccugcucauccuguucuucauguucggguggaagauccuguucugcuucaagugcugccggcgcacccgcggccucuucaaguaccggcaccugaaggacgacgaggagaccggguaccgccggaucaucgagcgccugaacaacaagaagggcaagaacaagcuccuggacggcgagauccuggccgaccggcgcaucgccgagcuguucagcaccaagacccacaucggg

SEQ ID NO: 12187 - RNA, 3495 nt, Artificial Sequence; identical to SEQ ID NO: 12103
  derived and/or modified CDS sequence (opt1) from CCHVF(CCHVF SPU4/81 )__DQ157175.1__Gn-NSm-Gc

SEQ ID NO: 12188 - RNA, 3495 nt, Artificial Sequence; identical to SEQ ID NO: 12124
  derived and/or modified CDS sequence (opt1) from CCHVF(CCHVF Sudan Al-Fulah 9-2008)__HQ378185.1__Gn-NSm-Gc

SEQ ID NO: 12189 - RNA, 3495 nt, Artificial Sequence; identical to SEQ ID NO: 12118
  derived and/or modified CDS sequence (opt1) from CCHVF(CCHVF NIV161064)__KY213713.1__Gn-NSm-Gc

SEQ ID NO: 12190 - RNA, 3495 nt, Artificial Sequence; identical to SEQ ID NO: 12140
  derived and/or modified CDS sequence (opt1) from CCHVF(CCHVF 5180-R-2011)__KR814874.1__Gn-NSm-Gc

SEQ ID NO: 12191 - RNA, 3495 nt, Artificial Sequence; identical to SEQ ID NO: 12148
  derived and/or modified CDS sequence (opt1) from CCHVF(CCHVF 4574-ST-2008)__KR814870.1__Gn-NSm-Gc

SEQ ID NO: 12192 - RNA, 3495 nt, Artificial Sequence; identical to SEQ ID NO: 12100
  derived and/or modified CDS sequence (opt1) from CCHVF(CCHVF 3010)__DQ019222.1__Gn-NSm-Gc

SEQ ID NO: 12193 - RNA, 3495 nt, Artificial Sequence; identical to SEQ ID NO: 12100
  derived and/or modified CDS sequence (opt1) from CCHVF(CCHVF UG3010)__DQ211637.1__Gn-NSm-Gc

SEQ ID NO: 12194 - RNA, 2916 nt, Artificial Sequence
  derived and/or modified CDS sequence (opt1) from CCHFV(10200, Artificial)__U39455.2__Gn-4aa-Gc
agcgaggagcccuccgacgacugcgugagccgcacccagcuccuccggaccgagacggccgagauccacggcgacaacuacgggggcccgggggacaagaucaccaucugcaacggcuccaccaucguggaccagcgccuggggagcgagcugggcugcuacaccaucaaccgggugcgcuccuucaagcucugcgagaacagcgccacgggcaagaacugcgagaucgacuccgugcccgucaagugccggcagggguacugccugcgcaucacccaggagggccgggggcacgugaagcugagccgcggcuccgaggugguccucgacgcgugcgacaccagcugcgagaucaugauccccaaggggaccggcgacauccugguggacugcuccggcgggcagcagcacuuccugaaggacaaccucaucgaccugggcugccccaagaucccgcugcucgggaagauggccaucuacaucugccggaugagcaaccaccccaagacgaccauggccuuccuguucugguucuccuucggcuacgugaucacgugcauccugugcaaggccaucuucuaccuccugaucaucgucggcacccuggggcgccggcucaagcaguaccgcgagcugaagccccagaccugcaccaucugcgagaccacccccgugaacgccaucgacgcggagaugcacgaccugaacugcagcuacaacaucugcccguacugcgccucccggcucacgagcgacggccuggcccgccacgugauccagugccccaagcggaaggagaaggucgaggagaccgagcuguaccucaaccuggagcgcauccccuggguggugcggaagcugcuccaggucuccgagagcaccgggguggcccugaagcgcuccagcuggcugaucgugcuccugguccuguucaccgugagccucucccccgugcagagcgcgccgaucggccggaagccccuguuccuggacuccacggccaaggggaugaagaaccuccugaacagcaccucccuggagaccagccucuccaucgaggcccccuggggcgccaucaacguccagagcaccuacaagcccacgguguccaccgccaacaucgcgcugagcugguccagcguggagcaccgcggcaacaagauccuggucuccgggcggagcgaguccaucaugaagcucgaggagcgcaccggcaucagcugggaccuggggguggaggacgccuccgagagcaagcugcucaccgucuccgugauggaccugagccagauguacagcccgguguucgaguaccuguccggcgaccgccaggucgaggaguggcccaaggccacgugcaccggggacugccccgagcggugcggcugcaccagcuccacgugccuccacaaggaguggccccacagccgcaacuggcggugcaacccgaccuggugcuggggcguggggaccggcugcacgugcugcgggcuggacgugaaggaccuguucaccgacuacauguucgucaaguggaagguggaguacaucaagaccgaggccaucgugugcgucgagcugaccucccaggagcgccagugcagccucaucgaggccggcacccgguucaaccuggggcccgugaccaucacccuguccgagccccgcaacauccagcagaagcugcccccggagaucaucacgcuccacccccggaucgaggagggcuucuucgaccugaugcacgugcagaagguccucagcgcguccaccgugugcaagcugcagagcugcacccacggcgugcccggggaccugcaggucuaccacaucggcaaccuccugaagggggacaaggugaacggccaccugauccacaagaucgagccccacuucaacaccuccuggaugagcugggacggcugcgaccucgacuacuacugcaacaugggggacuggccguccugcacguacaccggcgugacccagcacaaccacgccagcuucgucaaccugcugaacaucgagaccgacuacacgaagaacuuccacuuccacuccaagcgcgugaccgcccacggggacacgccccagcucgaccugaaggcccggcccaccuacggcgccggggagaucaccgugcuggucgagguggcggacauggagcuccacaccaagaagaucgagaucagcggccugaaguucgccucccuggccugcaccggcugcuacgccugcagcagcuccaucagcugcaaggugcgcauccacgucgacgagccggacgagcucaccgugcacgugaaguccgacgaccccgacgucguggccgcgagcuccagccugauggcccggaagcuggaguucgggacggacuccaccuucaaggccuucagcgccaugcccaagaccucccucugcuucuacaucguggagcgcgagcacugcaagagcugcuccgaggaggacaccaagaagugcgucaacacgaagcuggagcagccccagagcauccugaucgagcacaagggcaccaucaucgggaagcagaacuccacgugcaccgcgaaggccagcugcuggcucgaguccgucaagagcuucuucuacggccugaagaacaugcuguccgggaucuucggcaacguguucaugggcaucuuccucuuccuggccccguucauccugcucauccuguucuucauguucggguggcggauccuguucugcuucaagugcugccgccggacccgcggccucuucaaguaccggcaccugaaggacgacgaggagaccggguaccgccggaucaucgagaagcugaacaacaagaagggcaagaacaagcuccuggacggggagcgccuggccgacggccgcaucgccgagcuguucagcaccaagacccacaucggc

SEQ ID NO: 12195 - RNA, 2916 nt, Artificial Sequence
  derived and/or modified CDS sequence (opt1) from CCHFV(IbAr10200, Artificial)__AF467768.2__Gn-4aa-Gc
agcgaggagcccuccgacgacugcaucagccgcacccagcuccuccggaccgagacggccgagauccacggcgacaacuacgggggcccgggggacaagaucaccaucugcaacggcuccaccaucguggaccagcgccuggggagcgagcugggcugcuacaccaucaaccggguccgcuccuucaagcucugcgagaacagcgccacgggcaagaacugcgagaucgacuccgugcccgugaagugccggcagggguacugccugcgcaucacccaggagggccgggggcacgucaagcugagccgcggcuccgagguggugcucgacgcgugcgacaccagcugcgagaucaugauccccaaggggaccggcgacauccuggucgacugcuccggcgggcagcagcacuuccugaaggacaaccucaucgaccugggcugccccaagaucccgcugcucgggaagauggccaucuacaucugccggaugagcaaccaccccaagacgaccauggccuuccuguucugguucuccuucggcuacgugaucacgugcauccugugcaaggccaucuucuaccuccugaucaucgugggcacccuggggaagcgccucaagcaguaccgggagcugaagccccagaccugcaccaucugcgagaccacccccgucaacgccaucgacgcggagaugcacgaccugaacugcagcuacaacaucugcccguacugcgccucccgccucacgagcgacggccuggcccggcacgugauccagugccccaagcgcaaggagaagguggaggagaccgagcuguaccucaaccuggagcggauccccugggucgugcgcaagcugcuccagguguccgagagcaccggggucgcccugaagcgguccagcuggcugaucgugcuccuggugcuguucaccgucagccucucccccgugcagagcgcgccgaucggccgcaagccccuguuccuggacuccacggccaaggggaugaagaaccuccugaacagcaccucccuggagaccagccucuccaucgaggcccccuggggcgccaucaacgugcagagcaccuacaagcccacggucuccaccgccaacaucgcgcugagcugguccagcguggagcaccggggcaacaagauccugguguccgggcgcagcgaguccaucaugaagcucgaggagcggaccggcaucagcugggaccugggggucgaggacgccuccgagagcaagcugcucaccguguccgucauggaccugagccagauguacagcccgguguucgaguaccuguccggcgaccgccaggugggggaguggcccaaggccacgugcaccggcgacugccccgagcgcugcggcugcaccagcuccacgugccuccacaaggaguggccccacagccggaacuggcgcugcaacccgaccuggugcuggggcgucgggaccgggugcacgugcugcggccuggacgugaaggaccuguucaccgacuacauguucgugaaguggaaggucgaguacaucaagaccgaggccaucgugugcguggagcugaccucccaggagcggcagugcagccucaucgaggccgggacccgcuucaaccugggccccgucaccaucacccuguccgagccccggaacauccagcagaagcugcccccggagaucaucacgcugcacccccgcaucgaggagggcuucuucgaccugaugcacgugcagaaggugcucagcgcguccaccgucugcaagcugcagagcugcacccacggggugcccggcgaccuccagguguaccacaucgggaaccuccugaagggcgacaaggucaacggccaccugauccacaagaucgagccccacuucaacaccuccuggaugagcugggacgggugcgaccucgacuacuacugcaacaugggcgacuggccguccugcacguacaccggggugacccagcacaaccacgccagcuucgugaaccugcugaacaucgagaccgacuacacgaagaacuuccacuuccacuccaagcgggucaccgcccacggcgacacgccccagcucgaccugaaggcccgccccaccuacggggccggcgagaucaccgugcugguggaggucgcggacauggagcuccacaccaagaagaucgagaucagcggccugaaguucgccucccuggccugcaccgggugcuacgccugcagcagcggcaucuccugcaaggugcggauccacguggacgagccggacgagcucaccguccacgucaagagcgacgaccccgacgugguggccgcguccagcucccugauggcccgcaagcuggaguucgggacggacagcaccuucaaggccuucuccgccaugcccaagaccagccucugcuucuacaucguggagcgggagcacugcaaguccugcagcgaggaggacaccaagaagugcgugaacacgaagcuggagcagccccaguccauccugaucgagcacaagggcaccaucaucgggaagcagaacagcacgugcaccgcgaaggccuccugcuggcucgagagcgucaaguccuucuucuacggccugaagaacaugcugagcggcaucuucgggaacguguucaugggcaucuuccucuuccuggccccguucauccugcucauccuguucuucauguucggguggcgcauccuguucugcuucaagugcugccggcgcacccggggccucuucaaguaccgccaccugaaggacgacgaggagaccggguaccggcgcaucaucgagaagcugaacaacaagaagggcaagaacaagcuccuggacggcgagcggcuggccgaccgccgcaucgccgagcuguucuccaccaagacccacaucggg

SEQ ID NO: 12196 - RNA, 2916 nt, Artificial Sequence
  derived and/or modified CDS sequence (opt1) from CCHFV(Turkey-Kelkit06, Artificial)__GQ337054.1__Gn-4aa-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcaagaacuccgccacgggcaagaccugcgagguggacagcacccccgugaagugccgccagggguucugccugaagaucacccaggagggccgggggcacgucaagcugucccgcggcagcgagguggugcucgacgcgugcgacuccagcugcgaggucaugauccccaaggggacgggcgacauccugguggacugcuccggcgggcagcagcacuuccugaaggacaaccucaucgaccugggcugcccccacaucccgcugcucgggcggauggccaucuacaucugccgcaugagcaaccacccccggaccaccauggccuuccuguucugguucuccuucggcuacgugaucacgugcaucuucugcaaggcccuguucuacagccucaucaucaucggcacccuggggaagaagaucaagcaguaccgcgagcugaagccccagaccugcaccaucugcgagaccgcccccgucaacgcgaucgacgccgagaugcacgaccucaacugcuccuacaacaucugcccguacugcgccagccggcugacguccgacggccuggcccgccacgugacccagugccccaagcggaaggagaagguggaggagaccgagcucuaccugaaccuggagcgcauccccuggaucguccggaagcuccuccaggugagcgaguccaccgggguggcgcugaagcgcagcagcuggcucaucguccugcuggugcuccugacggugucccugagccccguccaguccgccccggugggccggaagccccucuuccuggacagcaucgugaaggggaugaagaaccugcucaacuccaccagccuggagaccucccugagcaucgaggcccccuggggcgccaucaacguccaguccaccuucaagcccacggugagcaccgccaacaucgcgcucuccuggagcuccgugguccaccgcggcaacaagauccuggugaccgggcggagcgaguccaucaugaagcuggaggagcgcaccggcgucagcugggaccucgggguggaggacgccuccgagagcaagcugcugacgguguccaucauggaccucagccagauguacagcccggucuucgaguaccuguccggcgaccgccagguggaggaguggcccaaggcgaccugcaccggggacugccccgagcggugcggcugcaccagcuccacgugccugcacaaggaguggagccacucccgcaacuggcggugcaaccccaccuggugcuggggcguggggaccggcugcacgugcugcggggucgacgugaaggaccucuucaccgaccacauguucgugaaguggaaggucgaguacaucaagaccgaggccaucgugugcguggcccugaccagccaggagcgccagugcucccugaucgaggccggcacccgguucaaccuggggccggucaccaucacgcucagcgagccccgcaacauccagcagaagcugccgcccgagaucaucacccugcaccccaagaucgaggagggcuucuucgaccucaugcacgugcagaaggugcuguccgccagcaccgucugcaagcugcaguccugcacccacggcauccccggggaccuccagguguaccacaucggcaaccugcugaagggggaccgggugaacggccaccucauccacaagaucgagagccacuucaacacguccuggaugagcugggacggcugcgaccuggacuacuacugcaacaugggggacuggcccuccugcaccuacaccggcgucacccagcacaaccacgccgccuucgugaaccugcucaacaucgagacggacuacaccaagaccuuccacuuccacagcaagcgcgugaccgcccacggggacacgccccagcuggaccugaaggcgcggccgaccuacggcgccgggggcaucaccguccucguggagguggccgacauggagcugcacaccaagaaggucgagaucuccggccugaaguucgccagccucgccugcacggggugcuacgcgugcagcuccggcaucagcugcaaggugcgcauccacguggacgagcccgacgagcugaccguccacgugaaguccagcgaccccgacguggucgccgccuccaccagccugauggcccggaagcucgaguucgggaccgacuccacguucaaggcguucagcgccaugccgaagaccucccugugcuucuacaucguggagcgcgaguacugcaagagcugcuccgaggacgacacccagaagugcguggacacccggcuggagcagccccagagcauccucaucgagcacaagggcacgaucaucgggaagcagaacgacacgugcaccgccaaggccuccugcuggcuggagagcgucaaguccuucuucuacggccugaagaacaugcucggcagcguguucgggaaccuguucaucggcauccuccuguuccuggcccccuucgugcugcucguccuguucuucauguucggguggaagauccuguucugcuucaagugcugccgccggacccgcggccucuucaaguaccggcaccugaaggacgacgaggagaccggguaccgccggaucaucgagcgccugaacuccaagaagggcaagaaccggcuccuggacggcgaccgccuggcggaccgcaagaucgccgagcuguucagcaccaagacccacaucggg

SEQ ID NO: 12197 - RNA, 2919 nt, Artificial Sequence
  derived and/or modified CDS sequence (opt1) from CCHFV(SR3, Artificial)__AJ538199.1__Gn-4aa-Gc
agcgaggaguccggcgacgacugcaucagccgcacccagcugcuccggaccgagacggccgaggugcacggggacaacuacggcgggcccggcgacaagaucaccaucugcaacggguccaccgucguggaccagcgccugggcagcgagcugggcugcuacaccaucaaccgggugcgcuccuucaagcucugcgagaacagcgccacggggaaguccugcgagaucgacagcaucccggucaagugcaagcagggcuacugccugaagaucacccaggaggggcggggccacgugaagcugucccgcgggagcgaggugguccucgacgugugcgacuccagcugcgaggugaugauccccaagggcaccggcgacauccuggucgacugcuccgggggccagcagcacuuccugaaggacaaccucguggaccuggggugccccaagaucccccugcucggcaagauggcgaucuacaucugccggaugagcaaccacccgaagaccacgauggccuuccuguucugguucuccuucggcuacgugaucacgugcauccugugcaaggccaucuucuuccuccugaucaucuucgggacccugggcaagcgcuucaagcaguaccgggagcucaagccccagaccugcaccaucugcgagaccacccccgucaacgccaucgacgccgagaugcacgaccugaacugcagcuacaacaucugccccuacugcgcgucccgccugaccagcgacgggcucgcccggcacgugacgcagugcccgcgccggaaggagaagguggaggagaccgagcuguaccugaaccucgagcgcauccccugggucgugcggaagcugcuccagguguccgagagcaccggcaccguccugaagcgcagcuccuggcugaucgugcugcucgugcuguucacggucagccugucccccgugcagagcgcccccaucgggcuccggcgcccgcuguuccuggacuccaucgugaagggcaugaagaaccuccugaacagcaccucccuggagaccagccucuccaucgaggcccccuggggcgcgaucaacguccagagcaccuacaagcccacgguguccaccgccaacaucgcccugagcugguccagcgucgagcaccgggggaacaaggugcugguguccggccgcagcgaguccaucaugaagcucgaggagcggaccgggaucagcugggaccugggcgucgaggacgccuccgagagcaagcugcucaccgugagcgugauggaccugucccagauguacagccccgucuucgaguaccuguccggggaccgccagguggaggaguggccgaaggccacgugcaccggcgacugccccgagcgcugcggcugcaccagcuccacgugccuccacaaggaguggccccacagccggaacuggcgcugcaaccccaccuggugcuggggcguggggaccgggugcacgugcugcggccuggacgucaaggaccuguucaccgacuacauguucgugaaguggaagguggaguacaucaagaccgaggcgaucgucugcguggagcugaccucccaggagcggcagugcagccucaucgaggccgggacccgcuucaaccugggcuccgugaccaucacccugagcgagccgcggaacauccagcagaagcucccgcccgagaucaucacgcugcaccccaagaucgaggagggcuucuucgaccugaugcacguccagaaggugcucuccgccagcaccgugugcaagcugcaguccugcacccacgggguccccggcgaccuccagguguaccacaucgggaaccugcugaagggcgaccgcgugaacggccaccugauccacaagaucgagcagcacuucaacaccagcuggauguccugggacgggugcgaccucgacuacuacugcaacaugggcgacuggcccagcugcacguacaccggggucacccagcacaaccacgccuccuucgugaaccugcugaacaucgagaccgacuacacgaagaccuuccacuuccacagcaagcgggugaccgcccacggcgacacgccccagcucgaccugaaggcgcgccccaccuacggggccggcgagaucaccguccugguggagguggccgacauggagcuccacaccaagaagaucgagaucagcggccugaaguucgccgggcugaccugcacgggcugcuacgccugcuccagcgggaucuccugcaagguccggauccacguggacgagccggacgagcucaccgugcacgucaagagcgacgaccccgacgugguggcggccuccagcucccugauggcccgcaagcuggaguucggcaccgacagcaccuucaaggccuucuccgccaugcccaagacgagccucugcuucuacaucgucgagcgggaguacugcaaguccugcaacaaggaggacacccagaagugcgugaacaccaagcuggagcagccgcagagcauccugaucgagcacaaggggaccaucaucggcaagcagaacaacacgugcaccgcgaaggccuccugcuggcucgagagcgugaaguccuucuucuacggccugaagaacaugcucgggggcaucuucgggaacgucuucaucggcaucuucaccuuccugacccccuucauccugcugauccucuucuucauguucggguggcgcauccuguucugcuucaagugcugccggcgcacgcggggccuguucaaguaccgccaccucaaggacgacgaggagaccggcuaccggaagaucaucgagcgccugaacaacaagaaggggaagaaccggcugcucgacggcgagcgccuggccgaccgcaagaucgccgagcuguucagcaccaagacccacaucggg

SEQ ID NO: 12198 - RNA, 2919 nt, Artificial Sequence
  derived and/or modified CDS sequence (opt1) from CCHFV(UCCR4413, Artificial)__KY484038.1__Gn-4aa-Gc
agcgaguccagcgccuccggcugcaucagccgcacccagaugaucaaguccgagaccgccgagauccacgacgacaucuacgggggccccggggagaagcugacgaucugcaacggcaccaccguggucgaccagcggcucgggagcgagcugggcugcuacaccaucaaccgcaucaagacguacaagcugugcgagaacuccgugaaggagaagaccugcgagaucgacagcgugccggucaagugccggcagggccucugccugaagaucacccaggaggggcgcggccacgugaagcugucccgggggagcgagaucgugcucgacaucugcgacuccagcugcgagcugaugauccccaagggcaccggggacauccuggucgacugcuccggcggccagcagcacuuccuccaggacaaccugguggaccuggggugccccaacaucccccuccugggcaagguggcgaucuacaucugccgcaugagcaaccacccgaagacgaccauggccuuccuguucugguucuccuucggguacgucaucaccugcauccucugcaagauccuguucuaccugcucaucaucaccggcacgcugggcaagaagcugaagcaguaccgggagcucaagccccagaccugcaccaucugcgagagcacccccgugaacgccaucgacgccgagaugcacgaccugaacugcuccuacaacaucugccccuacugcgccagccgccugacguccgacgggcucauccggcacgugaaccugugcccgaagcgcaaggagaaggucgaggagaccgagcuguaccucaaccuggagcggauccccugguucgugcgcaagcugcuccaggugagcgagagcaccggcgucgcgcugaagcgguccagcuggcugcucauccuggugauccugcucaccguguccaugagccccguccaguccgcccccaucaaccgcaagccgcuguuccugagcuccaucgugaaggggaagaagaaccuccugaacagcgccucccuggagacgagccucuccaucgaggcccccuggggcgcgaucaacgcccagagcaccuucaagcccaccaucuccaccgccaacaucgcccugagcugguccagcguggagcaccgggggaacaagguccugguguccggccgcagcgaguccaucaugaagcucgaggagcggacgggcaucagcuggaaccuggggguggaggacgccagcgagucccgcaugcugaccgucagcgugauggaccucucccagauguaccugcccgucuucgaguaccugagcggcgaccggcagguggaggaguggccgaaggcgaccugcaccggggacugccccgagcgcugcggcugcacguccagcaccugccugcacaaggaguggccccacucccggaacuggcgcugcaaccccaccuggugcuggggggugggcaccggcugcacgugcugcgggcucgacgucaaggaccuguucaccgacuacauguucgugaaguggaagguggaguacaucaagaccgaggccaucgucugcguggagcugaccagccaggagcgccagugcucccucaucgaggccggcacgcgguucaaccuggggccggugaccaucacccugagcgagccccgcaacauccagcagaagcuccccuccgagaucgucacccugcaccccaagaucgaggagggcuucuucgaccugaugcacgugcagaaggugcucagcgccuccaccgucugcaagcugcagagcugcacgcacgggguggccggcgaccugcagguguaccacgucggcaaccuccugaagggggacaagaucaacggccacuccauccacaagaucgagccgcaccugaacaccagcuggauguccugggacgggugcgaccucgacuacuacugcaacaugggcgacuggcccagcugcaccuacaccggcgugacgcagcacaaccacgcggccuucgugaaccugcugaacaucgagaccgacuacaccaagagcuuccacuuccacuccaagcgggucaccgcccacggggacacgccccagcucgaccugaaggcccgccccauguacggcgccggggagaucaccgugcugguggaggucgcggacauggagcuccacagcaagaacaucgagaucuccggccugaaguucgccagccugaccugcuccgggugcuacgccugcagcuccggcaucagcugcaaggugcggauccacguggacgagccggacgagcucgccguccacgugaaguccgacgaccuggacguggucgccgcgagcuccagccugauggcccgcaagaucgaguucggcaccgacuccacguucaaggccuucagcuccaugcccaaggagagccucugcuucuacaucguggagcgggacuucugcaaguccugcgccgcggaggacacccagaagugcgugaaggccaagcuggagcagccccagagcauccugaucgagcacaaggggaccaucaucggcaagcagaacgacaccugcuccacgaagaccagcugcuggcucgagagcuucaaguccuucuucuacgggcugaagaacaugcugagcggcgucuucggguccgccaucaugggcauccuccuguuccuggccccguucauccuccugauccuguucuucuucuucggcuggcgcauccucuucugccugcggugcugccgccggacccgcgggcuguucaaguacaagcacaucaaggacgacgaggaggccggcuacaagaagaucaucgagaagcucaacaacaagaaggggggcaccagcaagcugcuggacggggagcggcucgcggaccgcaagaucgccgagcuguucuccacgaaggcccacaucggc

SEQ ID NO: 12199 - RNA, 2916 nt, Artificial Sequence
  derived and/or modified CDS sequence (opt1) from CCHFV(66019, Artificial)__AB069669.1__Gn-4aa-Gc
agcgaggaguccggcgacgacugcaucagccgcacccagcugcuccggaccgagacggccgaggugcacggggacaacuacggcgggcccggcgacaagaucaccaucugcaacggguccaccaucgucgaccagcgccugggcagcgagcugggcugcuacaccaucaaccgggugaaguccuucaagcucugcgagaacagcgggacgggcaaguccugcaagaucgacaacaccccggugaagugccgccagggguucugccugaagaucacccaggagggccgggggcacgucaagcugagccgcggcuccgagguggugcucgacgccugcgacagcuccugcgagaucaugauccccaagggcaccggggacauccuggucgacugcagcggcgggcagcagcacuuccugaaggacaaccucguggaccugggcugccccaacaucccccugcucggcaagauggcgaucuacaucugccggauguccaaccacccgaagacgaccauggccuuccuguucugguucagcuucggguacgugaucacgugcaucuucugcaagaucaucuucuaccugcucaucgucgugggcacccuggggaagaaguucaagcaguaccgcgagcugaagccccagaccugcaccaucugcgagaccacccccacgaacgccaucgacgccgagaugcacgaccucaagugcuccuacaacaucugccccuacugcgccagccggcugaccuccgacggccuggcgcgccacgugacccagugcccgaagcggaaggagaaggucgaggagaccgagcucuaccugaaccuggagcgcauccccuggaucgugcggaagcuccuccaggugagcgaguccacgggggucgcccugaagcgcagcagcuggcucaucgugcugcuggugcuccugaccgucucccugagccccgugcaguccgcccccaucggccggaagccccucuucagcgacuccaucgugaagggcaugaagaaccugcugaacagcaccucccucgagaccagccuguccaucgaggcccccuggggcgcgaucaacguccagagcacguucaagcccaccguguccaccgccaacaucgcccugagcugguccagcguggagcaccgcgggaacaagauccucgucuccgggcggagcgaguccaucaugaagcuggaggagcgcaccggcaucagcugggaccuggggguggaggacgccuccgagagcaagcuccugacggucagcgugauggaccugucccagauguacagccccguguucgaguaccucuccggcgaccggcaggucgaggaguggccgaaggcgaccugcaccggcaacugccccgaccgcugcgggugcaccagcuccacgugccugcacaaggaguggccccacagccggaacuggcgcugcaaccccaccuggugcuggggcguggggaccggcugcacgugcugcgggcuggacgugaaggaccucuucaccgacuacauguucgucaaguggaagguggaguacaucaagaccgaggccaucgugugcgucgagcugaacucccaggagcgccagugcagccugaucgaggccggcacccgguucaaccugggcccggugaccaucacccucuccgagccccgcaacauccagcagaagcugcccagcgagaucaucacgcugcacccccggaucgaggagggguucuucgaccucaugcacgugcagaagguccuguccgccagcaccgugugcaagcugcaguccugcacccacggcgugccgggggaccuccagaucuaccacaucggcaaccugcugaagggcgaccgcgucaacgggcaccucauccacaagaucgagccccacuucaacaccagcuggauguccugggacggcugcgaccuggacuacuacugcaacaugggggacuggcccagcugcacguacaccggcgugacccagcacaaccacgccgccuucgugaaccugcucaacaucgagaccgacuacacgaagaacuuccacuuccacuccaagcgggucaccgcgcacggggacaccccgcagcuggaccugaaggcccgcccgaccuacggcgccggcgagaucacggugcucguggaggucgccgacauggagcugcacaccaagaagaucgccaucagcgggcugaaguucgcgagccugaccugcaccggcugcuacgccugcuccagcgggaucuccugcaaggugcggauccacguggacgagcccgacgagcugacgguccacgucaagagcgaggaccccgacaucguggccgccuccagcucccugauggcccgcaagcucgaguucggcaccgacagcaccuucaaggcguucuccgccaugccgaagaccagccugugcuucuacaucguggagcgggaguacugcgaguccugcagcaaggaggacacgcagaagugcgugaacaccaagcuggagcagccccaguccauccucaucgagcacaaggggaccaucaucggcaagcagaacgacacgugcaccgccaaggccagcugcuggcuggaguccgucaagagcuucuucuacggccugaagaacaugcucuccgggaucuucggcaacguguucaucgggaucuuccuguuccuggcgcccuucauccuccugauccuguucuucauguucggcuggcgcauccucuucugcuucaagugcugccggcgcacccgggggcuguucaaguaccgcuaccugaaggacgacgaggagagcggcuaccggcgcaucaucgagcggcucaacaacaagaagggcaagaacaagcugcuggacggggagcgccucgccgaccggcgcaucgccgagcuguucuccaccaagacccacaucggc

SEQ ID NO: 12200 - RNA, 2916 nt, Artificial Sequence
  derived and/or modified CDS sequence (opt1) from CCHFV(7001, Artificial)__AB069670.1__Gn-4aa-Gc
gccgagggcgggagcuccgacugcaucagccgcacccagcuggugaagaccgaggucgccgagauccacgaggacuccuacggcgggcccggcgagaagaucacgaucugcaacgggagcaccaucguggaccagcggcucggcuccgagcugggcugcuacaccaucaaccgcgugcggagcuacaagcugugcgagaacuccgcgagcgggaaguccugcgagaucgacagcaucccggucaagugcaagcagggcuucugccucaagaucacccaggaggggcgcggccacgugaagcugucccgggggacggagaucgugcuggacgucugcgacagcuccugcgagcucaugauccccaagggcaccggcgacauccugguggacugcagcgggggccagcagcacuuccugcagaacaaccucaucgaccuggggugccccaacgugccccugcucggcaagauggccaucuacgucugccgcauguccaaccacccgaagaccaccauggccuuccuguucugguucagcuucggcuacgugaucacgugcaucgccugccgggugcuguucuaccuccugaucgccaucgggaccgucggcaagaagcugaagcaguaccgcgagcucaagccccagaccugcaucgugugcgaguccgugcccgucaacgcgaucgacgccgagaugcacgagcugaacugcagcuacaacaucugccccuacugcgccucccggcugagcaccgacgggcucauccgccacgugacgcagugcccgaagcggcgcgagaagguggaggagaccgagcuguuccugaaccucgagcggauccccuggcugguccgcaagcugcuccaggugagcgaguccaccggcauggcccugaagcggagcugcuggaugaucacccugcucauccugcugcucguguccaucagccccguccaguccgcgcccguggggcgcaagccgcuguuccuggacaacaucgccaagggcaugaagucccuccugaacagcacgagccuggagaccucccucagcaucgaggcccccuggggcgccaucaacgugcaguccaccuucaagcccaccgucagcgccgcgaacaucgcccuguccuggagcuccguggagcaccgggggaacaagauccuggucagcggccgcuccgagagcaucaugaagcucgaggagcggacggggguguccuggaaccugggcguggaggacgccagcgagagcaagacccugaccgucuccgugauggaccucagccagauguacucccccguguucgaguaccugagcggggaccgccaggucgaggaguggccgaaggcgaccugcacgggcgacugccccgagcggugcggcugcaccuccagcacgugccugcacaaggaguggccccacucccgcaacuggcgcugcaaccccaccuggugcuggggcguggggaccgggugcacgugcugcggccucgacgugaaggacuucuucaccgacuacaugcuggucaaguggaagguggaguacaucaagaccgaggccaucgugugcgucgagcugaccagccaggagcggcagugcucccugaucgaggccgggacccgcuucaaccucggcccggugaccaucacccugagcgagccccggaacgugcagcagcgccugccgcccgagaucgucacgcuccaccccaagaucgaggagggcuucuucgaccugaugcacgugcagaagauccuguccgccagcaccgugugcaagcuccaguccugcacccacgggguccccggcgacuuccagguguaccacguggggaaccugcugcggggcgacaaggucaacggccacagcauccacaagaucgagccccacuucaacaccuccuggaugagcugggacgggugcgaccucgacuacuucugcaacaugggcgacuggcccuccugcaccuacacgggggugacccagcacaaccgcgccgccuucaucaacaugcugaacaucgagaccgacuacaccaagacguuccacuuccacagcaagcgggugaccgcccacggcgacaccccgcagcuggaccucaaggcgcgccccgccuacggggccggcgaggucaccgugcugguggaggucgccgaccuggagcuccacacgaagaagcuggaggugagcggccugaagaucgccucccugaccugcagcgggugcuacgcgugcuccagcggcaucuccugcaaggugcggauccacgucaacgagcccgacgaguucaccgugcacgugcgcagcuccgacccggacgucguggccgccgggagcucccucauggcccggaagaucgaguucggcgcggacagcaccuucaaggccuucuccagcaugcccaaggacucccugugcuucuacaucguggagaaggacuacugcagcuccugcacggacgacgacacccagaagugcgucaacaccaagcucgaccacccccagagcauccugaucgagcacaaggggaccaucaucggcaagcagaacgacacgugcuccaccaagaccagcugcuggcuggaguccgugaagggcuucuucuacgggcucaagaacaugcugagcggcaucuucgggaacguguuccugggcaucuuccucuuccuggcccccuucguccugcucaucuucuucuucuucuucggguggcgccugcuguucugccucaagugcugccggcgcacccggggccugcugaaguacaagcaccucaaggacgaggaggaggccggcuacaagaagaucaucgagcgccugaacgggaagaagggcaagagccagcuguucgacggggagcggcucgccgaccgcaagaucgcggagcuguucuccacgaagauccacaucggc

SEQ ID NO: 12201 - RNA, 2916 nt, Artificial Sequence
  derived and/or modified CDS sequence (opt1) from CCHFV(75024, Artificial)__AB069671.1__Gn-4aa-Gc
agcgaggaguccggcgacgacugcaucagccgcacccagcugcuccggaccgagacggccgagauccacggggacaacuacggcgggcccggcgacaagaucaccaucugcaacggguccaccaucguggaccagcgccugggcagcgagaugggcugcuacaccaucaaccgggucaaguccuucaagcugugcgagaacagcgccacggggaaguccugcgagaucgacagcaucccggugaagugccgccagggcuacugccucaagaucacccaggaggggcggggccacgugaagcugucccgcgggagcgaggucgugcuggacgcgugcgacuccagcugcgaggugaugauccccaagggcaccggcgacauccucgucgacugcuccgggggccagcagcacuuccugaaggacaaccugaucgaccucgggugccccagcaucccccugcugggcaagauggccaucuacaucugccggauguccaaccacccgaagaccacgauggccuuccucuucugguucagcuucggcuacgugaucacgugcauccugugcaaggccaucuucuaccugcucaucaucguggggacccugggcaagcgcuucaagcaguaccgggagcugaagccccagaccugcaccaucugcgagaccacccccgccaacgcgaucgacgccgagaugcacgaccucaacugcuccuacaacaucugccccuacugcgccagccgccugaccuccgacgggcuggcccggcacgucacgcagugcccgaagcgcaaggagaagguggaggagaccgagcucuaccugaaccuggagcggauccccugggugguccgcaagcuccuccaggugagcgagagcaccggcguggcgcugaagcgguccagcuggcucaucguccugcuggugcuguucgccaucucccugagccccgugcaguccgcccccaucgggcgccggccgcuguuccucgacagcaucguccgcggcaugaagaaccagcugaacuccaccagccuggagacgucccucagcaucgaggcccccuggggcgccaucaacgugcaguccaccuacaagcccaccgugagcaccgcgaacaucgcccuguccuggagcuccgucgagcaccgggggaacaagauccuggugagcggccgcuccgagagcaucaugaagcucgaggagcggacggggaucuccugggaccugggcguggaggacgccagcgagagcaagcugcucaccgucuccgugauggaccugagccagauguacucccccgucuucgaguaccugagcggggaccgccagguggaggaguggccgaaggcgaccugcaccggcgacugccccgagcgcugcggcugcacgaccuccacgugccuccacaaggaguggccccacagccggaacuggcgcugcaaccccaccuggugcuggggcguggggaccgggugcacgugcugcggccuggacgucaaggaccuguucaccgacuacaugaucgugaaguggaagguggaguacaucaagaccgaggccaucgucugcguggagcucaccucccaggagcggcagugcagccugaucgaggccgggacccgcuucaaccugggcuccgugaccaucacccugagcgagccgcggaacauccagcagaagcucccgcccgagaucaucacccugcacccccgcaucgaggagggcuucuucgaccugaugcacguccagaaggugcucuccgccagcacggugugcaagcugcaguccugcacccacgggguccccggcgaccuccagguguaccacguggggaaccugcugaagggcgacaaggucaacggccaccugauccacaagaucgagccccaccucaacaccagcuggauguccugggacgggugcgaccuggacuacuacugcaacaugggcgacuggcccagcugcaccuacacgggggugacccagcacaaccacgccuccuucgugaaccugcucaacaucgagaccgacuacaccaagagcuuccacuuccacagcaagcgggucacggcccacggcgacacgccccagcuggaccugaaggcccgcccgaccuacggggcgggcgagaucaccgugcucguggaggucgccgacauggaguucacccccaagaagaucgagaucuccggccugaaguucgccagccugaccugcaccgggugcuacgccugcuccagcggcaucuccugcaaggugcggauccacguggacgagcccgacgagcucaccguccacgucaagagcgacgacccggacgugguggccgcguccagcucccugauggcccgcaagcuggaguucgggacggacagcaccuucaaggccuucuccgccaugcccaagaccagccucugcuucuacaucguggagcgggaguacugcaaguccugcagcaaggaggacacccagaagugcgugaacacgaagcuggagcagccccaguccauccugaucgagcacaagggcaccaucaucgggaagcagaacaacacgugcaccgcgaaggccagcugcuggcucgaguccgucaagagcuucuucuacggccugaagaacaugcuguccggcaucuucgggaaccucuucaugggcaucuuccuguuccuggcccccuucauccuccugauccuguucuucauguucggguggcgcauccucuucugcuucaagugcugccggcgcacccggggccuguucaaguaccgccaccugaaggacgacgaggagaccggguaccggcgcaucaucgagcggcucaacaacaagaagggcaagaacaagcugcuggacggcgagcgccucgccgaccgccggaucgccgagcuguucagcaccaagacccacaucggg

SEQ ID NO: 12202 - RNA, 2916 nt, Artificial Sequence
  derived and/or modified CDS sequence (opt1) from CCHFV(7803, Artificial)__AB069672.1__Gn-4aa-Gc
agcgaggaguccggcgacgacugcaucagccgcacccagcuccuccggaccgagacggccgagauccacggggacaacuacggcgggcccggcgacaagaucaccaucugcaacggguccaccaucguggaccagcgccugggcagcgagaugggcugcuacaccaucaaccgggucaaguccuucaagcugugcgagaacagcgccacggggaaguccugcgagaucgacagcaucccggugaagugccgccagggcuacugccucaagaucacccaggaggggcggggccacgugaagcugucccgcgggagcgaggucauccuggacgcgugcgacuccagcugcgaggugaugauccccaagggcaccggcgacauccucguggacugcuccgggggccagcagcacuuccugaaggacaaccugaucgaccucgggugccccagcaucccccugcugggcaagauggccaucuacaucugccggauguccaaccacccgaagaccacgauggccuuccucuucugguucagcuucggcuacgucaucacgugcauccugugcaaggccaucuucuaccugcucaucaucguggggacccugggcaagcgcuucaagcaguaccgggagcugaagccccagaccugcaccaucugcgagaccacccccgccaacgcgaucgacgccgagaugcacgaccucaacugcuccuacaacaucugccccuacugcgccagccgccugaccuccgacgggcuggcccggcacgugacgcagugcccgaagcgcaaggagaaggucgaggagaccgagcucuaccugaaccuggagcggauccccuggguggugcgcaagcuccugcaggucagcgagagcaccggcguggcgcugaagcgguccagcuggcucaucgugcugcugguccucuucgccaucucccugagccccgugcaguccgcccccaucagccgccggccgcuguuccucgacuccaucgugcgcgggaugaagaacccccugaacagcaccucccuggagacgagccucuccaucgaggcccccuggggcgccaucaacguccagagcaccuacaagcccaccguguccaccgcgaacaucgcccugagcugguccagcguggagcaccggggcaacaagauccuggucuccgggcgcagcgaguccaucaugaagcucgaggagcggacgggcaucagcugggaccuggggguggaggacgccagcgaguccaagcugcucaccgugagcgucauggaccugucccagauguacagcccgguguucgaguaccuguccggcgaccgccaggucgaggaguggcccaaggcgaccugcaccggggacugccccgagcgcugcggcugcacgaccagcacgugccuccacaaggaguggccccacucccggaacuggcgcugcaacccgaccuggugcuggggcguggggaccggcugcacgugcugcgggcuggacgugaaggaccuguucaccgacuacaugaucgucaaguggaagguggaguacaucaagacccggggcaucgugugcgucgagcucaccagccaggagcgccagugcucccugaucgaggccgggacccgguucaaccugggcagcgugaccaucacccuguccgagccccgcaacauccagcagaagcucccgcccgagaucaucacccugcacccccggaucgaggagggcuucuucgaccugaugcacgugcagaagguccucagcgccuccacggugugcaagcugcagagcugcacccacggggugcccggcgaccugcaggucuaccacguggggaaccuccugaagggcgacaaggugaacggccaccugauccacaagaucgagccccaccucaacaccuccuggaugagcugggacgggugcgaccuggacuacuacugcaacaugggcgacuggcccuccugcaccuacacgggggucacccagcacaaccacgccagcuucgugaaccugcucaacaucgagaccgacuacaccaagagcuuccacuuccacuccaagcgcgugacggcccacggcgacaccccgcagcuggaccugaaggcccggcccaccuacggggccggcgagaucaccguccucguggagguggcggacauggaguucacgcccaagaagaucgagaucagcggccugaaguucgccucccugaccugcaccgggugcuacgccugcagcuccggcaucagcugcaagguccgcauccacguggacgagccggacgagcucaccgugcacgucaaguccgacgaccccgacgugguggccgccagcuccagccugauggcgcggaagcuggaguucgggacggacuccaccuucaaggccuucagcgccaugcccaagaccucccucugcuucuacaucgucgagcgcgaguacugcaagagcugcuccaaggaggacacccagaagugcgugaacacgaagcuggagcagccccagagcauccugaucgagcacaagggcaccaucaucgggaagcagaacaacacgugcaccgccaaggcguccugcuggcucgagagcgugaaguccuucuucuacggccugaagaacaugcugagcggcaucuucgggaacuucuucaugggcaucuuccucuuccuggccccguucauccugcucauccuguucuucauguucggguggcggauccuguucugcuucaagugcugccgccggacccgcggccucuucaaguaccggcaccugaaggacgacgaggagaccggguaccgccggaucaucgagcgccugaacaacaagaagggcaagaacaagcuccuggacggcgagcgccuggccgaccggcgcaucgccgagcuguucagcaccaagacccacaucggg

SEQ ID NO: 12203 - RNA, 2916 nt, Artificial Sequence
  derived and/or modified CDS sequence (opt1) from CCHFV(79121, Artificial)__AB069673.1__Gn-4aa-Gc
gccgagggcgggagcuccgacugcaucagccgcacccagcuggugaagaccgaggucgccgagauccacgaggacuccuacggcgggcccggcgagaagaucacgaucugcaacgggagcaccaucguggaccagggccucggcuccgagcuggggugcuacaccaucaaccgggugcgcagcuacaagcugugcgagaacuccgcgagcggcaaguccugcgagaucgacagcaucccggucaagugcaagcagggguucugccucaagaucacccaggagggccgggggcacgugaagcugucccgcggcacggagaucgugcuggacgucugcgacagcuccugcgagcucaugauccccaagggcaccggggacauccugguggacugcagcggcgggcagcagcacuuccugcagaacaaccucaucgaccugggcugccccaacgugccccugcucggcaagauggccaucuacgucugccggauguccaaccacccgaagaccaccauggccuuccuguucugguucagcuucggguacgugaucacgugcaucgccugccgcgugcuguucuaccuccugaucgccaucggcaccgucgggaagaagcugaagcaguaccgggagcucaagccccagaccugcaucgugugcgaguccgugcccgucaacgcgaucgacgccgagaugcacgagcugaacugcagcuacaacaucugccccuacugcgccucccgccugagcaccgacggccucauccggcacgugacgcagugcccgaagcgccgggagaagguggaggagaccgagcuguuccugaaccucgagcgcauccccuggcugguccggaagcugcuccaggugagcgaguccaccgggauggcccugaagcgcagcugcuggaugaucacccugcucauccugcugcucguguccaucagccccguccaguccgcgcccgugggccggaagccgcuguuccuggacagcacggccaagggcaugaagucccuccugaacagcaccucccuggagaccagccucuccaucgaggcccccuggggcgccaucaacgugcagagcaccuucaagcccacggucuccgccgcgaacaucgcccugagcugguccagcguggagcaccgcgggaacaagauccuggucuccgggcggagcgaguccaucaugaagcucgaggagcgcaccggcgugagcuggaaccuggggguggaggacgccagcgaguccaagacccugaccgucagcgugauggaccucucccagauguacagccccguguucgaguaccuguccggcgaccggcaggucgaggaguggccgaaggccacgugcaccggcgacugccccgagcgcugcgggugcaccagcuccacgugccugcacaaggaguggccccacagccggaacuggcgcugcaaccccaccuggugcuggggcguggggaccggcugcacgugcugcgggcucgacgugaaggacuucuucaccgacuacaugcuggucaaguggaagguggaguacaucaagaccgaggccaucgugugcgucgagcugaccucccaggagcgccagugcagccugaucgaggcgggcacccgguucaaccucggcccggugaccaucacgcuguccgagccccgcaacgugcagcagcggcugccgcccgagaucgucacccuccaccccaagaucgaggagggguucuucgaccugaugcacgugcagaagauccugagcgccuccaccgugugcaagcuccagagcugcacccacggcguccccggggacuuccagaucuaccacgugggcaaccugcugcgcggcgacaaggugaacgggcacuccauccacaagaucgagccccacuucaacaccagcuggauguccugggacggcugcgaccucgacuacuucugcaacaugggggacuggcccagcugcacguacaccggcgucacccagcacaaccgggccgccuucaucaacaugcugaacaucgagaccgacuacacgaagaccuuccacuuccacagcaagcgcgugaccgcccacggggacaccccgcagcuggaccucaaggcgcggcccgccuacggcgccggcgaggugacgguccugguggagguggccgaccuggagcuccacaccaagaaccuggaggucuccgggcugaagaucgccagccugaccugcuccggcugcuacgcgugcagcuccgggaucagcugcaaggugcgcauccacgugaacgagcccgacgaguucaccguccacgugcgguccagcgacccggacguggucgccgccggcuccagccucauggcccgcaagaucgaguucggggcggacuccacguucaaggccuucagcuccaugcccaaggacagccugugcuucuacaucguggagaaggacuacugcuccagcugcaccgacgacgacacccagaagugcgugaacaccaagcucgaccacccccaguccauccugaucgagcacaagggcacgaucaucggcaagcagaacgacacgugcagcaccaagaccuccugcuggcuggagagcgucaagggguucuucuacggccucaagaacaugcugagcgggaucuucggcaacguguuccuggggaucuuccucuuccuggcccccuucgugcugcucaucuucuucuucuucuucggcuggcggcugcuguucugccucaagugcugccgccggacccgcggccugcugaaguacaagcaccucaaggacgaggaggaggccggguacaagaagaucaucgagcggcugaacggcaagaaggggaagucccagcuguucgacggcgagcgccucgccgaccggaagaucgcggagcuguucagcaccaagauccacaucggg

SEQ ID NO: 12204 - RNA, 2916 nt, Artificial Sequence
  derived and/or modified CDS sequence (opt1) from CCHFV(8402, Artificial)__AB069674.1__Gn-4aa-Gc
agcgaggaguccggcgacgacugcaucagccgcacccagcugcuccggaccgagacggccgagauccacaacgacaacuacgggggccccggggacaagaucaccaucugcaacggcuccaccguggucgaccagcgccuggggagcgagcugggcugcuacaccaucaaccgggugaaguccuucaagcucugcgagaacagcgccacgggcaaguccugcgagaucgacagcaccccggugaagugccgccagggguucugccugaagaucacccaggagggccgggggcacgucaagcugucccgcggcagcgagguggugcucgacgcgugcgacuccagcugcgagaucaugauccccaaggggaccggcgacauccuggucgacugcuccggcgggcagcagcacuuccugaaggacaaccucaucgaccugggcugccccaacaucccccugcucgggaagauggccaucuacaucugccggaugagcaaccacccgaagacgaccauggccuuccuguucugguucuccuucggcuacguggugaccugcauccugugcaaggucaucuucuaccuccugaucguggugggcacccuggggaagaaguucaagcaguaccgcgagcucaagccccagacgugcaccaucugcgagaccacccccgucaacgccaucgacgccgagaugcacgaccugaacugcagcuacaacaucugccccuacugcgcgucccggcugacgagcgacggccucgcccgccacgugaugcagugcccgaagcggaaggagaagaucgaggagaccgagcuguaccugaaccucgagcgcauccccugggugguccggaagcugcugcagguguccgagagcaccgggguggcccucaagcgcagcuccuggcuggucgugcugcucgugcugcugaccgucagccucucccccgugcagagcgcccccaucggccggaagccgcuguucuccgacagcaucgugaaggggaugaagaaccugcucaacuccacgagccuggagaccucccugagcaucgaggcgcccuggggcgccaucaacguccaguccaccuucaagcccaccgugagcgccgccaacaucgcccucuccuggagcuccgucgagcaccgcggcaacaagauccuggugagcgggcgguccgagagcaucaugaagcuggaggagcgcacgggcaucuccugggaccucgggguggaggacgcgagcgagagcaagcugcugaccgucuccgugauggaccucagccagauguacucccccguguucgaguaccugagcggcgaccggcaggucgaggaguggccgaaggccaccugcaccggggacugccccgagcgcugcggcugcacguccagcaccugccugcacaaggaguggccccacucccggaacuggcgcugcaaccccaccuggugcuggggcguggggaccggcugcacgugcugcgggcucgacgugaaggaccuguucaccgacuacauguucaucaaguggaaggucgaguacaucaagaccgaggccaucgugugcguggagcugaccagccaggagcgccagugcacgcugaucgaggccggcacccgguucaaccucgggccggucaccaucacccuguccgagccccgcaacauccagcagaagcugccccccgagaucgugacccuccacccgcggaucgaggagggcuucuucgaccugaugcacgugcagaagguccugagcgccuccacggugugcaagcuccagagcugcacccacggcgugcccggggaccugcaggucuaccacaucggcaaccugcucaagggggacaaggugaacggccaccugauccacaagaucgagccccacuucaacaccuccuggaugagcugggacggcugcgaccuggacuacuacugcaacaugggggacuggcccuccugcaccuacacgggcgugacccagcacaaccacgcggccuucgucaacaugcucaacaucgagaccgacuacaccaagaacuuccacuuccacagcaagcgcgugacggcccacggggacaccccgcagcuggaccugaaggcccggcccaccuacggcgccggggagaucaccgugcucgucgagguggcggacauggagcugcacacgaagaagaucgagaucuccggccugaaguucgccagccucaccugcaccggcugcuacgccugcagcuccgggaucagcugcaaggugcgcauccacgucgacgagcccgacgagcugaccgugcacgugaaguccgaggacccggacaucgucgccgccagcuccagccugauggcgcggaagcucgaguucggcacggacuccaccuucaaggccuucagcgccaugcccaagaccucccugugcuucuacaucguggagcgcgaguacugcaagagcugcuccaaggaggacacccagaagugcgugaacacgaagcuggagcagccccagagcauccucaucgagcacaaggggaccaucaucggcaagcaguccaacaccugcaccgccaaggcgagcugcuggcuggaguccgucaagagcuucuucuacgggcugaagaacaugcucuccggcaucuucggcaacguguucaucgggguguuccuguucuucgcccccuucauccugcucauccuguucuucauguucggcuggcggauccuguucugcuucaagugcugccgccggacgcgcgggcucuucaaguaccggcaccugaaggacgacgaggagaccggcuaccgcaagaucaucgagcggcugaacaacaagaaggggaagaacaagcuccuggacggcgagcgccuggccgaccggaagaucgccgagcucuucagcaccaagacccacaucggc

SEQ ID NO: 12205 - RNA, 2916 nt, Artificial Sequence
  derived and/or modified CDS sequence (opt1) from CCHFV(88166, Artificial)__AB069675.1__Gn-4aa-Gc
agcgaggaguccggcgacgacugcaucagccgcacccagcugcuccggaccgagacggccgagauccacuccgacaacuacgggggccccggggacaagaucaccaucugcaacggcagcaccguggucgaccagcgccugggguccgagcugggcugcuacaccaucaaccgggugaagagcuucaagcucugcgagaacuccgccacgggcaagagcugcgagaucgacuccaccccggugaagugccgccagggguucugccugaagaucacccaggagggccgggggcacgucaagcugagccgcggcuccgagguggugcucgacgcgugcgacagcuccugcgagaucaugauccccaaggggaccggcgacauccuggucgacugcagcggcgggcagcagcacuuccugaaggacaaccucaucgaccugggcugccccaacaucccccugcucgggaagauggccaucuacaucugccggauguccaaccacccgaagacgaccaugggcuuccuguucugguucagcuucggcuacguggugaccugcauccugugcaaggucaucuucuaccuccugaucgugguggggacccugggcaagaaguucaagcaguaccgcgagcucaagccccagacgugcaccaucugcgagaccacccccgucaacgccaucgacgccgagaugcacgaccugaacugcuccuacaacaucugccccuacugcgccagccggcugacguccgacgggcucgcgcgccacgugaugcagugcccgaagcggaaggagaagaucgaggagaccgagcuguaccugaaccucgagcgcauccccugggugguccggaagcugcugcaggugagcgagagcaccggcguggcccucaagcgcuccagcuggcuggucgugcugcucgugcugcugaccgucucccucagccccgugcaguccgcccccaucgggcggaagccgcuguucagcgacuccaucgugaagggcaugaagaaccugcucaacagcacgucccuggagaccagccuguccaucgaggcccccuggggcgcgaucaacguccagagcaccuucaagcccaccauguccgccgccaacaucgcccucagcugguccagcguggagcaccgcgggaacaagauccuggucuccggccggagcgaguccaucaugaagcuggaggagcgcacggggaucagcuggaaccucggcguggaggacgccagcgaguccaagcugcugaccgugagcgucauggaccucucccagauguacagccccguguucgaguaccuguccggggaccggcagguggaggaguggccgaaggcgaccugcaccggcgacugccccgagcgcugcggcugcacgagcuccaccugccugcacaaggaguggccccacagccggaacuggcgcugcaaccccaccuggugcuggggggucggcaccgggugcacgugcugcggccucgacgugaaggaccuguucaccgacuacauguucaucaaguggaagguggaguacaucaagaccgaggccaucgucugcguggagcugaccucccaggagcgccagugcacgcugaucgaggccgggacccgguucaaccucggcccggugaccaucacccugagcgagccccgcaacauccagcagaagcugccccccgagaucgucacccuccacccgcggaucgaggagggcuucuucgaccugaugcacgugcagaaggugcuguccgccagcacggucugcaagcuccaguccugcacccacggggugcccggcgaccugcagguguaccacaucgggaaccugcucaagggcgacaaggucaacggccaccugauccacaagaucgagccccacuucaacaccagcuggauguccugggacgggugcgaccuggacuacuacugcaacaugggcgacuggcccagcugcaccuacacgggggugacccagcacaaccacgccgcguucgugaacaugcucaacaucgagaccgacuacaccaagaacuuccacuuccacuccaagcgcgucacggcccacggcgacaccccgcagcuggaccugaaggcccggcccaccuacggggccggcgagaucaccgugcucguggaggucgccgacauggagcugcacacgaagaagaucgagaucagcggccugaaguucgcgagccucaccugcaccgggugcuacgccugcuccagcggcaucuccugcaaggugcgcauccacguggacgagcccgacgagcugaccguccacgugaagagcgaggacccggaccugguggccgccuccagcucccucauggcccggaagcuggaguucgggacggacagcaccuucaaggcguucuccgccaugcccaagaccagccugugcuucuacaucgucgagcgcgaguacugcaaguccugcagcaaggaggacacccagaagugcgugaacacgaagcucgagcagccccaguccauccugaucgagcacaagggcaccaucaucgggaagcagaacaacaccugcaccgccaaggccagcugcuggcuggaguccgugaagagcuucuucuacggccucaagaacaugcuguccggcaucuucgggaacgucuucaucggcguguuccuguucuucgcgcccuucauccuccugauccuguucuucauguucggguggcggauccucuucugcuucaagugcugccgccggacgcgcggccuguucaaguaccggcaccugaaggacgacgaggagaccggguaccgcaagaucaucgagcggcucaacaacaagaagggcaagaacaagcugcuggacggcgagcgccucgccgaccggaagaucgccgagcuguucagcaccaagacccacaucggg

SEQ ID NO: 12206 - RNA, 2916 nt, Artificial Sequence
  derived and/or modified CDS sequence (opt1) from CCHFV(BA88166, Artificial)__AF338470.1__Gn-4aa-Gc
agcgaggaguccggcgacgacugcaucagccgcacccagcugcuccggaccgagacggccgagauccacuccgacaacuacgggggccccggggacaagaucaccaucugcaacggcagcaccguggucgaccagcgccugggguccgagcugggcugcuacaccaucaaccgggugaagagcuucaagcucugcgagaacuccgccacgggcaagagcugcgagaucgacuccaccccggugaagugccgccagggguucugccugaagaucacccaggagggccgggggcacgucaagcugagccgcggcuccgagguggugcucgacgcgugcgacagcuccugcgagaucaugauccccaaggggaccggcgacauccuggucgacugcagcggcgggcagcagcacuuccugaaggacaaccucaucgaccugggcugccccaacaucccccugcucgggaagauggccaucuacaucugccggauguccaaccacccgaagacgaccaugggcuuccuguucugguucagcuucggcuacguggugaccugcauccugugcaaggggaucuucuaccuccugaucgucgugggcacccuggggaagaaguucaagcaguaccgcgagcucaagccccagacgugcaccaucugcgagaccacccccgugaacgccaucgacgccgagaugcacgaccugaacugcuccuacaacaucugccccuacugcgccagccggcugacguccgacggccucgcgcgccacgucaugcagugcccgaagcggaaggagaagaucgaggagaccgagcuguaccugaaccucgagcgcauccccuggguggugcggaagcugcugcaggucagcgagagcaccgggguggcccucaagcgcuccagcuggcuggugguccugcucgugcugcugaccgugucccucagccccguccaguccgcccccaucggccggaagccgcuguaccuggacagcaucgugaagggcaugaagaaccuccugaacuccacgagccuggagaccucccucagcaucgaggcccccuggggggcgaucaacgugcaguccaccuucaagcccaccaugagcgccgccaacaucgcccuguccuggagcuccgucgagcaccgcggcaacaagauccuggugagcgggcgguccgagagcaucaugaagcucgaggagcgcacgggcaucuccuggaaccugggggucgaggacgccagcgagagcaagcugcucaccguguccgugauggaccugagccagauguacucccccgucuucgaguaccugagcggcgaccggcagguggaggaguggccgaaggcgaccugcaccggcgacugccccgagcgcugcgggugcacguccagcaccugccuccacaaggaguggccccacucccggaacuggcgcugcaaccccaccuggugcuggggcguggggaccggcugcacgugcugcgggcuggacgucaaggaccuguucaccgacuacauguucaucaaguggaagguggaguacaucaagaccgaggccaucgugugcgucgagcugaccagccaggagcgccagugcacgcucaucgaggccggcacccgguucaaccugggcccggugaucaucacccuguccgagccccgcaacauccagcagaagcucccccccgagaucgugacccugcacccgcggaucgaggagggguucuucgaccugaugcacguccagaaggugcucagcgccuccaccgugugcaagcugcagagcugcacgcacggcguccccggggaccugcagguguaccacaucggcaaccuccugaagggcgacaaggugaacgggcaccugauccacaagaucgagccccacuucaacaccuccuggaugagcugggacggcugcgaccucgacuacuacugcaacaugggggacuggcccuccugcaccuacaccggcgucacgcagcacaaccacgccgcguucgugaacaugcugaacaucgagaccgacuacaccaagaacuuccacuuccacagcaagcgcgugaccgcccacggggacacgccgcagcuggaccucaaggcccggcccaccuacggcgccggcgagaucaccguccugguggagguggccgacauggagcugcacaccaagaagaucgagaucuccgggcucaaguucgcgagccugacgugcaccggcugcuacgccugcagcuccgggaucagcugcaagguccgcauccacguggacgagcccgacgagcugaccgugcacgucaaguccgaggacccggacaucguggccgccagcuccagccucauggcccggaagcuggaguucggcaccgacuccacguucaaggcguucagcgccaugcccaagaccucccugugcuucuacaucguggagcgcgaguacugcaagagcugcuccaaggaggacacccagaagugcgucaacaccaagcucgagcagccccagagcauccugaucgagcacaaggggacgaucaucggcaagcagaacaacaccugcaccgccaaggccuccugcuggcuggagagcgugaaguccuucuucuacggccucaagaacaugcugagcgggaucuucggcaacguguucaucggggucuuccuguucuucgcgcccuucauccuccugauccuguucuucauguucggcuggcggauccucuucugcuucaagugcugccgccggacccgcgggcuguucaaguaccggcaccugaaggacgacgaggagacgggcuaccgcaagaucaucgagcggcucaacaacaagaagggcaagaacaagcugcuggacggggagcgccucgccgaccggaagaucgccgagcuguucuccaccaagacccacaucggc

SEQ ID NO: 12207 - RNA, 2916 nt, Artificial Sequence
  derived and/or modified CDS sequence (opt1) from CCHFV(BA66019, Artificial)__AF350448.1__Gn-4aa-Gc
agcgaggaguccggcgacgacugcaucagccgcacccagcugcuccggaccgagacggccgaggugcacggggacaacuacggcgggcccggcgacaagaucaccaucugcaacggguccaccaucgucgaccagcgccugggcagcgagcugggcugcuacaccaucaaccgggugaaguccuucaagcucugcgagaacagcgggacgggcaaguccugcaagaucgacaagcacccggugaagugccgccagggguucugccugaagaucacccaggagggccgggggcacgucaagcugagccgcggcuccgagguggugcucgacgccugcgacagcuccugcgagaucaugauccccaagggcaccggggacauccuggucgacugcagcggcgggcagcagcacuuccugaaggacaaccucguggaccugggcugccccaacaucccccugcucggcaagauggcgaucuacaucugccggauguccaaccacccgaagaccacgauggccuuccuguucugguucagcuucggguacgugaucacgugcaucuucugcaagaucaucuucuaccugcucaucgucgugggcacccuggggaagaaguucaagcaguaccgcgagcugaagccccagaccugcaccaucugcgagaccacccccaccaacgccaucgacgccgagaugcacgaccucaagugcuccuacaacaucugccccuacugcgccagccggcugacguccgacggccuggcgcgccacgugacccagugcccgaagcggaaggagaaggucgaggagaccgagcucuaccugaaccuggagcgcauccccuggaucgugcggaagcuccuccaggugagcgaguccaccggggucgcccugaagcgcagcagcuggcucaucgugcugcuggugcuccugacggucucccugagccccgugcaguccgcccccaucggccggaagccccucuucagcgacuccaucgugaagggcaugaagaaccugcugaacagcaccucccucgagaccagccuguccaucgaggcccccuggggcgcgaucaacguccagagcaccuucaagcccacgguguccaccgccaacaucgcccugagcugguccagcguggagcaccgcgggaacaagauccucgucuccgggcggagcgaguccaucaugaagcuggaggagcgcaccggcaucagcugggaccuggggguggaggacgccuccgagagcaagcuccugaccgucagcgugauggaccugucccagauguacagccccguguucgaguaccucuccggcgaccggcaggucgaggaguggccgaaggccacgugcaccggcgacugccccgaccgcugcgggugcaccagcuccacgugccugcacaaggaguggccccacagccggaacuggcgcugcaaccccaccuggugcuggggcguggggaccggcugcacgugcugcgggcuggacgugaaggaccucuucaccgacuacauguucgucaaguggaagguggaguacaucaagaccgaggcgaucgugugcgucgagcugaacucccaggagcgccagugcagccugaucgaggccggcacccgguucaaccugggcccggugaccaucacccucuccgagccccgcaacauccagcagaagcugccgcccgagaucaucacccugcacccgcggaucgaggagggguucuucgaccucaugcacgugcagaagguccugagcgccuccacggugugcaagcugcagagcugcacccacggcgugcccggggaccuccagaucuaccacaucggcaaccugcugaagggcgaccgcgucaacgggcaccucauccacaagaucgagccccacuucaacaccuccuggaugagcugggacggcugcgaccuggacuacuacugcaacaugggggacuggcccuccugcaccuacacgggcgugacccagcacaaccacgccgccuucgugaaccugcucaacaucgagaccgacuacaccaagaacuuccacuuccacagcaagcgggucacggcgcacggggacaccccgcagcuggaccugaaggcccgccccaccuacggcgccggcgagaucaccgugcucguggaggucgccgacauggagcugcacacgaagaagaucgccaucuccgggcugaaguucgcgagccugaccugcaccggcugcuacgccugcagcuccgggaucagcugcaaggugcggauccacguggacgagcccgacgagcugaccguccacgugaaguccgaggacccggacaucguggccgccagcuccagccugauggcccgcaagcucgaguucggcacggacuccaccuucaaggcguucagcgccaugcccaagaccucccugugcuucuacaucgucgagcgggaguacugcgagagcugcuccaaggaggacacccagaagugcgugaacacgaagcuggagcagccccagagcauccucaucgagcacaaggggaccaucaucggcaagcagaacgacacgugcaccgccaaggccuccugcuggcuggagagcgugaaguccuucuucuacggccugaagaacaugcucagcgggaucuucggcaacgucuucaucgggaucuuccuguuccuggcgcccuucauccuccugauccuguucuucauguucggcuggcgcauccucuucugcuucaagugcugccggcgcacccgggggcuguucaaguaccgcuaccugaaggacgacgaggaguccggcuaccggcgcaucaucgagcggcucaacaacaagaagggcaagaacaagcugcuggacggggagcgccucgccgaccggcgcaucgccgagcuguucagcaccaagacccacaucggc

SEQ ID NO: 12208 - RNA, 2916 nt, Artificial Sequence
  derived and/or modified CDS sequence (opt1) from CCHFV(BA8402, Artificial)__AF350449.1__Gn-4aa-Gc
agcgaggaguccggcgacgacugcaucagccgcacccagcugcuccggaccgagacggccgagauccacaacgacaacuacgggggccccggggacaagaucaccaucugcaacggcuccaccguggucgaccagcgccuggggagcgagcugggcugcuacaccaucaaccgggugaacuccuucaaccucugcgagaacacggccaccggcaagagcugcgagaucgacuccaccccggugaagugccgccagggguucugccugaagaucacccaggagggccgggggcacgucaagcugagccgcggcuccgagguggugcucgacgcgugcgagagcuccugcgagaucaugauccccaaggggacgggcgacauccuggucgacugcagcggcgggcagcagcacuuccugaaggacaaccucaucgaccugggcugccccaacaucccccugcucgggaagauggccaucuacaucugccggauguccaaccacccgaagaccaccauggccuuccuguucugguucagcuucggcuacguggugaccugcauccugugcaaggucaucuucuaccuccugaucguggugggcacgcuggggaagaaguucaagcaguaccgcgagcucaagccccagaccugcaccaucugcgagaccacgcccgucaacgccaucgacgccgagaugcacgaccugaacugcuccuacaacaucugccccuacugcgcgagccggccgaccuccgacggccuggcccgccacgugaugcagugccccaagcggaaggagaagaucgaggagaccgcccucuaccugaaccuggagcgcauccccugggugguccggaagcuccuccaggugagcgaguccaccgggguggcccugaagcgcagcagcuggcuggucgugcugcuggugcuccugacggucucccugagccccgugcaguccgcgccgaucggccggaagccccucuucagcgacuccaucgugaaggggaugaagaaccugcugaacagcaccucccucgagaccagccuguccaucgaggcccccuggggcgccaucaacguccagagcaccuucaagcccacgguguccgccgccaacaucgcgcugagcugguccagcgucgagcaccgcggcaacaagauccucguguccgggcggagcgaguccaucaugaagcuggaggagcgcaccggcaucagcugggaccuggggguggaggacgccuccgagagcaagcuccugaccgucagcgugauggaccugucccagauguacagcccgguguucgaguaccucuccggcgaccggcaggucgaggaguggcccaaggcgaccugcacgggggacugccccgagcgcugcggcugcaccagcuccacgugccugcacaaggaguggccccacagccggaacuggcgcugcaacccgaccuggugcuggggcguggggaccggcugcacgugcugcgggcuggacgugaaggaccucuucaccgacuacauguucaucaaguggaaggucgaguacaucaagaccgaggccaucgugugcguggagcugaccucccaggagcgccagugcacccugaucgaggccggcacccgguucaaccuggggcccgucaccaucacccucagcgagccccgcaacauccagcagaagcugcccccggagaucgugacgcugcacccccggaucgaggagggcuucuucgaccucaugcacgugcagaagguccuguccgccagcaccgugugcaagcugcaguccugcacccacggcgugcccggggaccuccaggucuaccacaucggcaaccugcugaagggggacaaggugaacggccaccucauccacaagaucgagccccacuucaacaccagcuggauguccugggacggcugcgaccugcacuacuacugcaacaugggggacuggccgagcugcacguacaccggcgugacccagcacaaccacgccgccuucgucaacaugcugaacaucgagaccgacuacacgaagaacuuccacuuccacuccaagcgcgugaccgcccacggggacacgccccagcucgaccugaaggcccggcccaccuacggcgcgggggagaucaccgugcuggucgagguggccgacauggagcuccacaccaagaagaucgagaucagcggccugaaguucgccucccugaccugcaccggcugcuacgccugcagcagcgggaucuccugcaaggugcgcauccacgucgacgagccggacgagcucacggugcacgucaagagcgaggaccccgacaucguggccgcguccagcucccugauggcccggaagcuggaguucggcaccgacagcaccuucaaggccuucuccgccaugcccaagaccagccucugcuucuacaucguggagcgcgaguacugcgaguccugcagcaaggaggacacgcagaagugcgugaacaccaagcuggagcagccccaguccauccugaucgagcacaaggggaccaucaucggcaagcagagcaacacgugcaccgcgaaggccuccugcuggcucgagagcgucaaguccuucuucuacgggcugaagaacaugcugagcggcaucuucggcaacguguucaucgggguguuccucuucuucgccccguucauccugcugauccucuucuucauguucggcuggcggauccuguucugcuucaagugcugccgccggacccgcgggcuguucaaguaccggcaccucaaggacgacgaggagaccggcuaccgcaagaucaucgagcggcugaacaacaagaaggggaagaacaagcugcucgacggcgagcgccuggccgaccggaagaucgccgagcuguucuccaccaagacgcacaucggc

SEQ ID NO: 12209 - RNA, 2916 nt, Artificial Sequence
  derived and/or modified CDS sequence (opt1) from CCHFV(Matin, Artificial)__AF467769.2__Gn-4aa-Gc
agcgaggaguccggcgacgacugcaucagccgcacccagcugcuccggaccgagacggccgagauccacuccgacagcuacgggggccccggggacaagaucaccaucugcaacggcuccaccguggucgaccagcgccuggggagcgagcugggcugcuacaccaucaaccgggugaaguccuucaagcucugcgagaacagcgccacgggcaaguccugcgagaucgacagcaccccggugaagugccgccagggguucugccugaagaucacccaggagggccgggggcacgucaagcugucccgcggcagcgagguggugcucgacgcgugcgacuccagcugcgagaucaugauccccaaggggaccggcgacauccuggucgacugcuccggcgggcagcagcacuuccugaaggacaaccucaucgaccugggcugccccaacaucccccugcucgggaagauggccaucuacaucugccggaugagcaaccacccgaagacgaccaugguguuccuguucugguucuccuucggcuacgugaucaccugcauccugugcaaggucaucuucuaccuccugaucguggugggcacccuggggaagaaguucaagcaguaccgcgagcucaagccccagacgugcaccaucugcgagaccacccccgucaacgccaucgacgccgagaugcacgaccugaacugcagcuacaacaucugccccuacugcgccucccggcugacgagcgacggccucgcgcgccacgugaugcagugcccgaagcggaaggagaagaucgaggagaccgagcuguaccugaaccucgagcgcauccccugggugguccggaagcugcugcaggugagcgaguccaccgggguggcccucaagcgcagcuccuggcuggucgugcugcucgugcugcugaccgucagccucucccccgugcagagcgcccccaucggccggaagccgcuguuccuggacuccaucaucaaggggaugaagaaccuccugaacagcacgucccuggagaccagccucuccaucgaggcccccuggggcgcgaucaacgugcagagcaccuucaagcccaccauguccgccgccaacaucgcccugagcugguccagcgucgagcaccgcggcaacaagauccugguguccgggcggagcgaguccaucaugaagcucgaggagcgcacgggcaucagcugggaccugggggucgaggacgccagcgaguccaagcugcucaccgugagcgugauggaccugucccagauguacagccccgucuucgaguaccuguccggcgaccggcagguggaggaguggccgaaggcgaccugcaccggggacugccccgagcgcugcggcugcacgagcuccaccugccuccacaaggaguggccccacagccggaacuggcgcugcaaccccaccuggugcuggggcguggggaccggcugcacgugcugcgggcuggacgucaaggaccuguucaccgacuacauguucgugaaguggaagguggaguacaucaagaccgaggucaucgugugcguggagcugaccucccaggagcgccagugcagccucaucgaggccggcacgcgguucaaccuggggccggucaccaucacccuguccgagccccgcaacauccagcagaagcucccccccgagaucgugacccugcacccgcggaucgaggagggcuucuucgaccugaugcacgugcagaagguccucagcgccuccaccgugugcaagcugcagagcugcacgcacggcgugcccggggaccugcaggucuaccacaucggcaaccuccugaagggggacaaggugaacggccaccugauccacaagaucgagccccacuucaacaccuccuggaugagcugggacggcugcgaccucgacuacuacugcaacaugggggacuggcccuccugcagcuacaccggcgugacccagcacaaccacgccgccuucgucaacaugcugagcaucgagacggacuacaccaagaacuuccacuuccacuccaagcgcgugaccgcgcacggggacaccccgcagcuggaccucaaggcccggcccacguacggcgccggggagaucaccgugcuggucgagguggccgacauggagcugcacaccaagaagaucgagaucagcggccucaaguucgccucccugaccugcacgggcugcuacgcgugcagcuccgggaucagcugcaaggugcgcauccacgucgacgagcccgacgagcugaccgugcacgugaaguccgaggacccggacaucgucgccgccagcuccagccucauggcccggaagcuggaguucggcaccgacuccaccuucaaggccuucagcgcgaugcccaagacgucccugugcuucuacaucguggagcgcgaguacugcaagagcugcuccaaggaggacacccagaagugcgugaacaccaagcucgagcagccccagagcauccugaucgagcacaaggggaccaucaucggcaagcagaacgacacgugcaccgccaaggccuccugcuggcuggagagcgucaaguccuucuucuacgggcucaagaacaugcugagcggcaucuucggcaacguguucaucgggaucuuccuguuccucgcccccuucgcgcugcugauccucuucuucauguucggcuggcggauccuguucugcuucaagugcugccgccggacccgcgggcuguucaaguaccggcaccucaaggacgacgaggagaccggcuaccgcaagaucaucgagcggcugaacaacaagaaggggaagaacaagcugcucgacggcgagcgccuggccgaccggaagaucgccgagcuguucagcacgaagacccacgugggc

SEQ ID NO: 12210 - RNA, 2916 nt, Artificial Sequence
  derived and/or modified CDS sequence (opt1) from CCHFV(Baghdad 12, Artificial)__AJ538197.2__Gn-4aa-Gc
agcgaggaguccggcgacgacugcaucagccgcacccggcugcuccgcaccgagacggccgagauccacggggacuccuacggcgggcccggcgacaagaucaccaucugcaacgggagcaccaucguggaccagcggcugggcuccgagaugggcugcuacaccaucaaccgcgucaagagcuucaagcugugcgagaacuccgccacgggcaagagcugcaagaucgacuccaucccggugaagugccggcagggguacugccucaagaucacccaggaggggcgcggccacgugaagcugagccggggguccgaggucgugcuggacgcgugcgacagcuccugcgaggugaugauccccaagggcaccggcgacauccucgucgacugcagcgggggccagcagcacuuccugaaggacaaccugaucgaccucgggugccccaacaucccccugcugggcaagauggccaucuacaucugccgcauguccaaccacccgaagaccacgauggccuuccucuucugguucagcuucggcuacgugaucacgugcauccugugcaaggccaucuucuaccugcucaucaucguggggacccugggcaagcgguucaagcaguaccgcgagcugaagccccagaccugcacgaucugcgagaccacccccgucaacgccaucgacgcggagaugcacgaccucaacugcuccuacaacaucugccccuacugcgccagccggcugaccuccgacgggcuggcccgccacgugacgcagugcccgaagcggaaggagaagguggaggagaccgagcucuaccugaaccuggagcgcauccccugggucgugcggaagcuccuccaggugagcgagagcaccggcgucgcccugaagcgcuccagcuggcucaucgugcugcuggugcuccuggcggucuccagcucccccgugcagagcgcccccaucgggcggaagccgcuguuccucgacuccaucgugaagggcaccaagaaccugcugaacagcacgucccucgagaccagccuguccaucgaggcccccuggggcgccaucaacguccagagcaccuacaagcccaccguguccacggccaacaucgcgcugagcugguccagcguggagcaccgcgggaacaagauccucgucuccggccggagcgaguccaucaugaagcuggaggagcgcaccgggaucagcugggaccugggcguggaggacgccagcgaguccaagcuccugaccgucagcgugauggaccugucccagauguacagccccguguucgaguaccucuccggggaccggcaggucgaggaguggccgaaggcgaccugcacgggcgacugccccgagcgcugcggcugcaccaccagcacgugccugcacaaggaguggccccacucccgcaacuggcggugcaaccccaccuggugcuggggcguggggaccgggugcacgugcugcggccuggacgugaaggaccucuucaccgacuacauguucgucaaguggaagguggaguacaucaagaccgacgccaucgugugcgucgagcugaccagccaggagcgccagugcucccugaucgaggccgggacccgguucaaccugggcagcgugaccaucacccucuccgagccgcgcaacauccagcagaagcugccgcccgagaucaucacgcugcacccccggaucgaggagggcuucuucgaccucaugcacgugcagaagguccugagcgccuccaccgugugcaagcugcagagcugcacccacggggugcccggcgaccuccaggucuaccacaucgggaaccugcugaagggcgacaaggugaacggccaccucauccacaagaucgagccccacuucaacaccuccuggaugagcugggacgggugcgaccuggacuacuacugcaacaugggcgacuggcccuccugcacguacaccggggugacccagcacaaccacgccagcuucgucaaccugcucaacaucgagaccgacuacaccaagagcuuccacuuccacuccaagcgcgugaccgcccacggcgacacgccccagcuggaccugaaggugcggccgaccuacggggccggcgagaucaccguccucguggagguggccgacauggagcugcacaccaagaagaucgagaucagcggccugaaguucgcgucccugaccugcaccgggugcuacgccugcagcuccggcaucagcugcaagguccgcauccacguggacgagcccgacgagcugacggugcacgucaaguccgacgaccccgacgugguggccgccagcuccagccugauggcccggaagcucgaguucgggaccgacuccaccuucaaggcguucagcgccaugccgaagaccucccugugcuucuacaucgucgagcgcgaguacugcaagagcugcuccaaggaggacacgcagaagugcgugaacaccaagcuggagcagccccagagcauccucaucgagcacaagggcaccaucaucgggaagcagaacaacacgugcaccgccaagaccuccugcuggcuggagagcgugaaguccuucuucuacggccugaagaacaugcucagcggcaucuucgggaacuucuucaugggcaucuuccuguuccuggcccccuucauccuccugauccuguucuucauguucggguggcggauccucuucugcuucaagugcugccgccggacccgcggccuguucaaguaccggcaccugaaggacgacgaggagaccggguaccgccggaucaucgagcgccucaacaacaagaagggcaagaacaagcugcuggacggcgagcggcucgcggaccgccgcaucgccgagcuguucagcacgaagacccacaucggg

SEQ ID NO: 12211 - RNA, 2916 nt, Artificial Sequence
  derived and/or modified CDS sequence (opt1) from CCHFV(VLG/TI29414, Artificial)__AY179961.1__Gn-4aa-Gc
agcgaggagcccggcgacgacugcaucucccgcacccagcugcuccgggccgagccggccgagauccacgacgacaacuacgggggccccggggacaagaucaccaucugcaacggcagcacgaucguggaccagcgccugggguccgagcugggcugcuacaccaucaaccgggucaagagcuucaagcucugcgagaacuccgcgaccggcaagaccugcgagaucgacagcacgcccgugaagugccgccagggguucugccugaagaucacccaggagggccgggggcacgugaagcugucccgcggcagcgaggucgugcucgacgccugcgacuccagcugcgaggugaugauccccaaggggaccggcgacauccuggucgacugcuccggcgggcagcagcacuuccugaaggacaaccucaucgaccugggcugcccgcacaucccccugcucgggaagauggccaucuacaucugccggaugagcaaccacccccgcaccacgauggccuuccuguucugguucuccuucggcuacgugaucaccugcaucuucugcaaggcccuguucuacagccucaucaucaucggcacccuggggaagaagaucaagcaguaccgggagcugaagccccagaccugcacgaucugcgagaccgcgccggugaacgccaucgacgccgagaugcacgaccucaacugcuccuacaacaucugccccuacugcgccagccgccugaccuccgacggccuggcgcggcacgucccccagugccccaagcgcaaggagaagguggaggagaccgagcucuaccugaaccuggagcggaucccguggaacgugcgcaagcuccugcaggucagcgaguccacggggguggcccugaagcggagcagcuggcucaucgugcugcugguccuccugaccgugucccugagccccgugcaguccgcccccgucggccgcaagccccucuuccuggacagcaucgugaaggggaugaagaaccugcucaacuccaccaaccuggagaccagccuguccaucgaggccccguggggcgccaucaacgugcagagcacguucaagcccaccgucuccaccgcgaacaucgcccucagcugguccagcguggagcaccggggcaacaagauccuggugaccgggcgcuccgagagcaucaugaagcuggaggagcggacgggcgucuccugggaccucgggguggaggacgccagcgaguccaagcugcugaccgucagcaucauggaccucucccagauguacagccccguguucgaguaccugagcggcgaccgccagguggaggaguggcccaaggccaccugcaccggggacugcccggagcggugcggcugcacguccagcaccugccugcacaaggaguggccccacucccgcaacuggcgcugcaaccccaccuggugcugggaggucggcaccgggugcacgugcugcggcuggaacgugaaggaccucuucaccgaccacauguucgugaaguggaaggucgaguacaucaagaccgaggccaucgugugcguggagcugaccagccaggagcggcagugcucccugaucgaggcggggacgcgcuucaaccugggccccgucaccaucacccucagcgagccgcggaacauccagcagaagcugccccccgagaucaucacccugcaccccaagguggaggagggguucuucgaccucaugcacgugcagaagguccuguccgccagcaccgugugcaagcugcaguccugcacgcacggcaucccgggcgaccuccagguguaccacaucgggaaccugcugaagggcgaccgcgucaacgggcaccucauccacaagaucgagccccacuucaacaccagcuggauguccugggacggcugcgaccuggacuacuacugcaacaugggcgacuggcccagcugcaccuacaccgggaugacgcagcacaaccacgccgccuucgugaaccugcucaacaucgagaccgacuacaccaagaccuuccacuuccacuccaagcgggugacggcccacggcgacaccccgcagcuggaccugaaggcgcgccccaccuacggggccggcgagaucaccguccucguggagguggccgacauggagcugcacacgaagaaggucgagaucagcgggcugaaguucgccucccucgccugcaccggcugcuacgcgugcagcuccggcaucagcugcaaggugcggauccacguggacgagcccgacgagcugaccguccacgugaagagcaacgaccccgacgugaucgccgccuccaccagccugauggcccgcaagcucgaguucgggacggacuccaccuucaaggcguucagcgccaugccgaagaccucccugugcuucuacaucgccgagcgggaguacugcaagagcugcuccgaggaggacacccagaagugcgucgacacgaagcuggagcagccccagagcauccucaucgagcacaagggcaccaucaucgggaagcagaacgacaccugcaccgccaaggccuccugcuggcuggagagcgugaaguccuucuucuacggccugaagaacaugcucgggagcguguucggcaacuucuucaucggcauccugcuguuccucgcgcccuucguccugcuggugcucuucuucauguucggguggaagauccuguucugcuucaagugcugccgccggacgcgcggccugcucaaguaccggcugcugaaggacgacgaggagaccggguaccgccggaucaucgagcgccucaacaacaagaagggcaagaaccggcugcuggacggggagcgccucgccgaccggaagaucgccgagcuguucuccaccaagacccacaucggc

SEQ ID NO: 12212 - RNA, 2916 nt, Artificial Sequence
  derived and/or modified CDS sequence (opt1) from CCHFV(TADJ/HU8966, Artificial)__AY179962.1__Gn-4aa-Gc
agcgaggaguccggcgacgacugcaucagccgcacccagcugcuccggaccgagacggccgagauccacggggacgacuacggcgggcccggcgacaagaucaccaucugcaacggguccaccaucguggaccagcgccugggcagcgagcugggcugcuacaccaucaaccgggucaaguccuucaagcucugcgagaacagcgccacggggaagaacugcgagaucgacuccgugccggugaagugccgccagggcuacugccugaagaucacccaggaggggcggggccacgucaagcugagccgcggguccgagguggugcucgacgcgugcgacagcuccugcgaggucaugauccccaagggcaccggcgacaucagcguggacugcuccgggggccagcagcacuuccugaaggacaaccugaucgaccucgggugccccaagaucccccugcugggcaagauggccaucuacaucugccggaugagcaaccacccgaagaccacgauggccuuccucuucugguucuccuucggcuacgugaucacccgcauccugugcaaggccaucuucuaccugcucaucaucgucgggacccugggcaagcgguucaagcaguaccgcgagcugaagccccagaccugcacgaucugcgagaccacccccgccaacgcgaucgacgccgagaugcacgaccucaacugcagcuacaacaucugccccuacugcgccucccggcugaccagcgacgggcuggcccgccacgugacgcagugcccgaagcggaaggagcgcguggaggagaccgagcucuaccugaaccuggagcggauccccuggaucguccgcaagcuccuccagguguccgagagcaccggcguggcgcugaagcggagcuccuggcucaucguccugcuggugcuguucaccgugagccugucccccguccagagcgcccccaucgggcgccggccgcuguuccucgacuccaucgugaagggcaugaagaacccccugaacagcacgucccuggagaccagccucuccaucgaggcccccuggggcgccaucaacgugcagagcaccuacaagcccaccgucuccacggccaacaucgcgcugagcugguccagcaucgagcaccgcgggaacaacauccugguguccggccggagcgaguccaucaugaagcucgaggagcgcaccgggaucagcggcgaccuggggguggaggacgccuccgagagcaagcugcucaccgucagcgugauggaccugucccagauguacagcccggucuucgaguaccuguccggcgaccgccagguggaggaguggcccaaggcgaccugcacgggcgacugccccgagcggugcgggugcaccagcuccacgugccuccacaaggaguggccccacagccgcaacuggcggugcaacccgaccuggugcuggggcguggggaccggcugcacgugcugcgggcuggacgucaaggaccuguucaucgacuacauguucgugaaguggaagguggacuacaucaagaccgaggccaucgucugcguggagcucaccucccaggagcgccagugcagccugguggaggccggcacccgguucaaccugggccccgucaccaucacccuguccgagccccgcaacauccagcagaagcugcccccggagaucaucacccugcacccccggaucgaggagggguucuucgaccugaugcacgugcagaaggugcucagcgccuccaccgucugcaagcugcagagcugcacgcacggcgugcccggggaccuccagguguaccacaucggcaaccuccugaagggcgacaaggagaacgggcaccugauccacaagaucgagccccacuucaacaccuccuggaugagcugggacggcugcgaccucgacuacuacugcaacaugggggacuggccguccugcaccuacaccggcgucacgcagcacaaccacgccagcuucgugaaccugcugaacaucgagaccgacuacaccaaguccuuccacuuccacagcaagcgcgugaccgcccacggggacacgccccagcucgaccugaaggcccggcccaccuacggcgccggcgagaucaccguccugguggagguggcggacauggagcuccacaccaagaagaucgagaucacggggcugaaguucgccagccugaccugcaccggcugcuacgccugcuccagcgggaucuccugcaagguccgcauccacguggacgagccggacgagcucaccgugcacgucaagagcgacgaccccgacgugguggccgccuccagcucccugauggcgcggaagcuggaguucggcacggacagcaccuucaaggccuucuccgccaugcccaagaccagccucugcuucuacaucgucgagcgcgaguaccggaaguccugcagcaaggaggacacccagaagugcgugaacacgaagcuggagcagccccaguccauccugaucgagcacaaggggaccaucaucggcaagcagaacaacacgugcaccgccaaggcgagcugcuggcucgaguccgucaagagcuucuucuacggccugaagaacaugcuguccgggaucuucggcaacguguucguggggaucuuccucuuccuggccccguucauccugcucauccuguucuucauguucggcuggcgcauccugagcugcuucaagugcugccggcgcacccgggggcuccugaagcaccgccaccugaaggacgacgaggagaccggcuaccggcgcaucaucgagcgccucaacaacaagaagggcaagaacaagcugcuggacggggagcggcucgccgaccgccggaucgccgagcuguucuccaccaagacccacaucggc

SEQ ID NO: 12213 - RNA, 2916 nt, Artificial Sequence
  derived and/or modified CDS sequence (opt1) from CCHFV(Hodzha, Artificial)__AY223476.1__Gn-4aa-Gc
agcgaggaguccggcgacgacugcaucagccgcacccagcugcuccggaccgagacggccgagauccacggggacgacuacggcgggcccggcgacaagaucaccaucugcaacggguccaccaucguggaccagcgccugggcagcgagcugggcugcuacaccaucaaccgggucaaguccuucaagcucugcaagaacagcgccacggggaaguccugcgagaucgacagcaccccggugaagugccgccagggcuacugccugaagaucacccaggaggggcggggccacgugaagcugucccgcgggagcgaggucgugcucgacgcgugcgacuccagcugcgaggugaugauccccaagggcaccggcgacauccuggucgacugcuccgggggccagcagcacuuccugaaggacaaccucaucgaccuggggugcccccggaucccccugcucggcaagauggccaucuacaucugccgcaugagcaaccacccgaagacgaccauggccuuccuguucugguucuccuucggcuacgugaucacgugcauccugugcaaggccaucuucuaccuccugaucaucguggggacccugggcaagcgguucaagcaguaccgcgagcucaagccccagaccugcaccaucugcgagaccacccccgccaacgcgaucgacgccgagaugcacgaccugaacugcagcuacaacaucugccccuacugcgccucccggcugacgagcgacgggcucgcccgccacgucacccagugcccgaagcggaaggagaagguggaggagaccgagcuguaccugaaccucgagcgcauccccuggaucgugcggaagcugcugcaggucuccgagagcaccggcguggcgcucaagcgcagcuccuggcugaucgugcugcucguccuguucgccgugagccugucccccgugcagagcgcccccaucgggcggcgcccccucuuccuggacuccaucgucaagggcacgaagaaccugcucaacagcaccucccuggagaccagccuguccaucgaggcccccuggggcgccaucaacgugcagagcaccuacaagcccacgguguccaccgcgaacaucgcccucagcugguccagcgucgagcaccgggggaacaagauccugguguccggccgcagcgaguccaucaugaagcuggaggagcggaccgggaucagcugggaccucggcguggaggacgccuccgagagcaagcugcugaccgucagcgugauggaccucucccagauguacagccccgucuucgaguaccuguccggggaccgccagguggaggaguggccgaaggccacgugcaccggcgacugccccgagcgcugcggcugcaccagcuccacgugccugcacaaggaguggccccacagccggaacuggcgcugcaaccccaccuggugcuggggcguggggaccgggugcacgugcugcggccucgacgucaaggaccuguucaccgacuacauguucgugaaguggaagguggacuacaucaagaccgaggccaucgucugcguggagcugaccucccaggagcggcagugcagccugguggaggcggggacccgcuucaaccucggcccggucaccaucacccuguccgagccccggaacauccagcagaagcugccgcccgagaucaucacgcuccacccgcgcaucgaggagggcuucuucgaccugaugcacgugcagaaggugcugagcgccuccaccgucugcaagcuccagagcugcacccacggggugcccggcgaccuccagguguaccacaucgggaaccugcugaagggcgacaaggucaacggccaccugauccacaagaucgagccccacuucaacaccuccuggaugagcugggacgggugcgaccuggacuacuacugcaacaugggcgacuggcccuccugcacguacaccggggugacccagcacaaccacgccagcuucgugaaccuccugaacaucgagaccgacuacacgaaguccuuccacuuccacagcaagcgggucaccgcccacggcgacaccccgcagcuggaccucaaggcccgccccaccuacggggcgggcgagaucacggugcugguggaggucgccgacauggagcugcacaccaagaagaucgagaucaccggccucaaguucgccagccugaccugcacggggugcuacgccugcuccagcggcaucuccugcaaggugcggauccacguggacgagcccgacgagcugaccguccacgucaagagcgacgacccggacgugguggccgcguccagcucccucauggcccgcaagcuggaguucgggaccgacagcaccuucaaggccuucuccgccaugcccaagacgagccugugcuucuacaucguggagcgggaguacugcaaguccugcagcaaggaggacacccagaagugcgugaacaccaagcucgagcagccccaguccauccugaucgagcgcaagggcaccaucaucgggaagcagaacaacacgugcaccgcgaaggccagcugcuggcuggaguccgucaagagcuucuucuacggccucaagaacaugcuguccggcaucuucgggaacguguucgugggcaucuuccuguuccucgcccccuucauccugcugauccucuucuucauguucggguggcggauccuguucugcuucaagugcugccgccggacccgcggccuguucaaguacaagcaccucaaggacgacgaggagaccggguaccggcgcaucaucgagcggcugaacaacaagaagggcaagaacaagcugcucgacggcgagcgccuggccgaccgccggaucgccgagcuguucagcacgaagacccacaucggg

SEQ ID NO: 12214 - RNA, 2916 nt, Artificial Sequence
  derived and/or modified CDS sequence (opt1) from CCHFV(Kosovo/9553/2001, Artificial)__AY675511.1__Gn-4aa-Gc
agcgaggagcccggcgacgacugcaucucccgcacccagcuccuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucgcccggaugagcaaccaccccaagaccaccauggccuuccuguucugguucucccugggcuacgugaucacgugcauccucugcaaggcccuguucuacagccugaucaucaucggcacccucgggaagaagaucaagcaguaccgcgagcugaagccccagaccugcaccaucugcgagaccgcgcccgugaacgccaucgacgccgagaugcacgaccugaacugcuccuacaacaucugcccguacugcgccagccggcucacguccgacggccuggcgcgccacgucaagcagugccccaagcggaaggagaagguggaggagaccgagcuguaccucaaccuggagcgcauccccugggugguccggaagcugcuccaggugagcgaguccaccgggguggcccugaagcgcagcagcuggcugaucguccuccuggugcugcucaccgugucccugagccccguccaguccgccccggugggccggaagccccuguuccucgacagcaucgugaaggggaugaagaaccugcugaacuccacgagccucgagaccucccugagcaucgaggcccccuggggcgccaucaacguccaguccaccuucaagcccaccgugagcacggcgaacaucgcccuguccuggagcuccguggagcaccgcggcaacaagauccucgucaccgggcggagcgaguccaucaugaagcuggaggagcgcaccggcgugagcugggaccugggggucgaggacgccuccgagagcaagcuccugaccguguccaucauggaccugagccagauguacagcccgguguucgaguaccucuccggcgaccggcaggucgaggaguggcccaaggccacgugcaccggggacugccccgagcgcugcggcugcaccagcuccacgugccugcacaaggaguggccccacagccggaacuggcgcugcaacccgaccuggugcuggggcguggggaccggcugcacgugcugcgggguggacgucaaggaccuguucaccgaccacauguucgugaaguggaagguggaguacaucaagaccgaggccaucgucugcguggagcugaccucccaggagcgccagugcagccucaucgaggcgggcacccgguucaaccuggggcccgugaccaucacccuguccgagccccgcaacauccagcagaagcugcccccggagaucaucacgcuccaccccaagaucgaggagggcuucuucgaccugaugcacguccagaaggugcucagcgccuccaccgugugcaagcugcagagcugcacccacggcauccccggggaccugcaggucuaccacaucggcaaccuccugaagggggaccgggugaacggccaccugauccacaagaucgagccccacuucaacaccuccuggaugagcugggacggcugcgaccucgacuacuacugcaacaugggggacuggccguccugcacguacaccggcgugacccagcacaaccacgccgccuucgucaaccugcugaacaucgagaccgacuacacgaagaccuuccacuuccacagcaagcgcgugaccgcccacggggacacgccccagcucgaccugaaggcgcggcccaccuacggcgccggggagaucaccgugcuggucgagguggccgacauggagcuccacaccaagaagguggagaucuccggccugaaguucgccagccuggccugcaccggcugcuacgcgugcuccagcgggaucagcugcaagguccgcauccacguggacgagccggacgagcucacggugcacgucaaguccagcgaccccgacgugguggccgccuccaccagccugauggcccggaagcuggaguucggcaccgacuccaccuucaaggcguucagcgccaugcccaagacgucccucugcuucuacaucgucgagaaggaguacugcaagagcugcuccgaggacgacaccaagaagugcguggacaccaagcuggagcagccccagagcauccugaucgagcaccgcgggaccaucaucggcaagccgaacgacacgugccccgccaagaccuccugcuggcucgagagcgugaaguccuucuucuacgggcugaagaacaugcugggcagcgucuucggcaacuucuucaucgggauccuccuguuccuggcccccuucuuccucuggaugcuguccuucauguucggcuggaagauccuguucugcuucaagugcugccggcgcacccggggccucuucaaguaccgccaccugaaggacgacgaggagaccggguaccggcgcaucaucgagcggcugaacaacaagaaggggaagaaccgccuccuggacggcgagcggcuggccgaccgcaagaucgcggagcuguucagcacgaagacccacaucggc

SEQ ID NO: 12215 - RNA, 2916 nt, Artificial Sequence
  derived and/or modified CDS sequence (opt1) from CCHFV(SPU41/84, Artificial)__AY900142.1__Gn-4aa-Gc
agcgaggaguccagcgacgacugcaucucccgcacccagcugcuccggaccgagacggccgagauccacggcgacaacuacgggggccccggggacaagaucaccaucugcaacggcagcaccguggucgaccagcgccugggguccgagcugggcugcuacaccaucaaccgggugaagacguucaagcucugcgagaacagcgccaccggcaaguccugcgagaucgacagcgugccggucaagugccgccagggguacugccugaagaucacccaggagggccgggggcacgugaagcugucccgcggcagcgaggugguccucgacgcgugcgacaccuccugcgaggugaugauccccaaggggacgggcgacauccugguggacugcagcggcgggcagcagcacuuccugaaggacaaccucaucgaccugggcugccccaagaucccccugcucgggaagauggccaucuacaucugccggauguccaaccacccgaagaccaccauggccuuccuguucugguucagcuucggcuacgucaucacgugcaucaucugcaaggugaucuucuaccugcucaucaucgugggcacccuggggaagcgcuucaagcaguaccgggagcugaagccccagaccugcaccaucugcgagaccacgcccgucaacgccaucgacgccgagaugcacgaccucaacugcuccuacaacaucugccccuacugcgcgagccgccugaccuccgacggccuggcccggcacgugacccagugcccgaagcgcaaggagaagguggaggagaccgagcucuaccugaaccuggagcggauccccugggucgugcgcaagcuccuccaggugagcgaguccacgggggucgcccugaagcggagcagcuggcugguggugcugcugguccuccugaccgugucccugagccccgugcaguccgcccccaucagccgccggccccucuuccuggacuccaucgucaagggcaugaagaaccugcucaacagcaccucccuggagaccagccuguccaucgaggcgcccuggggcgccaucaacgugcagagcacguacaagcccaccgucuccaccgccaacaucgcccucagcugguccagcguggagcaccgcgggaacaagauccugguguccggccggagcgaguccaucaugaagcuggaggagcgcaccgggaucagcugggaccucggcgucgaggacgccuccgagagcaagcugcugacggugagcgugauggaccucucccagauguacagccccgucuucgaguaccuguccggggaccgccagguggaggaguggccgaaggcgaccugcaccggcgacugccccgagcggugcgggugcaccagcuccacgugccugcacaaggaguggccccacagccgcaacuggcggugcaaccccaccuggugcuggggcgugggcaccgggugcacgugcugcggccucgacgucaaggaccuguucaccgacuacauguucgugaaguggaagguggaguacaucaagaccgaggccaucgucugcguggagcugaccucccaggagcgccagugcagccugaucgaggccgggacccgguucaaccucggcccggugaccaucacgcuguccgagccccgcaacauccagcagaagcugccgcccgagaucaucacccuccacccgcggaucgaggagggguucuucgaccugaugcacguccagaaggugcugagcgccuccaccgugugcaagcuccagagcugcacccacggcguccccggcgaccuccagguguaccacaucgggaaccugcugaagggcgacaaggugaacgggcaccugguccacaagaucgagccccacuucaacacguccuggaugagcugggacggcugcgaccuggacuacuacugcaacaugggcgacuggcccuccugcaccuacaccggggugacccagcacaaccacgccagcuucgugaacaugcucaacaucgagacggacuacaccaagaacuuccacuuccacuccaagcgcgucaccgcgcacggcgacaccccgcagcuggaccugaaggcccggcccacguacggggccggcgagaucaccgugcucguggaggucgccgacauggagcugcacaccaagaagaucgagaucagcgggcugaaguucaccagccucacgugcaccggcugcuacgccugcuccagcggcaucuccugcaaggugcgcauccacguggacgagcccgacgagcugaccguccacgucaagagcgaggacccggacgugguggcggccuccagcucccugauggcccggaagcucgaguucgggaccgacagcacguucaaggccuucuccgccaugcccaagaccagccugugcuucuacaucguggagcgcgaguacugcaaguccugcagcgaggaggacacccagaagugcgugaacaccaagcuggagcagccccaguccauccucaucgagcggaagggcacgaucaucgggaagcagaacaacacgugcaaggcgaaggccggcugcuggcuggagagcgucaaguccuucuucuacgggcugaagaacaugcucagcggcaucuucggcaacguguucaucgggaucuuccuguuccuggcccccuucauccuccugauccuguucuucauguucggcuggcgcauccucuucugcuucaagugcugccggcgcacccgggggcuguucaaguaccgccaccugaaggacgacgaggagaccggcuaccggaagaucaucgagcgccucaacaacaagaaggggaagaacaagcugcuggacggcgagcggcucgccgaccgccgcaucgcggagcuguucuccaccaagacccacaucggc

SEQ ID NO: 12216 - RNA, 2916 nt, Artificial Sequence
  derived and/or modified CDS sequence (opt1) from CCHFV(UG3010, Artificial)__AY900143.1__Gn-4aa-Gc
gccgagggcgugagcaacgacugcgugucccgcacccagcugaucaagaccgagguggccgagauccacgaggacagcuacgggggccccggggagaagaucacgaucugcaacggcuccaccaucguggaccagcggcucgggagcgagcugggcugcuacaccaucaaccgcgucaagaccuacaagcugugcgagaacuccgcgacggagaagggcugcgagaucgacagcgugccggugaagugcaagcagggguucugccucaaggucacccaggagggccgggggcacgugaagcugucccgcggcaccgagaucgugcuggacgucugcgacaccagcugcgagcucaugauccccaaggggacgggcgacauccugguggacugcuccggcgggcagcagcacuuccugcaggacaaccucaucgaccugggcugccccaacgugccccugcucgggaagauggccaucuacaucugccggaugagcaaccacccgaagaccaccauggccuuccuguucugguucuccuucggcuacgucaucacgugcaucgugugcaaggugcuguucuaccuccugaucgucaucggcacccugagcaagaagcucaagcaguaccgcgagcugaagccccagaccugcaucgugugcgaguccacccccgugaacgccaucgacgccgagaugcacgagcugaacugcaacuacaacaucugccccuacugcgcgagccggcucaccuccgacgggcugguccgccacgugaaccagugcccgaagcggaaggagaagguggaggagacggagcuguaccucaaccuggagcgcauccccuggcugguccggcgccuccuccaggugagcgaguccaccggcauggcccugaagcggagcugcuggaugaccacccuccugauccugcucguggucucccugagccccgugcagagcgcccccgucgggcgcaagccgcuguaccucgacuccaucgccaagggcaugaagucccugcugaacagcacgaaccucgagaccagccuguccaucgaggcgcccuggggcgccaucaacgugcagagcaccuucaagcccaccguguccgccgccaacaucgcccugagcugguccagcgucgagcaccgggggaacaagauccucguguccggccgcagcgaguccaucaugaagcuggaggagcggacggggaucagcuggucccugggcguggaggacgcgagcgaguccaagacccucaccgucagcgugauggaccugucccagauguacagccccguguucgaguaccugagcggggaccgccaggucgaggaguggccgaaggcgaccugcacgggcgacugccaggagcggugcgggugcaccuccagcacgugccuccacaaggaguggccccacucccgcaacuggcggugcaaccccaccuggugcuggggcgugggcaccgggugcacgugcugcggccuggacgugcgcgaccuguucaccgacuacaugauggucaaguggaagguggaguacgugaagaccgaggccaucaugugcgucgagcugaccagccaggagcgccagugcucccucaucgaggccgggacccgguucaaccugggccccgugaccaucacccugagcgagccgcgcaacauccagcagcggcuccccuccgagaucgugacccugcaccccaagaucgaggagggguucuucgaccugaugcacguccagaaggugcucagcgccuccacggugugcaagcugcagagcugcacccacggcguccccggcgaccuccagguguaccacguggggaaccuccugaagggcgacaaggucaacgggcacuccauccacaagaucgagagccacuucaacaccuccuggaugagcugggacggcugcgaccuggacuacuucugcaacaugggcgacuggccguccugcaccuacacgggggugacccagcacaaccgcgccgccuucaucaacaugcucaacaucgagaccgacuacaccaagacguuccacuuccacagcaagcgggugaccgcccacggcgacacgccccagcuggaccugaaggcccgccccaccuacggggccggcgaggucaccgugcucguggaggucgcggaccuggagcugcacaccaagaagaucgagguguccgggcucaaguucgccagccugaccugcagcggcugcuacgccugcuccagcggcaucuccugcaaggugcggauccacgucaacgagcccgacgaguucaccgugcacgucaagagcuccgacccggacgugguggccgccgggagcucccugauggcgcgcaagaucgaguucggcgccgacagcacguucaaggccuucuccagcaugcccaagaacucccucugcuucuacaucguggagcgggacuacugcagcuccugcaccaacgacgacacccagaagugcgucgacaccaagcuggagcacccccagagcauccugaucgagcacaaggggacgaucaucggcaagcagaacgacacgugcuccaccaagaccagcugcuggcucgaguccgucaagagcuucuucuacgggcugaagaacaugcugggcggcaucuucgggaacguguuccucggcaucuuccuguuccuggccccguucgcgcuccugaucuucuucuucuucuucggguggcgccugcuguucugccugaagugcugccggcgcacccggggccugcucaaguacaagcagcugaaggacgaggaggaggccggguacaagaagaucaucgagcgccugaacgacaagaagggcaagucccggcuguucgacggcgagcgccuggccgaccggaagaucgccgagcuguucagcaccaagacccacaucggg

SEQ ID NO: 12217 - RNA, 2916 nt, Artificial Sequence
  derived and/or modified CDS sequence (opt1) from CCHFV(Hy13, Artificial)__AY900145.1__Gn-4aa-Gc
agcgaggaguccggcgacgacugcaucagccgcacccagcugucccggaccgagacggccgagauccacagcgacaacuacgggggccccggggacaagaucaccaucugcaacggcuccaccaucguggaccagcgccucgggagcgagcugggcugcuacaccaucaaccgggucaaguccuucaagcugugcgagaacagcgccacgggcaaguccugcgagaucgacagcaccccgaucaagugccgccagggguucugccucaagaucacccaggagggccgggggcacgugaagcugucccgcggcagcgaggugguccuggacgcgugcgacuccagcugcgagaucaugauccccaaggggaccggcgacauccucguggacugcuccggcgggcagcagcacuuccugaaggacaaccugaucgaccucggcugccccaacaucccccugcuggggaagauggccaucuacaucugccggaugagcaaccacccgaagacgaccauggccuuccucuucugguucuccuucggcuacgugaucaccugcauccugugcaaggucaucuucuaccugcucaucguggugggcacccuggggaagaaguucaagcaguaccgcgagcugaagccccagacgugcaccaucugcgagaccacccccgucaacgccaucgacgccgagaugcacgaccucaacugcagcuacaacaucugccccuacugcgcgucccggcugacgagcgacggccuggcccgccacgugaugcagugcccgaagcggaaggagaagguggaggagaccgagcucuaccugaaccuggagcgcauccccugggucgugcggaagcuccugcaggugagcgaguccaccggggucgcccugaagcgcagcuccuggcucguggugcugcugguccuccugaccgugagccugucccccgugcagagcgcccccaucggccggaagccgcucuucuccgacagcaucgucaaggggaugaagaaccugcugaacuccacgagccucgagaccucccugagcaucgaggcgcccuggggcgccaucaacgugcaguccaccuucaagcccaccgugagcgccgccaacaucgcccuguccuggagcuccgucgagcaccgcggcaacaagauccucgugagcgggcgguccgagagcaucaugaagcuggaggagcgcacgggcaucagcugggaccugggggucgaggacgcguccgagagcaagcuccugaccguguccaucauggaccugagccagauguacucccccguguucgaguaccucagcggcgaccggcaggucgaggaguggccgaaggccaccugcaccggggacugccccgagcgcugcggcugcacguccagcaccugccugcacaaggaguggccccacucccggaacuggcgcugcaaccccaccuggugcuggggcguggggaccggcugcacgugcugcgggcuggacgugaaggaccucuucaccgaccacauguucgucaaguggaagguggaguacaucaagaccgaggccaucgugugcgucgagcugaccagccaggagcgccagugcucccugaucgaggccggcacgcgguucaaccuggggccggugaccaucacccucagcgagccccgcaacauccagcagaagcugccccccgagaucgugacccugcacccgcggaucgaggagggcuucuucgaccucaugcacgucaagaaggugcuguccgccagcaccgugugcaagcugcaguccugcacgcacggcguccccggggaccuccagguguaccacaucggcaaccugcugaagggggacaaggugaacggccaccucauccacaagaucgagccccacuucaacaccagcuggauguccugggacggcugcgaccuggacuacuacugcaacaugggggacuggcccagcugcagcuacaccggcgucacccagcacaaccacgcggccuucgugaacaugcugaacaucgagacggacuacaccaagaucuuccacuuccacuccaagcgcgugaccgcccacggggacaccccgcagcucgaccugaaggcccggcccacguacggcgccggggagaucaccguccugguggagguggcggacauggagcuccacaccaagaagaucgagaucagcggccugaaguucgccucccugaccugcacgggcugcuacgccugcagcuccgggaucagcugcaagguccgcauccacguggacgagcccgacgagcucaccgugcacgucaaguccgaggacccggacaucguggccgccagcuccagccugauggcgcggaagcuggaguucggcaccgacuccaccuucaaggccuucagcgccaugcccaagacgucccucugcuucuacaucguggagcgcgaguacugcaagagcugcuccaaggaggacacccagaagugcgucaacaccaagcuggagcagccccagagcauccugaucgagcacaaggggaccaucaucggcaagcagaacgacacgugcaccuccaaggccgggugcuggcucgagagcgugaaguccuucuucuacggccugaagaacaugcugagcggcaucuucgggaacguguucaucggcaucuuccucuuccuggcgcccuucauccugcucauccuguucuucauguucggguggcggauccuguucugcuucaagugcugccgccggacccgcggccucuucaaguaccggcaccugaaggacgacgaggagaccggguaccgcaagaucaucgagcggcugaacaacaagaagggcaagaacaagcuccuggacggcgagcgccuggccgaccggaagaucgccgagcucuucagcacgaagacccacaucggg

SEQ ID NO: 12218 - RNA, 2916 nt, Artificial Sequence
  derived and/or modified CDS sequence (opt1) from CCHFV(Semunya, Artificial)__DQ094832.1__Gn-4aa-Gc
gccgagggcgugagcaacgacugcgucucccgcacccagcugaucaagaccgagguggccgagauccacgaggacagcuacgggggccccggggagaagaucacgaucugcaacggcuccaccaucguggaccagcggcucgggagcgagcugggcugcuacaccaucaaccgcgucaagaccuacaagcugugcgagaacuccgcgacggagaagggcugcgagaucgacagcgugccggugaagugcaagcagggguucugccucaaggucacccaggagggccgggggcacgugaagcugucccgcggcaccgagaucgugcuggacgucugcgacaccagcugcgagcucaugauccccaaggggacgggcgacauccugguggacugcuccggcgggcagcagcacuuccugcaggacaaccucaucgaccugggcugccccaacgugccccugcucgggaagauggccaucuacaucugccggaugagcaaccacccgaagaccaccauggccuuccuguucugguucuccuucggcuacgucaucacgugcguggugugcaagguccuguucuaccuccugaucgugaucggcacccuggggaagaagcucaagcaguaccgcgagcugaagccccagaccugcaucgugugcgagagcauccccgucaacgccaucgacgccgagaugcacgagcugaacugcaacuacaacaucugccccuacugcgcgucccggcucaccagcgacggccuggugcgccacgugacccagugcccgaagcggaaggagaaggucgaggagacggagcuguaccucaaccuggagcgcauccccuggcuggugcggcgccuccuccagguguccgagagcaccgggauggcccugaagcgguccugcuggaugaccacccuccugauccugcucgucgugagccugucccccguccagagcgcccccgugggccgcaagccgcuguuccucgacagcaucgccaaggggaagaagucccugcugaacagcacgaaccucgagaccucccugagcaucgaggcgcccuggggcgccaucaacgugcaguccaccuucaagcccaccgucagcgccgccaacaucgcccuguccuggagcuccguggagcaccggggcaacaagauccucgugagcgggcgcuccgagagcaucaugaagcuggaggagcggacgggcaucuccuggagccugggggucgaggacgcguccgagagcaagacccucaccguguccgugauggaccugagccagauguacucccccgucuucgaguaccugagcggcgaccgccagguggaggaguggccgaaggcgaccugcacgggggacugccccgagcggugcggcugcaccagcuccacgugccuccacaaggaguggccccacagccgcaacuggcggugcaaccccaccuggugcuggggcguggggaccggcugcacgugcugcgggcuggacguccgcgaccuguucaccgacuacaugauggugaaguggaagguggaguacgucaagaccgaggccaucaugugcguggagcugaccucccaggagcgccagugcagccucaucgaggccggcacccgguucaaccuggggccggugaccaucacccuguccgagccccgcaacguccagcagcggcuccccagcgagaucgugacccugcaccccaagaucgaggagggcuucuucgaccugaugcacgugcagaagguccucuucugcaaguacucccugcaggccacgagcugcacccacggcgugccgggggaccuccagguguaccacgucggcaaccugcugaagggggacaaggugaacggccacuccauccacaagaucgagagccacuucaacaccuccuggaugagcugggacggcugcgaccuggacuacuucugcaacaugggggacuggcccuccugcaccuacacgggcgugacccagcacaaccgcgccgccuucgucaacaugcucaacaucgagaccgacuacaccaagacguuccacuuccacagcaagcgggugaccgcccacggggacacgccccagcuggaccugaaggcccgccccaccuacggcgccggggaggugaccguccucguggagguggcggaccuggagcugcacaccaagaagaucgaggucuccggccucaaguucgccagccugaccugcuccggcugcuacgccugcagcagcgggaucuccugcaaggugcggauccacgugaacgagccggacgaguucaccguccacgucaagagcaacgaccccgacgugguggccgccggcuccagccugauggcgcgcaagaucgaguucggggccgacuccacguucaaggccuucagcuccaugcccaagaacagccucugcuucuacaucguggagcgggacuacugcuccagcugcaccgacgacgacacccagaagugcgugaacaucaagcuggagcacccgcaguccauccugaucgagcacaagggcaccaucaucgggaagcagaacgacacgugccccaccaagaccagcugcuggcucgaguccgucaagagcuucuucuacggccugaagaacaugcugggcgggaucuucggcaacguguuccucgggaucuuccuguuccuggcccccuucgcgcuccugauccuguucuucuucuucggcuggcgccuccuguucugccugaagugcugccggcgcacccgggggcuccugaaguacaagcagcugaaggacgaggaggaggccggcuacaagaagaucaucgagcgccucaacgacaagaagggcaagucccggcuguucgacggggagcgccuggccgaccggaagaucgccaagcuguucagcacgaagacccacaucggc

SEQ ID NO: 12219 - RNA, 2916 nt, Artificial Sequence
  derived and/or modified CDS sequence (opt1) from CCHFV(SPU128/81/7, Artificial)__DQ157174.1__Gn-4aa-Gc
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggucaaguccuucaagcucugcgagaacagcgccacgggcaaguccugcgagaucgagagcgugcccgugaagugccgccagggguacugccugcggaucacccaggagggccgcgggcacgucaagcugucccggggcagcgagguggugcucgacgcgugcgacaccuccugcgagaucaugauccccaaggggaccggcgacauccuggucgacugcagcggcgggcagcagcacuuccugaaggacaaccucaucgaccugggcugccccaagaucccgcugcucgggaagauggccaucuacaucugccgcauguccaaccaccccaagacgaccauggccuuccuguucugguucagcuucggcuacgugaucacgugcauccugugcaaggccaucuucuaccuccugaucaucaucggcacccuggggaagcgguucaagcaguaccgcgagcucaagccccagaccugcaccaucugcgagaccacccccgugaacgccaucgacgcggagaugcacgaccugaacugcuccuacaacaucugcccguacugcgccagccggcugacguccgacggccucgcccgccacgucacccagugccccaagcggaaggagaagguggaggagaccgagcuguaccugaaccucgagcgcauccccugggugguccggaagcugcuccaggugagcgaguccaccgggguggcccucaagcgcagcagcuggcugaucguccugcucgugcuguucacggugucccugagccccguccaguccgcgccgaucggccggaagccccucuuccuggacagcaucgugaaggggaugaagaaccugcucaacuccaccagccuggagaccucccugagcaucgaggcccccuggggcgccaucaacgugcaguccaccuacaagcccacggucagcaccgccaacaucgcccucuccuggagcuccguggagcaccgcggcaacaagauccuggugagcgggcgguccgagagcaucaugaagcuggaggagcgcaccggcaucuccugggaccucggggucgaggacgcgagcgaguccaagcugcugaccgugagcgucauggaccucagccagauguacuccccgguguucgaguaccugagcggcgaccgccagguggaggaguggcccaaggccacgugcaccggggacugccccgagcggugcggcugcaccuccagcacgugccugcacaaggaguggccccacucccgcaacuggcggugcaacccgaccuggugcuggggcgucgggaccggcugcacgugcugcgggcucgacgugaaggaccuguucaccgacuacauguucgugaaguggaaggucgaguacaucaagaccgaggccaucgugugcguggagcugaccagccaggagcgccagugcucccugaucgaggccggcacccgguucaaccucgggcccgucaccaucacccugagcgagccccgcaacauccagcagaagcugcccccggagaucaucacgcuccacccccggaucgaggagggcuucuucgaccugaugcacgugcagaaggugcuguccgccagcaccgucugcaagcuccaguccugcacccacggcgugcccggggaccuccagguguaccacaucggcaaccugcugaagggggacaaggucaacggccaccugauccacaagaucgagccccacuucaacaccagcuggauguccugggacggcugcgaccuggacuacuacugcaacaugggggacuggccgagcugcacguacaccggcgugacccagcacaaccacgcguccuucgugaaccuccugaacaucgagaccgacuacacgaagaacuuccacuuccacagcaagcgcgucaccgcccacggggacacgccccagcuggaccucaaggcccggcccaccuacggcgccggggagaucaccgugcugguggaggucgccgacauggagcugcacaccaagaagaucgagaucuccggccucaaguucgcgagccugaccugcaccggcugcuacgccugcagcuccgggaucagcugcaaggugcgcauccacguggacgagccggacgagcugacgguccacgugaaguccgacgaccccgacguggucgccgccagcuccagccucauggcccggaagcuggaguucggcaccgacuccaccuucaaggcguucagcgccaugcccaagaccucccugugcuucuacaucguggagcgcgagcacugcaagagcugcuccgaggaggacacgaagaagugcgugaacaccaagcucgagcagccccagagcauccugaucgagcacaaggggaccaucaucggcaagcagaacuccacgugcaccgccaaggccagcugcuggcuggaguccgucaagagcuucuucuacgggcucaagaacaugcuguccggcaucuucggcaacguguucaucgggaucuuccuguuccucggcccguucauccugcugauccucuucuucauguucggguggcggauccuguucugcuucaagugcugccgccggacccgcggccugcucaaguaccggcaccugaaggaggacgaggagaccggguaccgccggaucaucgagcgccugaacaacaagaagggcaagaacaagcuccuggacggcgagcggcuggcggaccgccgcaucgccgagcuguucagcaccaagacgcacaucggg

SEQ ID NO: 12220 - RNA, 2916 nt, Artificial Sequence
  derived and/or modified CDS sequence (opt1) from CCHFV(ROS/HUVLV-100, Artificial)__DQ206448.1__Gn-4aa-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugaccgugucccugagcccggugcaguccgcccccgucggccgcaagccccucuuccuggacagcaucgugaaggggaugaagaaccugcucaacuccacgagccuggagaccucccugagcaucgaggcccccuggggcgccaucaacgugcaguccaccuucaagccgaccgucagcacggccaacaucgcgcucuccuggagcuccguggagcaccggggcaacaagauccuggugaccgggcgcagcgaguccaucaugaagcuggaggagcggaccggcgucagcugggaccucgggguggaggacgccuccgagagcaagcugcugaccgucuccaucauggaccucagccagauguacagccccguguucgaguaccuguccggcgaccgccagguggaggaguggcccaaggccacgugcaccggggacugccccgagcggugcggcugcaccagcuccacgugccugcacaaggaguggccgcacagccgcaacuggcgcugcaaccccaccuggugcuggggcgucgggaccggcugcacgugcugcgggguggacgugaaggaccucuucaccgaccacauguucgucaaguggaagguggaguacaucaagaccgaggccaucgugugcgucgagcugaccucccaggagcggcagugcagccugaucgaggccggcacccgcuucaaccuggggcccgugaccaucacccucuccgagccccggaacauccagcagaagcugccgcccgagaucaucacgcugcaccccaagguggaggagggcuucuucgaccucaugcacguccagaaggugcugagcgcguccaccgugugcaagcugcagagcugcacccacggcauccccggggaccuccaggucuaccacaucggcaaccugcugaagggggaccgcgugaacggccaccucauccacaagaucgagccgcacuucaacaccuccuggaugagcugggacggcugcgaccuggacuacuacugcaacaugggggacuggcccuccugcacguacaccggcgugacccagcacaaccacgccgccuucgucaaccugcucaacaucgagaccgacuacacgaagaccuuccacuuccacagcaagcgggugaccgcccacggggacacgccccagcuggaccugaaggcccgcccgaccuacggcgcgggggagaucaccgugcucgucgagguggccgacauggagcugcacaccaagaagguggagaucuccggccugaaguucgccagccucgccugcaccggcugcuacgccugcuccagcgggaucagcugcaagguccggauccacguggacgagcccgacgagcugacggugcacgucaaguccagcgaccccgacgugguggcggccuccaccagccugauggcccgcaagcucgaguucggcaccgacuccaccuucaaggccuucagcgcgaugcccaagacgucccugugcuucuacaucgucgagcgggaguacugcaagagcugcuccgaggaggacacccagaagugcguggacaccaagcuggagcagccgcagagcauccucaucgagcacaaggggaccaucaucggcaagcagaacgacacgugcaccgccaaggccuccugcuggcuggagagcgugaaguccuucuucuacgggcugaagaacaugcucggcagcgucuucggcaacuucuucaucgggauccugcuguuccucgcccccuucgugcugcuggugcuguucuucauguucggcuggaagauccucuucugcuucaagugcugccgccggacccgcgggcugcucaaguaccggcugcugaaggacgacgaggagaccggcuaccgccggaucaucgagcgccucaacaacaagaaggggaagaaccggcugcuggacggcgagcgccucgccgaccggaagaucgcggagcuguucuccacgaagacccacaucggc

SEQ ID NO: 12221 - RNA, 2916 nt, Artificial Sequence
  derived and/or modified CDS sequence (opt1) from CCHFV(AP92, Artificial)__DQ211625.1__Gn-4aa-Gc
agcgagggcggggacggcgggugcaucucccgcacccagcugaucaagaccgagacggccgaggugcacggcgacgacuacgggggccccggcgagaagaucaccaucugcaacgggagcaccaucgucgaccagcggcucggcuccgagcuggggugcuacaccaucaaccgcaucaagagcuucaagcugugcgagaacuccgcccagggcaagaacugcgagaucgacagcgcgccggugcagugccggcagggguacugccucaagaucucccaggagggccgcggccacgugaagcugagccggggguccgagaucguccuggacgugugcgacacgagcugcgagaucaugauccccaagggcaccggggacauccucguggacugcuccggcggccagcagcacuuccugcagagcaaccuggucgaccucgggugccccaacaucccccugcugggcaagauggccaucuacaucugccgcauguccaaccacccgaagaccaccauggccuuccucuucugguucagcuucggguacgugaucacgugcauccugugcaagacccuguucuacauccucaucaucaucggcacccuggggaagaagcugaagcaguaccgggagcucaagccccagaccugcacgaucugcgaguccgugcccgucaacgccaucgacgccgagaugcacgaccugaacugcagcuacaacaucugccccuacugcgcgucccgccugaccagcgagggccucacccggcacgugaaccagugcccgaagcgcaaggagaagguggaggagaccgagcuguaccugaaccucgagcggauccccuggaucguccgcaagcugcuccagguguccgagagcacgggcguggcccucaagcggagcuccuggaugaucguccugcugauccuccugaucgugagcaugucccccgugcagagcgcccccaucucccgcaagccgcuguuccucgacagcaucgccaagggggucaagaaccugcugaacuccaccagccucgagaccucccugagcaucgaggcgcccuggggcgccaucaacgcccaguccaccuacaagcccacggccagcuccgccaacaucgcgcugaccuggagcuccguggagcaccgggggaacaagauccucgugagcggccgcuccgagagcaucaugaagcuggaggagcggaccgggaucuccuggaaccugggcgucgaggacgccagcgagagccgcacccucacgaucuccgugauggaccugagccagauguacucccccguguucgaguaccugagcggcgaccggcaggucgaggaguggccgaaggcgaccugcaccgggaacugccccgagcgcugcggcugcaccuccagcacgugccucuacaaggaguggccccacucccggaacuggcgcugcaaccccaccuggugcuggggcguggggaccgggugcacgugcugcggccuggacgucaaggagcuguucaccgaccacaugcucgugaaguggaagguggaguacaucaagaccgaggccaucgucugcguggagcugaccagccaggagcgccagugcucccugaucgaggccggcacccgguucagccuggggccggugacgaucacccucuccgagccccgcaacauccagcagaagcugccgcccgagcugaucacccuccaccccaagaucgaggacggcuacuucgaccugaugcacguccagaaggugaugagcgccuccaccgugugcaagcugcagagcugcacccacgggguccccggcgaccuccagaucuaccacgugggcaaccugcugaagggggaccgggugaacggccaccucauccacaaggucgagccccaccugaacacguccuggaugagcugggacgggugcgaccuggacuacuucugcaacaugggcgacuggcccuccugcaccuacaccggggugacccagcacaaccacgccgccuucgccaaccuccugaacaucgagacggacuacaccaagaccuuccacuuccacagcaagcgcgugaccgcccacggcgacacgccgcagcuggaccucaaggcgcggccccgcuacggcgccggggagaucaccguccugguggagguggccgacauggagcugcacaccaagaaggucgaggugaccggccucaaguucgccagccugacgugcuccgggugcuacgccugcagcuccggcaucagcugcaaggugcggauccacgucgacgagcccgacgagcugaccgugcacgugaaguccagcgacccggacaucgucgcggccuccagcucccucauggcccgcaagaucgaguucgggguggacagcaccuucaaggccuucuccagcaugcccaaggacucccugugcuucuacaucguggagcgggacuacugcaacagcugcaagaacgaggagacccagcgcugcgucaacgcgaagcuggagcagccccaguccauccucaucgagcacacgggcaccaucaucggcaagcagaacgacacgugcgggagccggaccuccugcuggcuggacagcuucaaguccuucuucuacggccucaagagcaugcugagcgggaucuucggcaacguguuccuggggaucuuccuguuccucgcccccuucgcccugcugcuguucuucuucuucuucggcuggcgcauccuguucugcuucaagugcugccggcgcacccggggccuguucaaguaccgccacaucaaggacgacgaggaggugggguacaagaagaucaucgagcggcucaacaacaagaagggcaagcaccgccugcuggacggggagcggcucgccgaccgcaagaucgccgagcuguucuccaccaagacccacaucggc

SEQ ID NO: 12222 - RNA, 2916 nt, Artificial Sequence
  derived and/or modified CDS sequence (opt1) from CCHFV(ArD8194, Artificial)__DQ211626.1__Gn-4aa-Gc
gccgagggcgggagcaacgacugcgugucccgcacccagcuggucaagaccgagguggccgagauccacgaggacagcuacggcgggcccggcgagaagaucacgaucugcaacggguccaccaucguggaccagcggcucggcagcgagcugggcugcuacaccaucaaccgcguccggaccuacaagcugugcgagaacuccgcgacggagaaguccugcgagaucgacagcgugccggugaagugcaagcagggguucugccucaagaucacccaggagggccgcgggcacgucaagcugagccggggcaccgagaucgugcuggacgugugcgacaccuccugcgagcucaugauccccaaggggacgggcgacauccuggucgacugcagcggcgggcagcagcacuuccugcaggacaaccucaucgaccugggcugccccaacaucccccugcucgggcgcaccgccaucuacgugugccggauguccaaccacccgaagaccaccauggccuuccuguucugguucagcuucggcuacgugaucacgugcgucgugugcaaggugcuguucuaccuccugaucgucaucggcacccuggggaagcgccucaagcaguaccgggagcugaagccccagaccugcaucgugugcgaguccauccccgugaacgccaucgacgccgagaugcacgaccugaacugcaacuacaacaucugccccuacugcgcgagccgccucaccuccgacggccugguccggcacgugacgcagugcccgaagcgcaaggagaagguggaggagaccgagcuguaccucaaccuggagcggauccccuggcugguccgcaagcuccuccaggugagcgaguccaccgggguggcccugaagcggagcugcuggaugaucacccugcugauccugcucacggucuccaugagccccgugcagagcgcccccgucggccgcaagccgcuguuccuggaccggaucgccaaggggaugaagucccuccugaacagcaccucccuggagaccagccucuccaucgaggcgcccuggggcgccaucaacgugcagagcaccuucaagcccacgguguccgccgccaacaucgcccugagcugguccagcgucgagcacaagggcaacaagauccugguguccgggcgcagcgaguccaucaugaagcucgaggagcggaccggcaucagcuggugccuggggguggaggacgcguccgagagcaagacccugaccgucuccgugauggaccucagccagauguacucccccguguucgaguaccugagcggcgaccgccaggucgaggaguggccgaaggccacgugcaccggggacugccccgagcggugcggcugcaccagcuccacgugccugcacaaggaguggccccacagccgcaacuggcgcugcaaccccaccuggugcuggggcguggggaccggcugcacgugcugcgggcucgacgugaaggaccuguucaccgacuacaugcuggucaaguggaagguggaguacaucaagaccgaggccaucaucugcguggagcugaccucccaggagcggcagugcagccucaucgaggccggcacccgcuucaaccuggggccggucaccaucacccuguccgagccccggaacgugcagcagcgccucccgcccgagaucaucacgcugcaccccaagaucgaggagggcuucuucgaccugaugcacgugcagaaggucaugagcgccuccaccgugugcaagcuccagagcugcacccacggcgugcccggggaccugcaggucuaccacgugggcaaccugcucaagggggacaaggugaacggccacuccauccacaagaucgagagccaccugaacaccuccuggaugagcugggacggcugcgaccuggacuacuucugcaacaugggggacuggcccuccugcacguacaccggcgucacccagcacaaccacgcggccuucaucaacaugcucaacaucgagaccgacuacacgaagaccuuccacuuccacagcaagcgggugaccgcccacggggacacgccccagcuggaccugaaggcccgcccggccuacggcgcgggggagaucaccgugcucgucgagguggccgaccuggagcugcacaccaagaagaucgagguguccggccucaaguucgccagccuguccugcagcggcugcuacgccugcagcuccgggaucagcugcaagguccggauccacgugaacgagcccgacgaguucaccgugcacgucaaguccaacgaccccgacgugguggccgcgggcagcucccugauggcccgcaagaucgagagcggggccgacuccaccuucaaggccuucagcuccaugccgaagaacagccucugcuucuacaucgucgagcgggacuacugcuccagcugcacggacgacgacacccagaagugcguggacaucaagcuggagcacccccaguccauccugaucgagcacaagggcaccaucaucgggaagcagaacgacacgugccccaccaagaccagcugcuggcucgaguccaucaagagcuucuucuacggccugaagaacaugcuguccggcaucuucgggaacguguuccucggcaugcugcuguuccucgcgcccuucauccugcugauccucuucuucuucuucggguggcgccugcuguucugccucaagugcugccggcgcacccggaagcugcugaaguacaagcaccuccgcgacgaggaggagagcggcuacaagaagaucaucgagcggcugaacgacaagaaggggaagucccgccuguucgacggcgagcggcucgccgaccgcaagaucgccgagcuguucagcaccaagacgcacaucggc

SEQ ID NO: 12223 - RNA, 2916 nt, Artificial Sequence
  derived and/or modified CDS sequence (opt1) from CCHFV(ArD15786, Artificial)__DQ211627.1__Gn-4aa-Gc
gccgagggcgggagcaacgacugcgugucccgcacccagcuggucaagaccgaggugacggagauccacgaggacagcuacggcgggcccggcgagaagaucaccaucugcaacggguccaccaucguggaccagcggcucggcagcgagcugggcugcuacaccaucaaccgcguccggacguacaagcugugcgagaacuccgccaccgagaaguccugcgagaucgacagcgugccggugaagugcaagcagggguucugccucaagaucacccaggagggccgcgggcacgucaagcugagccggggcaccgagaucgugcuggacgugugcgacacguccugcgagcucaugauccccaaggggaccggcgacauccuggucgacugcagcggcgggcagcagcacuuccugcaggacaaccucaucgaccugggcugccccaacaucccccugcucgggcagaccgcgaucuacgugugccgcauguccaaccacccgaagaccacgauggccuuccuguucugguucagcuucggcuacgugaucacgugcgucgugugcaaggugcuguucuaccuccugaucgucaucggcacccuggggaagcggcucaagcaguaccgcgagcugaagccccagaccugcaucgugugcgaguccauccccgugaacgccaucgacgccgagaugcacgaccugaacugcaacuacaacaucugccccuacugcgccagccggcucaccuccgacggccugguccgccacgugacccagugcccgaagcggaaggagaagguggaggagaccgagcuguaccucaaccuggagcgcauccccuggcugguccggaagcuccuccaggugagcgaguccaccgggguggcgcugaagcgcagcugcuggaucaucacgcugcugauccugcucaccgucuccaugagccccgugcagagcgcccccgucggccggaagccgcugucccuggacagcaucgccaaggggaugaagucccuccugaacagcaccucccuggagaccagccucuccaucgaggcccccuggggcgcgaucaacgugcagagcacguucaagcccaccaucuccgccgccaacaucgcccugagcugguccagcguggagcacaagggcaacaagauccuggucuccgggcgcagcgaguccaucaugaagcucgaggagcggaccggcaucagcuggugccuggggguggaggacgccuccgagagcaagacccugacgguguccgucauggaccucagccagauguacagccccguguucgaguaccuguccggcgaccgccagguggaggaguggccgaaggcgaccugcaccggggacugccccgagcggugcggcugcaccagcuccacgugccugcacaaggaguggccccacagccgcaacuggcggugcaaccccaccuggugcuggggcgucgggaccggcugcacgugcugcgggcucgacgugaaggaccuguucaccgacuacaugcuggugaaguggaaggucgaguacaucaagaccgaggccaucaucugcguggagcugaccucccaggagcgccagugcagccucaucgaggccggcacccgcuucaaccuggggccggugaccaucacgcuguccgagccccggaacguccagcagcgccucccgcccgagaucaucacccugcaccccaagaucgaggagggcuucuucgaccugaugcacgugcagaaggugaugagcgccuccaccgucugcaagcuccagagcugcacccacggcgugcccggggaccuccagguguaccacgucggcaaccugcugaagggggacaaggugaacggccacuccauccacaagaucgagagccaccugaacacguccuggaugagcugggacggcugcgaccuggacuacuucugcaacaugggggacuggcccuccugcaccuacaccggcgugacccagcacaaccgggccgcguucaucaacaugcucaacaucgagacggacuacaccaagaccuuccacuuccacagcaagcgcgucaccgcccacggggacacgccccagcuggaccugaaggcccggccgaccuacggcgccggggagaucaccgugcucguggaggucgccgaccuggagcugcacaccaagaagaucgagguguccggccucaaguucgcgagccugacgugcagcggcugcuacgccugcuccagcgggaucuccugcaaggugcgcauccacgucaacgagcccgacgaguucaccgugcacgucaagagcaacgaccccgacgugguggccgccggcuccagccugauggcccggaagaucgaguccggggcggacagcaccuucaaggccuucuccagcaugccgaagaacucccucugcuucuacaucguggagcgcgacuacugcagcuccugcaccgacgacgacacgcagaagugcgucgacaucaagcuggagcacccccagagcauccugaucgagcacaagggcaccaucaucgggaagcagaacgacacgugccccaccaagaccuccugcuggcucgagagcaucaaguccuucuucuacggccugaagaacaugcugagcggcaucuucgggaacaucuuccucggcaugcugcuguuccucgcccccuucgugcugcugauccucuucuucuucuucggguggcggcugcuguucugccucaagugcugccgccggacccgcaagcugcugaaguacaagcaccuccgggacgaggaggaguccggcuacaagaagaucaucgagcgccugaacgacaagaagggcaagagccggcuguucgacggggagcgccucgccgaccggaagaucgcggagcuguucagcaccaagacccacgugggc

SEQ ID NO: 12224 - RNA, 2916 nt, Artificial Sequence
  derived and/or modified CDS sequence (opt1) from CCHFV(ArD39554, Artificial)__DQ211628.1__Gn-4aa-Gc
agcgaguccaacaacaacgacugcgugagccgcacccagcugaucaagaccgagaacgccgagauccacggcgacgacuacgggggccccggggagaagaucacgaucugcaacggcuccaccaucgucgagcagcggcucgggagcgagcugggcugcuacaccaucaaccgcaucaaguccuucaagcugugcgagaacagcgccuccggcaaggggugcgagaucgacagcaccccggugaagugcaagcagggcuucugccucaagaucacgcaggaggggcggggccacgugaagcugucccgcgggagcgagaucauccuggacgucugcgacuccagcugcgagaugaugauccccaagggcuccggcgacauccucguggacugcagcgggggccagcagcacuuccugcaggacaaccugguggaccucgggugccccaacgucccccugcugggcaagauggcgaucuacaucugccggauguccaaccacccgaagaccaccauggccuuccucuucugguucagcuucggcuacgugaucacgugcaucuucugcaaggugaucuucuacguccugaucaucaucgggacccugggcaagcgcaucaagcaguaccgggagcucaagccccagaccugcaccaucugcgaggccacccccgugaacgccaucgacgccgagaugcacgaccugaacugcuccuacaacaucugccccuacugcgcgagccgccugacguccgaggggcucgugcggcacgucacccagugcccgaagcgcaaggagaagaucgaggagaccgagcuguaccugaaccucgagcggauccccugguucgugcgcaagcugcuccaggugagcgagagcaccggcgucgcccucaagcgguccagcuggcuggugacgcugcucgugcugcugaccgucucccucagccccgugcaguccgcccccaucgggcgcaagccgcuguuccuggacagcaccgccaaguccaugaagucccuccugaacagcaccagccuggagacgucccucagcaucgaggcgcccuggggcgccaucaacgugcaguccaccuucaagcccaccgccagcaccgccaacaucgcccuguccuggagcuccgucgagcaccggggcaacaagauccuggugacggggcgcagcgaguccaucaugaagcucgaggagcggaccggcaucagcuggaaccuggggguggaggacgcgagcgaguccaagacccugaccgucagcgugauggaccucucccagauguacagcacggucuucgaguaccuguccggcgaccgccagguggaggaguggcccaaggcgaccugcaccggggacugcccggagcggugcggcugcaccagcuccacgugccugcacaaggccuggccccacagccgcaacuggcggugcaaccccaccuggugcuggggcguggggaccggcugcacgugcugcgggcucgacgucaagaaccuguucaccgacuacaugcugaucaaguggaagguggaguucaucaagaccgaggccaucgugugcgucgagcucaccucccaggagcgccagugcagccugaucgaggccggcacccgcuucaaccuggggcccgugaccaucacgcuguccgagccgcggaacauccagcagaagcucccgcccgagcuggugacccugcacccccgcgucgaggagggcuucuucgaccucaugcacgugcagaaggugcugagcgccuccaccgucugcaagcugcagagcugcacccacggcgugcccggggaccuccagguguaccacgucggcaaccugcugaagggggacaagaucaacggcaacuccuuccacaagaucgagcccaaccucaacacgagcuggauguccugggacggcugcgaccuggacuacuacugcaacaugggggacuggcccagcugcaccuacaccggcgugacccagcacaaccacgccgccuucgugaaccugcucaacaucgagacggacuacaccaagaacuuccacuuccacagcaagcgggucaccgcccacggggagacgccccagcuggaccugaaggcccgcccgaaguacggcgcgggggaggugaccgugcucgucgagguggccgacauggagcugcacaccaagaagaucgagaucuccggccugaaguucgccagccugaccugcaccggcugcuacgccugcuccagcgggaucuccugcaaggugcggcugcacgucgacgagcccgacgagcugacggugcacgucaagagcgacgaccccgacgugguggccgcguccagcucccucauggcccgcaagaucgaguucggcaccgacagcaccuucaaggccuucuccagcaugccgaaggacaagcugugcuucuacaucguggagcgggacuacugcuccagcugcuccaaggaggacacccagaagugcgucaacgccaagcuggagcagccccagagcauccucaucgagcacaaggggacgaucaucggcaagcagaacgacacgugcaccgugaaggcguccugcuggcuggagagcgugaaguccuucuucuacgggcugaagaacaugcucggcggcaucuucgggaacgucauccugggcaucaucauguuccuggcccccuucgcccuccugcuccucuucuuccuguucggguggcgcauccuguucugccuccggugcugccgccggacccgcggccuguucaaguacaagcacaucaaggacgacgaggagagcggguacaagcggaucaucgagcgccugaacaacaagaagggcaagaacaagcuguucgacggcgagcggcuggccgacaagaagaucgccgagcuguucagcaccaagacccacaucggg

SEQ ID NO: 12225 - RNA, 2916 nt, Artificial Sequence
  derived and/or modified CDS sequence (opt1) from CCHFV(C-68031, Artificial)__DQ211629.1__Gn-4aa-Gc
agcgaggaguccggcgacgacugcaucagccgcacccagcugucccggaccgagacggccgagauccacagcgacaacuacgggggccccggggacaagaucaccaucugcaacggcuccaccaucguggaccagcgccucgggagcgagcugggcugcuacaccaucaaccgggucaaguccuucaagcugugcgagaacagcgccacgggcaaguccugcgagaucgacagcaccccgaucaagugccgccagggguucugccucaagaucacccaggagggccgggggcacgugaagcugucccgcggcagcgaggugguccuggacgcgugcgacuccagcugcgagaucaugauccccaaggggaccggcgacauccucguggacugcuccggcgggcagcagcacuuccugaaggacaaccugaucgaccucggcugccccaacaucccccugcuggggaagauggccaucuacaucugccggaugagcaaccacccgaagacgaccauggccuuccucuucugguucuccuucggcuacgugaucaccugcauccugugcaaggucaucuucuaccugcucaucguggugggcacccuggggaagaaguucaagcaguaccgcgagcugaagccccagacgugcaccaucugcgagaccacccccgucaacgccaucgacgccgagaugcacgaccucaacugcagcuacaacaucugccccuacugcgcgucccggcugacgagcgacggccuggcccgccacgugaugcagugcccgaagcggaaggagaagguggaggagaccgagcucuaccugaaccuggagcgcauccccugggucgugcggaagcuccugcaggugagcgaguccaccggggucgcccugaagcgcagcuccuggcucguggugcugcugguccuccugaccgugagccugucccccgugcagagcgcccccaucggccggaagccgcucuucuccgacagcaucgucaaggggaugaagaaccugcugaacuccacgagccucgagaccucccugagcaucgaggcgcccuggggcgccaucaacgugcaguccaccuucaagcccaccgugagcgccgccaacaucgcccuguccuggagcuccgucgagcaccgcggcaacaagauccucgugagcgggcgguccgagagcaucaugaagcuggaggagcgcacgggcaucagcugggaccugggggucgaggacgcguccgagagcaagcuccugaccguguccaucauggaccugagccagauguacucccccguguucgaguaccucagcggcgaccggcaggucgaggaguggccgaaggccaccugcaccggggacugccccgagcgcugcggcugcacguccagcaccugccugcacaaggaguggccccacucccggaacuggcgcugcaaccccaccuggugcuggggcguggggaccggcugcacgugcugcgggcuggacgugaaggaccucuucaccgacuacauguucgucaaguggaagguggaguacaucaagaccgaggccaucgugugcgucgagcugaccagccaggagcgccagugcucccugaucgaggccggcacgcgguucaaccuggggccggugaccaucacccucagcgagccccgcaacauccagcagaagcugccccccgagaucgugacccugcacccgcggaucgaggagggcuucuucgaccucaugcacgucaagaaggugcuguccgccagcaccgugugcaagcugcaguccugcacgcacggcguccccggggaccuccagguguaccacaucggcaaccugcugaagggggacaaggugaacggccaccucauccacaagaucgagccccacuucaacaccagcuggauguccugggacggcugcgaccuggacuacuacugcaacaugggggacuggcccagcugcagcuacaccggcgucacccagcacaaccacgcggccuucgugaacaugcugaacaucgagacggacuacaccaagaucuuccacuuccacuccaagcgcgugaccgcccacggggacaccccgcagcucgaccugaaggcccggcccacguacggcgccggggagaucaccguccugguggagguggcggacauggagcuccacaccaagaagaucgagaucagcggccugaaguucgccucccugaccugcacgggcugcuacgccugcagcuccgggaucagcugcaagguccgcauccacguggacgagcccgacgagcucaccgugcacgucaaguccgaggacccggacaucguggccgccagcuccagccugauggcgcggaagcuggaguucggcaccgacuccaccuucaaggccuucagcgccaugcccaagacgucccucugcuucuacaucguggagcgcgaguacugcaagagcugcuccaaggaggacacccagaagugcgucaacaccaagcuggagcagccccagagcauccugaucgagcacaaggggaccaucaucggcaagcagaacgacacgugcaccuccaaggccgggugcuggcucgagagcgugaaguccuucuucuacggccugaagaacaugcugagcggcaucuucgggaacguguucaucggcaucuuccucuuccuggcgcccuucauccugcucauccuguucuucauguucggguggcggauccuguucugcuucaagugcugccgccggacccgcggccucuucaaguaccggcaccugaaggacgacgaggagaccggguaccgcaagaucaucgagcggcugaacaacaagaagggcaagaacaagcuccuggacggcgagcgccuggccgaccggaagaucgccgagcucuucagcacgaagacccacaucggg

SEQ ID NO: 12226 - RNA, 2916 nt, Artificial Sequence
  derived and/or modified CDS sequence (opt1) from CCHFV(Drosdov, Artificial)__DQ211630.1__Gn-4aa-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgugaucaccugcaucuucugcaaggcccuguucuacagccucaucaucaucggcacgcuggggaagaagaucaagcaguaccgcgagcugaagccccagaccugcaccaucugcgagaccgcccccgugaacgcgaucgacgccgagaugcacgaccucaagugcuccuacaacaucugcccguacugcgccagccggcugacguccgacggccuggcccgccacgucacccagugccccaagcggaaggagaagguggaggagaccgagcucuaccugaaccuggagcgcauccccuggaucgugcggaagcuccugcaggucagcgaguccaccgggguggcgcugaagcgcagcagcuggcucaucgugcugcugguccuccugacggugucccugagccccgugcaguccgccccggucggccggaagccccucuuccuggacagcaccgugaaggggaugaagaaccugcucaacuccaccagccuggagaccucccugagcaucgaggcccccuggggcgccaucaacgugcaguccacguucaagcccaccgucagcaccgccaacaucgcgcucuccuggagcuccguggagcaccgcggcaacaagauccuggugaccgggcggagcgaguccaucaugaagcuggaggagcgcacgggcgucagcugggaccucgggguggaggacgccuccgagagcaagcugcugaccgucuccaucauggaccucagccagauguacagcccgguguucgaguaccuguccggcgaccggcagguggaggaguggcccaaggccaccugcaccggggacugccccgagcgcugcggcugcacgagcuccaccugccugcacaaggaguggccccacagccggaacuggcgcugcaacccgaccuggugcuggggcgucgggaccggcugcacgugcugcgggguggacgugaaggaccucuucaccgaccacauguucgucaaguggaagguggaguacaugaagaccgaggccaucgugugcgucgagcugaccucccaggagcgccagugcagccugaucgaggccggcacccgguucaaccuggggcccgugacgaucacccucuccgagccccgcaacauccagcagaagcugcccccggagaucaucacccugcaccccaagaucgaggagggcuucuucgaccucaugcacgugcagaagguccugagcgcguccaccgugugcaagcugcagagcugcacgcacggcauccccggggaccuccagaucuaccacaucggcaaccugcugaagggggaccgggugaacggccaccucauccacaagaucgagccccacuucaacaccuccuggaugagcugggacggcugcgaccuggacuacuacugcaacauggggaacuggccguccugcaccuacaccggcgucacgcagcacaaccacgccgccuucgugaaccugcucaacaucgagaccgacuacaccaagaccuuccacuuccacagcaagcgcgugacggcccacggggacaccccccagcuggaccugaaggcccggcccaccuacggcgcgggggagaucaccguccucguggagguggccgacauggagcugcacacgaagaaggucgagaucuccggccugaaguucgccagccucgugugcaccggcugcuacgccugcuccagcgggaucagcugcaaggugcgcauccacgucgacgagccggacgagcugaccgugcacgugaaguccagcgaccccgacgucguggccgcguccaccagccugauggcccggaagcucgaguucggcacggacuccaucuucaaggccuucagcgccaugcccaagaccucccugugcuucuacaucguggagcgcgaguacugcaagagcugcuccgaggacgacaccaagaagugcgucgacaccaagcuggagcagccccagagcauccucaucgagcacaaggggacgaucaucggcaagcagaacgacaccugcaccgcgaaggccuccugcuggcuggagagcgugaaguccuucuucuacgggcugaagaacaugcucggcagcguguucggcaacuucuucgucgggauccugcuguuccucgccccguucgugcugcuggugcucuucuucauguucggcuggaagauccuguucugcuucaagugcugccggcgcacccgggggcuguucaaguaccgccaccucaaggacgacgaggagacgggcuaccggcgcaucaucgagcggcugaacuccaagaaggggaagaaccgccugcucgacggcgagcggcuggccgaccgcaagaucgccgagcuguucagcaccaagacccacaucggc

SEQ ID NO: 12227 - RNA, 2916 nt, Artificial Sequence
  derived and/or modified CDS sequence (opt1) from CCHFV(Kashmanov, Artificial)__DQ211631.1__Gn-4aa-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugaccgugucccugagcccggugcaguccgcccccgucggccgcaagccccucuuccuggacagcaucgugaaggggaugaagaacucccugaacagcacgucccucgagaccagccuguccaucgaggcccccuggggcgccaucaacgugcagagcaccuucaagccgaccgucuccacggccaacaucgcgcugagcugguccagcguggagcaccggggcaacaagauccucgugaccgggcgcuccgagagcaucaugaagcuggaggagcggaccggcgucuccugggaccuggggguggaggacgccagcgaguccaagcuccugaccgucagcaucauggaccugagccagauguacucccccguguucgaguaccucagcggcgaccgccagguggaggaguggcccaaggccacgugcaccggggacugccccgagcggugcggcugcaccuccagcacgugccugcacaaggaguggccgcacucccgcaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcucaccagccaggagcggcagugcucccugaucgaggccggcacccgcuucaaccuggggcccgugaccaucacccugagcgagccccggaacauccagcagaagcucccgcccgagaucaucacgcugcaccccaagguggaggagggcuucuucgaccugaugcacguccagaaggugcucuccgcgagcaccgugugcaagcugcaguccugcacccacggcauccccggggaccugcaggucuaccacaucggcaaccuccugaagggggaccgcaucaacggccaccugauccacaagaucgagccgcacuucaacaccagcuggauguccugggacggcugcgaccucgacuacuacugcaacaugggggacuggcccagcugcacguacaccggcgugacccagcacaaccacgccgccuucgugaaccugcugaacaucgagaccgacuacacgaagaccuuccacuuccacuccaagcgggucaccgcccacggggacacgccccagcucgaccugaaggcccgcccgaccuacggcgcgggggagaucaccgugcugguggaggucgccgacauggagcuccacaccaagaagguggagaucagcggccugaaguucgccucccuggccugcaccggcugcuacgccugcagcagcgggaucuccugcaaggugcggauccacgucgacgagcccgacgagcucacggugcacgucaagagcuccgaccccgacgugguggcggccagcaccucccugauggcccgcaagcuggaguucggcaccgacagcaccuucaaggccuucuccgcgaugcccaagacgagccucugcuucuacaucguggagcgggaguacugcaaguccugcagcgaggaggacacccagaagugcgucgacaccaagcuggagcagccgcaguccauccugaucgagcacaaggggaccaucaucggcaagcagaacgacacgugcaccgccaaggccagcugcuggcucgaguccgucaagagcuucuucuacgggcugaagaacaugcugggcuccguguucggcaacuucuucaucgggauccuccuguuccuggcccccuucgugcuccuggugcuguucuucauguucggcuggaagauccucuucugcuucaagugcugccgccggacccgcgggcugcugaaguaccggcaccucaaggacgacgaggagaccggcuaccgccggaucaucgagcgccugaacaacaagaaggggaagaaccggcugcucgacggcgagcgccuggccgaccggaagaucgcggagcuguucagcacgaagacccacaucggc

SEQ ID NO: 12228 - RNA, 2916 nt, Artificial Sequence
  derived and/or modified CDS sequence (opt1) from CCHFV(Oman, Artificial)__DQ211632.1__Gn-4aa-Gc
agcgaggaguccggcgaggacugcaucagccgcacccagcugcuccggaccgagacggccgagauccacggggacaacuacggcgggcccggcgacaagaucaccaucugcaacggguccaccaucguggaccagcgccugggcagcgagcugggcugcuacaccaucaaccgggucaaguccuucaagcucugcgagaacagcgccacggggaaguccugcgagaucgacaacaccccggugaagugcaagcagggcuucugccugaagaucacccaggaggggcgcggccacgugaagcugagccgggacuccgaggucgugcucgacgcgugcgacagcuccugcgagaucaugauccccaaggggaccggcgacauccugguggacugcagcggcgggcagcagcacuuccugaaggacaaccucaucgaccugggcugccccaacaucccccugcucgggaagauggccaucuacaucugccgcauguccaaccacccgaagacgaccauggccuuccuguucugguucagcuucggcuacgucaucacgugcauccugugcaaggugaucuucuaccuccugaucguggucggcacccuggggaagaaguucaagcaguaccgggagcucaagccccagaccugcaccaucugcgagaccacccccgugaacgccaucgacgccgagaugcacgaccugaacugcuccuacaacaucugccccuacugcgcgagccgccugacguccgacggccucgcccggcacgugaugcagugcccgaagcgcaaggagaagaucgaggagaccgagcuguaccugaaccucgagcggauccccugggucgugcgcaagcugcuccaggugagcgaguccaccggggucgcccucaagcggagcagcuggcugaucgugcugcucgugcugcugaccgucucccucagccccgugcaguccgcccccaucggccgcaagccgcuguuccuggacagcaucgcgaaggggaugaagaaccuccugaacuccacgagccuggagaccucccucagcaucgaggcccccuggggcgccaucaacgugcaguccaccuucaagcccaccgucagcacggccaacaucgcccuguccuggagcuccguggagcaccggggcaacaagauccuggugagcgggcgcuccgagagcaucaugaagcucgaggagcggaccggcaucuccugggaccugggggucgaggacgcgagcgaguccaagcugcucaccgugagcgucauggaccugagccagauguacucccccguguucgaguaccugagcggcgaccgccagguggaggaguggccgaaggcgaccugcacgggggacugccccgagcggugcggcugcaccuccagcacgugccuccacaaggaguggccccacucccgcaacuggcggugcaaccccaccuggugcuggggcgucgggaccggcugcacgugcugcgggcuggacgugaaggaccuguucaccgacuacauguucgugaaguggaaggucgaguacaucaagaccgaggccaucgugugcguggagcugaccagccaggagcgccagugcucccucaucgaggccggcacccgcuucaaccuggggccggucaccaucacccugagcgagccccggaacauccagcagaagcucccgcccgagaucgugacccugcacccccgcaucgaggagggcuucuucgaccugaugcacgugcagaagguccucuccgccagcacggugugcaagcugcaguccugcacccacggcgugcccggggaccugcaggucuaccacaucggcaaccuccugaagggggacaaggugaacggccaccugauccacaagguggagccccacuucaacaccagcuggauguccugggacggcugcgaccucgacuacuacugcaacaugggggacuggcccagcugcaccuacacgggcgucacccagcacaaccacgccgccuucgugaaccugcugaacaucgagaccgacuacaccaagaacuuccacuuccacuccaagcgggugacggcccacggggacaccccgcagcucgaccugaaggcccgccccaacuacggcgccggggaggucaccgugcugguggaggucgcggacauggagcuccacaccaagaagaucgagaucagcggccugaaguucgccucccugacgugcaccggcugcuacgccugcagcagcgggaucuccugcaaggugcggauccacguggacgagcccgacgagcucaccguccacgucaagagcgaggacccggacaucguggccgccuccagcucccugauggcgcgcaagcuggaguucggcaccgacagcacguucaaggccuucuccgccaugcccaagaccagccucugcuucuacaucguggagcgggaguacugcaaguccugcagcaaggaggacacccagaagugcgugaacgccaagcuggagcgcccccaguccauccugaucgagcacaaggggaccaucaucggcaagcagaacgacacgugcaccgcgaaggccagcugcuggcucgaguccgucaagagcuucuucuacgggcugaagaacaugcuguccggcaucuucggcaacguguucaucgggaucuuccucuuccuggcccccuucauccugcucauccuguucuucauguucggcuggcggauccuguucugcuucaagugcugccgccggacccgcggccucuucaaguaccggcaccugaaggacgacgaggagaccggguaccgcaagaucaucgagcggcugaacaacaagaaggggaagaacaagcuccuggacggcgagcgccuggccgaccggaagaucgccgagcuguucagcacgaagacccacaucggc

SEQ ID NO: 12229 - RNA, 2916 nt, Artificial Sequence
  derived and/or modified CDS sequence (opt1) from CCHFV(SPU97/85, Artificial)__DQ211633.1__Gn-4aa-Gc
agcgaggaguccgacggcgacugcaucagccgcacccagcugcuccggaccgagacggccgagauccacuccgacaacuacgggggccccggggacaagaucaccaucugcaacggcagcaccaucguggaccagcgccugggguccgagcugggcugcuacaccaucaaccgggucaagagcuucaagcucugcgagaacuccgccacgggcaagagcugcgagaucgacuccaccccggugaagugccgccagggguucugccugaagaucacccaggagggccgggggcacgugaagcugagccgcggcuccgagaucguccucgacgcgugcgacagcuccugcgagaucaugauccccaaggggaccggcgacauccugguggacugcagcggcgggcagcagcacuuccugaaggacaaccucaucgaccugggcugccccaacaucccccugcucgggcggauggccaucuacaucugccgcauguccaaccacccgaagacgaccauggccuuccuguucugguucagcuucggcuacgugaucaccugcauccugugcaaggucaucuucuaccuccugaucguggccggcaccguggggaagaaguucaagcaguaccgggagcugcgcccccagacgugcaccaucugcgagaccacccccgucaacgccaucgacgcggagaugcacgaccucaacugcuccuacaacaucugccccuacugcgccagccggcugacguccgacggccuggcccgccacgugaugcagugcccgaagcggaaggagaagaucgaggagaccgagcucuaccugaaccuggagcgcauccccugggugguccggaagcuccugcaggugagcgagagcaccgggguggcccugaagcgcuccagcuggcucaccguccugcuggugcuccugaucgugucccugagccccguccaguccgcgcccaucggccggaagccgcucuuccuggacagcaucgugaaggggaagaagaaccugcucaacuccacgagccuggagaccucccugagcaucgaggcccccuggggcgccaucaacgugcaguccaccuucaagcccaccgucagcgccgccaacaucgcgcucuccuggagcuccguggagcaccgcggcaacaagauccuggugagcgggcgguccgagagcaucaugaagcuggaggagcgcacgggcaucuccugggaccucggggucgaggacgccagcgagagcaagcugcugaccguguccgucauggaccucagccagauguacucccccguguucgaguaccugagcggcgaccggcagguggaggaguggccgaaggccaccugcaccggggacugccccgagcgcugcggcugcacguccagcaccugccugcacaaggaguggccccacucccgcaacuggcggugcaaccccaccuggugcuggggcgucgggaccggcugcacgugcugcgggcucgacgugaaggaccuguucaccgacuacauguucgugaaguggaaggucgaguacaucaagaccgaggccaucgugugcguggagcugaccagccaggagcgccagugcucccugaucgaggccggcacgcgguucaaccucgggccggucaccaucacccugagcgagccccgcaacauccagcagaagcugccccccgagaucaucacccuccacccgcggaucgaggagggcuucuucgaccugaugcacgugcagaaggugcuguccgcgagcaccgucugcaagcuccaguccugcacgcacggcgugcccggggaccugcagguguaccacaucggcaaccugcucaagggggacaaggucaacggccaccugauccacaagaucgagccccacuucaacaccagcuggauguccugggacggcugcgaccuggacuacuacugcaacaugggggacuggcccagcugcaccuacaccggcgugacgcagcacaaccacgccgccuucgugaaccuccugaacaucgagaccgacuacaccaagaacuuccacuuccacuccaagcgcgucaccgcccacggggacacgccgcagcuggaccucaaggcccggcccaccuacggcgcgggggaggugaccgugcuggucgagguggccgacauggagcugcacaccaagaagaucgagaucagcggccucaaguucgccagccuguccugcacgggcugcuacgccugcagcuccgggaucagcugcaaggugcgcauccacgucgacgagcccgacgagcugaccgugcacgugaaguccgaggacccggacaucgucgccgcgggcagcucccucauggcccggaagcuggaguucggggccgacagcaccuucaaggccuucuccgcgaugcccaagaccagccugugcuucuacaucguggagcgcgaguacugcaaguccugcagccgggaggacacgcagaagugcgugaacaccaagcucgagcgcccccaguccauccugaucgagcacaagggcaccaucaucgggaagcagaacgacaccugcacggccaaggccagcugcuggcuggaguccgucaagagcuucuucuacggccucaaguccaugcugagcggcaucuucgggaacguguucaucggcaucuuccuguucaucgcccccuucgugcuccugauccuguucuucauguucggguggcggauccucuucugcuucaagugcugccgccggacccgcggccuguucaaguaccggcaccugaaggacgacgaggagaccggguaccgcaagaucaucgagcggcucaacaacaagaagggcaagaacaagcugcuggacggcgagcgccucgccgaccgcaagaucgcggagcuguucuccaccaagagccacaucggg

SEQ ID NO: 12230 - RNA, 2916 nt, Artificial Sequence
  derived and/or modified CDS sequence (opt1) from CCHFV(SPU103/87, Artificial)__DQ211634.1__Gn-4aa-Gc
agcgaggaguccagcgacgacugcaucucccgcacccagcugcuccggaccgagacggccgagauccacggcgacaacuacgggggccccggggacaagaucaccaucugcaacggcagcaccaucguggaccagcgccugggguccgagcugggcugcuacaccaucaaccgggucaagacguucaagcucugcgagaacagcgccaccggcaaguccugcgagaucgacagcgugccggugaagugccgccagggguacugccugaagaucacccaggagggccgggggcacgucaagcugucccgcggcagcgagguggugcucgacgcgugcgacaccuccugcgaggucaugauccccaaggggacgggcgacauccugguggacugcagcggcgggcagcagcacuuccugaaggacaaccucaucgaccugggcugccccaagaucccccugcucgggaagauggccaucuacaucugccggauguccaaccacccgaagaccaccauggccuuccuguucugguucagcuucggcuacgugaucacgugcguccugugcaaggccaucuucuaccuccugaucaucgugggcacccuggggaagcgccucaagcaguaccgggagcugaagccccagaccugcaccaucugcgagaccacgcccgugaacgccaucgacgcggagaugcacgaccugaacugcuccuacaacaucugccccuacugcgccagccgccucaccuccgacggccuggcccggcacgucacccagugcccgaagcgcaaggagaagguggaggagaccgagcuguaccucaaccuggagcggauccccugggugguccgccggcugcuccaggugagcgaguccacggggguggcccugaagcgcagcagcuggcugaucguccuccuggugcuguucaccgugucccucagccccguccaguccgcgcccaucagccggcgcccgcuguuccuggacaacaucgugaagggcaugaagaaccuccugaacuccaccagccuggagaccucccucagcaucgaggcccccuggggcgccaucaacgugcaguccacguacaagcccaccgucagcaccgccaacaucgcccuguccuggagcuccguggagcaccgggggaacaagauccuggucagcggccgcuccgagagcaucaugaagcucgaggagcggaccgggaucuccugggaccugggcguggaggacgcgagcgaguccaagcugcucacggugagcgucauggaccugagccagauguacucccccguguucgaguaccugagcggggaccgccagguggaggaguggccgaaggcgaccugcaccggcgacugccccgagcgcugcgggugcaccuccagcacgugccuccacaaggaguggccccacucccggaacuggcgcugcaaccccaccuggugcuggggcgucggcaccgggugcacgugcugcggccuggacgugaaggaccuguucaccgacuacauguucgugaaguggaagaucgaguacaucaagaccgaggccaucgucugcguggagcugaccagccaggagcggcagugcucccucaucgaggccgggacccgcuucaaccugggcccggugaccaucacgcugagcgagccccggaacauccagcagaagcuccccuccgagaucaucacccugcacccccgcaucgaggagggguucuucgaccugaugcacguccagaaggugcucagcgccuccaccgugugcaagcugcagagcugcacccacggcgucccgggcgaccuccagguguaccacaucgggaaccuccugaagggcgacaaggugaacgggcaccugguccacaagaucgagccccacuucaacacguccuggaugagcugggacggcugcgaccucgacuacuacugcaacaugggcgacuggcccuccugcaccuacaccggggugacccagcacaaccacgccagcuucgugaaccugcugaacaucgagacggacuacaccaagaacuuccacuuccacuccaagcgggucaccgcccacggcgacacgccccagcucgaccugaaggcccgcccgaccuacggggccggcgagaucaccgugcugguggaggucgccgacauggagcuccacaccaagaagaucgagaucagcgggcugaaguucaccagccugacgugcaccggcugcuacgcgugcuccagcggcaucuccugcaaggugcggauccacguggacgagcccgacgagcucaccguccacgucaagagcgacgaccccgacgugguggccgccuccagcucccugauggcccgcaagcuggaguucgggaccgacagcacguucaaggccuucuccgcgaugccgaagaccagccucugcuucuacaucguggagcgggaguacugcaaguccugcagcgaggaggacacccagaagugcgugaacaccaagcuggagcagccccaguccauccugaucgagcacaagggcacgaucaucgggaagcagaacaacacgugcaaggcccgcgccggcugcuggcucgagagcgucaaguccuucuucuacgggcugaagaacaugcugagcggcaucuucggcaacguguucaucgggaucuuccucuuccuggcccccuucauccugcucauccuguucuucauguucggcuggcggauccuguucugcuucaagugcugccgccggacccgcggccucuucaaguaccggcaccugaaggacgacgaggagaccggguaccgcaagaucaucgagcggcugaacaacaagaaggggaagaacaagcuccuggacggcgagcgccuggcggaccgccggaucgccgagcuguucuccaccaagacccacaucggc

SEQ ID NO: 12231 - RNA, 2916 nt, Artificial Sequence
  derived and/or modified CDS sequence (opt1) from CCHFV(SPU415/85, Artificial)__DQ211635.1__Gn-4aa-Gc
agcgaggaguccgacggcgacugcaucagccgcacccagcugcuccggaccgagacgaccgagauccacuccgacaacuacgggggccccggggacaagaucaccaucugcaacggcagcaccaucguggaccagcgccugggguccgagcugggcugcuacacgaucaaccgggucaagagcuucaagcucugcgagaacuccgccaccggcaagagcugcgagaucgacuccaccccggugaagugccgccagggguucugccugaagaucacccaggagggccgggggcacgugaagcugagccgcggcuccgagaucguccucgacgccugcgacagcaacugcgagaucaugauccccaaggggacgggcgacauccugguggacugcuccggcgggcagcagcacuuccugaaggacaaccucaucgaccugggcugccccaacaucccccugcucgggaagauggcgaucuacaucugccggaugagcaaccacccgaagaccaccauggccuuccuguucugguucuccuucggcuacgugaucaccugcauccugugcaaggucaucuucuaccuccugaucguggccggcacgguggggaagaaguucaagcaguaccgcgagcugcggccccagaccugcaccaucugcgagaccauccccgucaacgccaucgacgccgagaugcacgaccucaacugcagcuacaacaucugccccuacugcgcgucccgccugacgagcgacggccuggcccggcacgugaugcagugcccgaagcgcaaggagaagguggaggagaccgagcucuaccugaaccuggagcggauccccugggucgugcgcaagcuccugcagguguccgagagcaccggggucgcccugaagcggagcuccuggcucaccgugcugcuggugcuccugaucgucagccugucccccgugcagagcgcccccaucggccgcaagccgcucuuccuggacuccaucgugaaggggaugaagaaccugcucaacagcacgucccuggagaccagccuguccaucgaggcgcccuggggcgccaucaacguccagagcaccuucaagcccaccguguccgccgccaacaucgcccucagcugguccagcguggagcaccggggcaacaagauccuggucuccgggcgcagcgaguccaucaugaagcuggaggagcggacgggcaucagcugggaccucgggguggaggacgcguccgagagcaagcugcugaccgucagcgugauggaccucucccagauguacagccccguguucgaguaccuguccggcgaccgccaggucgaggaguggccgaaggccaccugcaccggggacugccccgagcggugcggcugcacgagcuccaccugccugcacaaggaguggccccacagccgcaacuggcgcugcaaccccaccuggugcuggggcguggggaccggcugcacgugcugcgggcucgacgugaaggaccuguucaccgacuacauguucgucaaguggaagguggaguacaucaagaccgaggccaucgugugcgucgagcugaccucccaggagcggcagugcagccugaucgaggccggcacgcgcuucaaccucgggccggugaccaucacccuguccgagccccggaacauccagcagaagcugccccccgagaucaucacccuccacccgcgcaucgaggagggcuucuucgaccugaugcacgugcagcggguccugagcgccuccaccgugugcaagcuccagagcugcacgcacggcgugcccggggaccugcaggucuaccacaucggcaaccugcucaagggggacaaggugaacggccaccugauccacaagaucgagccccacuucaacaccuccuggaugagcugggacggcugcgaccuggacuacuacugcaacaugggggacuggcccuccugcaccuacaccggcgugacgcagcacaaccacgcggccuucgucaaccuccugaacaucgagaccgacuacaccaagaacuuccacuuccacagcaagcgcgugaccgcccacggggacacgccgcagcuggaccucaaggcccggcccaccuacggcgccggggaggugaccguccugguggagguggcggacauggagcugcacaccaagaagaucgagaucuccggccucaaguucgccagccugacgugcaccggcugcuacgccugcagcuccgggaucagcugcaaggucaagauccacguggacgagcccgacgagcugaccgugcacgucaaguccgaggacccggacaucguggccgccggcagcucccucauggcgcgcaagcuggaguucggggccgacagcaccuucaaggccuucuccgccaugcccaagacgagccugugcuucuacaucguggagcgggaguacugcaaguccugcagccgcgaggacacccggaagugcgucaacaccaagcucgaccgcccccaguccauccugaucgagcacaagggcaccaucaucgggaagcagaacaacacgugcaccgcgaaggccagcugcuggcuggaguccgugaagagcuucuucuacggccucaagaacaugcuguccggcaucuucgggaacguguucaucggcaucuuccuguucaucgcccccuucguccuccugauccuguucuucauguucggguggcggauccucuucugcuucaagugcugccgccggacccgcggccuguucaaguaccggcaccugaaggacgacgaggagaccggguaccgcaagaucaucgagcggcucaacaacaagaagggcaagaacaagcugcuggacggcgagcgccucgccgaccgcaagaucgccgagcuguucagcacgaagucccacaucggg

SEQ ID NO: 12232 - RNA, 2916 nt, Artificial Sequence
  derived and/or modified CDS sequence (opt1) from CCHFV(Turkey200310849, Artificial)__DQ211636.1__Gn-4aa-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagguggacagcacccccgugaagugccgccagggguucugccugaagaucacccaggagggccgggggcacgucaagcugucccgcggcagcgagguggugcucgacgcgugcgacuccagcugcgaggucaugauccccaaggggacgggcgacauccugguggacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucagcugcaaggcccuguucuacucccucaucaucaucggcacccuggggaagaagaucaagcaguaccgggagcugaagccccagaccugcaccaucugcgagaccgcccccgucaacgcgaucgacgccgagaugcacgaccucaacugcagcuacaacaucugcccguacugcgccucccgccugacgagcgacggccuggcccggcacgugacccagugccccaagcgcaaggagaagguggaggagaccgagcucuaccugaaccuggagcggauccccuggaucguccgcaagcuccuccagguguccgagagcaccgggguggcgcugaagcggagcuccuggcucaucguccugcuggugcuccugacggugagccugucccccguccagagcgccccggugggccgcaagccccucuuccuggacuccaucgugaaggggaugaagaaccugcucaacagcaccucccuggagaccagccuguccaucgaggcccccuggggcgccaucaacguccagagcaccuucaagcccgccguguccacggcgaacaucgcccucagcugguccagcguggagcaccggggcaacaagauccuggucaccgggcgcuccgagagcaucaugaagcuggaggagcggaccggcguguccugggaccucggggucgaggacgccagcgaguccaagcugcugaccgugagcaucauggaccucagccagauguacuccccgguguucgaguaccugagcggcgaccgccaggucgaggaguggcccaaggccacgugcaccggggacugccccgagcggugcggcugcaccuccagcacgugccugcacaaggaguggccccacucccgcaacuggcgcugcaacccgaccuggugcuggggcguggggaccggcugcacgugcugcgggguggacgucaaggaccucuucaccgaccacauguucgugaaguggaagguggaguacaucaagaccgaggccaucgucugcguggagcugaccagccaggagcggcagugcucccugaucgaggcgggcacccgcuucaaccuggggcccgugaccaucacccucagcgagccccggaacauccagcagaagcugcccccggagaucaucacgcugcaccccaagaucgaggagggcuucuucgaccucaugcacguccagaaggugcuguccgccagcaccgugugcaagcugcaguccugcacccacggcauccccggggaccuccaggucuaccacaucggcaaccugcugaagggggaccgcgugaacggccaccucauccacaagaucgagagccacuucaacaccuccuggaugagcugggacggcugcgaccuggacuacuacugcaacaugggggacuggcccuccugcacguacaccggcgugacccagcacaaccacgccgccuucgucaaccugcucaacaucgagaccgacuacacgaagaccuuccacuuccacagcaagcgggugaccgcccacggggacaccccgcagcuggaccugaaggcgcgccccacguacggcgccggggagaucaccgugcucgucgagguggccgacauggagcugcacaccaagaagguggagaucuccggccugaaguucgccagccucgccugcaccggcugcuacgcgugcagcuccgggaucagcugcaagguccggauccacguggacgagcccgacgagcugacggugcacgucaaguccagcgacccggacgugguggccgccuccaccagccugauggcccgcaagcucgaguucggcaccgacuccaccuucaaggcguucagcgccaugcccaagacgucccugugcuucuacaucgucgagcgggaguacugcaagagcugcuccgaggacgacacccagaagugcguggacacccgccuggagcagccccagagcauccucaucgagcacaaggggaccaucaucggcaagcagaacgacacgugcaccgccaaggccuccugcuggcuggagagcgugaaguccuucuucuacgggcugaagaacaugcucggcagcgucuucggcaaccuguucaucgggauccuccucuuccuggcccccuucgugcugcucgugcuguucuucauguucggcuggaagauccuguucugcuucaagugcugccggcgcacccgggggcuguucaaguaccgccaccugaaggacgacgaggagaccggcuaccggcgcaucaucgagcggcugaacuccaagaaggggaagaaccgccuccuggacggcgaccggcuggcggaccgcaagaucgccgagcuguucagcacgaagacccacaucggc

SEQ ID NO: 12233 - RNA, 2916 nt, Artificial Sequence
  derived and/or modified CDS sequence (opt1) from CCHFV(Iran-52, Artificial)__DQ446215.1__Gn-4aa-Gc
agcgaggaguccggcgacgacugcaucagccgcacccagcugcuccggaccgagacggccgaggugcacggggacaacuacggcgggcccggcgacaagaucaccaucugcaacggguccaccgucguggaccagcgccugggcagcgagcugggcugcuacaccaucaaccgggugcgcuccuucaagcucugcgagaacagcgccacggggaaguccugcgagaucgacagcaucccggucaagugcaagcagggcuacugccugaagaucacccaggaggggcggggccacgugaagcugucccgcgggagcgaggugguccucgacgugugcgacuccagcugcgaggugaugauccccaagggcaccggcgacauccuggucgacugcuccgggggccagcagcacuuccugaaggacaaccucguggaccuggggugccccaagaucccccugcucggcaagauggcgaucuacaucugccggaugagcaaccacccgaagaccacgauggccuuccuguucugguucuccuucggcuacgugaucacgugcauccugugcaaggccaucuucuuccuccugaucaucuucgggacccugggcaagcgcuucaagcaguaccgggagcucaagccccagaccugcaccaucugcgagaccacccccgucaacgccaucgacgccgagaugcacgaccugaacugcagcuacaacaucugccccuacugcgcgucccgccugaccagcgacgggcucgcccggcacgugacgcagugcccgcgccggaaggagaagguggaggagaccgagcuguaccugaaccucgagcgcauccccugggucgugcggaagcugcuccagguguccgagagcaccggcaccguccugaagcgcagcuccuggcugaucgugcugcucgugcuguucacggucagccugucccccgugcagagcgcccccaucgggcggcgcccccucuuccuggacuccaucgugaagggcaugaagaaccugcucaacagcaccucccuggagaccagccuguccaucgaggcccccuggggcgcgaucaacguccagagcaccuacaagcccacgguguccaccgccaacaucgcccucagcugguccagcgucgagcaccgggggaacaaggugcugguguccggccgcagcgaguccaucaugaagcuggaggagcggaccgggaucagcugggaccucggcgucgaggacgccuccgagagcaagcugcugaccgugagcgugauggaccucucccagauguacagccccgucuucgaguaccuguccggggaccgccagguggaggaguggccgaaggccacgugcaccggcgacugccccgagcgcugcggcugcaccagcuccacgugccugcacaaggaguggccccacagccggaacuggcgcugcaaccccaccuggugcuggggcguggggaccgggugcacgugcugcggccucgacgucaaggaccuguucaccgacuacauguucgugaaguggaagguggaguacaucaagaccgaggcgaucgucugcguggagcugaccucccaggagcggcagugcagccugaucgaggccgggacccgcuucaaccucggcuccgugaccaucacccugagcgagccgcggaacauccagcagaagcugccgcccgagaucaucacgcuccaccccaagaucgaggagggcuucuucgaccugaugcacguccagaaggugcuguccgccagcaccgugugcaagcuccaguccugcacccacggggucccgggcgaccuccagguguaccacaucgggaaccugcugaagggcgaccgcgugaacggccaccugauccacaagaucgagcagcacuucaacaccagcuggauguccugggacgggugcgaccuggacuacuacugcaacaugggcgacuggcccagcugcacguacaccggggucacccagcacaaccacgccuccuucgugaaccuccugaacaucgagaccgacuacacgaagaccuuccacuuccacagcaagcgggugaccgcccacggcgacacgccccagcuggaccucaaggcgcgccccaccuacggggccggcgagaucaccguccugguggagguggccgacauggagcugcacaccaagaagaucgagaucagcggccucaaguucgccgggcugaccugcacgggcugcuacgccugcuccagcgggaucuccugcaagguccggauccacguggaggagccggacgagcugaccgugcacgucaagagcgacgaccccgacgugguggcggccuccagcucccucauggcccgcaagcuggaguucggcaccgacagcaccuucaaggccuucuccgccaugcccaagacgagccugugcuucuacaucgucgagcgggaguacugcaaguccugcagcaaggaggacacccagaagugcgugaacaccaagcucgagcagccgcaguccauccugaucgagcacaaggggaccaucaucggcaagcagaacaacacgugcaccgcgaaggccagcugcuggcuggaguccgucaagagcuucuucuacggccucaagaacaugcucgggggcaucuucgggaacguguucaucggcaucuucaccuuccugacccccuucauccugcugauccuguucuucauguucggguggcgcauccucuucugcuucaagugcugccggcgcacgcggggccuguucaaguaccgccaccugaaggacgacgaggagaccggcuaccggaagaucaucgagcgccucaacaacaagaaggggaagaaccggcugcuggacggcgagcgccucgccgaccgcaagaucgccgagcuguucuccaccaagacccacaucggg

SEQ ID NO: 12234 - RNA, 2916 nt, Artificial Sequence
  derived and/or modified CDS sequence (opt1) from CCHFV(Iran-53, Artificial)__DQ446216.1__Gn-4aa-Gc
agcgaggaguccggcgacgacugcaucagccgcacccagcugcuccggaccgagacggccgaggugcacggggacaacuacggcgggcccggcgacaagaucaccaucugcaacggguccaccgucguggaccagcgccugggcagcgagcugggcugcuacaccaucaaccgggugcgcuccuucaagcucugcgagaacagcgccacggggaaguccugcgagaucgacagcaucccggucaagugcaagcagggcuacugccugaagaucacccaggaggggcggggccacgugaagcugucccgcgggagcgaggugguccucgacgugugcgacuccagcugcgaggugaugauccccaagggcaccggcgacauccuggucgacugcuccgggggccagcagcacuuccugaaggacaaccucguggaccuggggugccccaagaucccccugcucggcaagauggcgaucuacaucugccggaugagcaaccacccgaagaccacgauggccuuccuguucugguucuccuucggcuacgugaucacgugcauccugugcaaggccaucuucuuccuccugaucaucuucgggacccugggcaagcgcuucaagcaguaccgggagcucaagccccagaccugcaccaucugcgagaccacccccgucaacgccaucgacgccgagaugcacgaccugaacugcagcuacaacaucugccccuacugcgcgucccgccugaccagcgacgggcucgcccggcacgugacgcagugcccgcgccggaaggagaagguggaggagaccgagcuguaccugaaccucgagcgcauccccugggucgugcggaagcugcuccagguguccgagagcaccggcaccguccugaagcgcagcuccuggcugaucgugcugcucgugcuguucacggucagccugucccccgugcagagcgcccccaucgggcggcgcccccucuuccuggacuccaucgugaagggcaugaagaaccugcucaacagcaccucccuggagaccagccuguccaucgaggcccccuggggcgcgaucaacguccagagcaccuacaagcccacgguguccaccgccaacaucgcccucagcugguccagcgucgagcaccgggggaacaaggugcugguguccggccgcagcgaguccaucaugaagcuggaggagcggaccgggaucagcugggaccucggcgucgaggacgccuccgagagcaagcugcugaccgugagcgugauggaccucucccagauguacagccccgucuucgaguaccuguccggggaccgccagguggaggaguggccgaaggccacgugcaccggcgacugccccgagcgcugcggcugcaccagcuccacgugccugcacaaggaguggccccacagccggaacuggcgcugcaaccccaccuggugcuggggcguggggaccgggugcacgugcugcggccucgacgucaaggaccuguucaccgacuacauguucgugaaguggaagguggaguacaucaagaccgaggcgaucgucugcguggagcugaccucccaggagcggcagugcagccugaucgaggccgggacccgcuucaaccucggcuccgugaccaucacccugagcgagccgcggaacauccagcagaagcugccgcccgagaucaucacgcuccaccccaagaucgaggagggcuucuucgaccugaugcacguccagaaggugcuguccgccagcaccgugugcaagcuccaguccugcacccacggggucccgggcgaccuccagguguaccacaucgggaaccugcugaagggcgaccgcgugaacggccaccugauccacaagaucgagcagcacuucaacaccagcuggauguccugggacgggugcgaccuggacuacuacugcaacaugggcgacuggcccagcugcacguacaccggggucacccagcacaaccacgccuccuucgugaaccuccugaacaucgagaccgacuacacgaagaccuuccacuuccacagcaagcgggugaccgcccacggcgacacgccccagcuggaccucaaggcgcgccccaccuacggggccggcgaggucaccgugcugguggaggucgccgacauggagcugcacaccaagaagaucgagaucagcggccucaaguucgccgggcugaccugcacgggcugcuacgccugcuccagcgggaucuccugcaaggugcggauccacguggacgagccggacgagcugaccguccacgucaagagcgacgaccccgacgugguggcggccuccagcucccucauggcccgcaagcuggaguucggcaccgacagcaccuucaaggccuucuccgccaugcccaagacgagccugugcuucuacaucguggagcgggaguacugcaaguccugcagcaaggaggacacccagaagugcgugaacaccaagcucgagcagccgcaguccauccugaucgagcacaaggggaccaucaucggcaagcagaacaacacgugcaccgcgaaggccagcugcuggcuggaguccgucaagagcuucuucuacggccucaagaacaugcucgggggcaucuucgggaacguguucaucggcaucuucaccuuccugacccccuucauccugcugauccuguucuucauguucggguggcgcauccucuucugcuucaagugcugccggcgcacgcggggccuguucaaguaccgccaccugaaggacgacgaggagaccggcuaccggaagaucaucgagcgccucaacaacaagaaggggaagaaccggcugcuggacggcgagcgccucgccgaccgcaagaucgccgagcuguucuccaccaagacccacaucggg

SEQ ID NO: 12235 - RNA, 2916 nt, Artificial Sequence
  derived and/or modified CDS sequence (opt1) from CCHFV(Kosova Hoti, Artificial)__EU037902.1__Gn-4aa-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccagaagggccgggggcacgugaagcugucccgcggcagcgaggucgugcucgacgcgugcgacuccaacugcgaggugaugauccccaaggggacgggcgacauccuggucgacugcagcggcgggcagcagcacuuccugaaggacaaccucaucgaccugggcugcccccacaucccgcugcucgggaagauggccaucuacaucugccggauguccaaccaccccaagaccaccauggccuuccuguucugguucagcuucggcuacgugaucacgugcaucuucugcaaggcccuguucuacucccucaucaucaucggcacccuggggaagaagaucaagcaguaccgcgagcugaagccccagaccugcaccaucugcgagaccgcccccgugaacgcgaucgacgccgagaugcacgaccucaacugcagcuacaacaucugcccguacugcgccucccggcugacgagcgacggccuggcccgccacgucaagcagugccccaagcggaaggagaagguggaggagaccgagcucuaccugaaccuggagcgcauccccugggugguccggaagcuccuccagguguccgagagcaccgggguggcgcugaagcgcuccagcuggcucaucguccugcuggugcuccugaccgugagccugucccccguccagagcgccccggugggccggaagccccucuuccuggacuccaucgugaaggggaugaagaaccugcucaacagcacgucccuggagaccagccuguccaucgaggcccccuggggcgccaucaacguccagagcaccuucaagcccaccguguccacggccaacaucgcgcucagcugguccagcguggagcaccgcggcaacaagauccuggucaccgggcgguccgagagcaucaugaagcuggaggagcgcaccggcaucuccugggaccucgggguggaggacgccagcgaguccaagcugcugaccgucagcaucauggaccucucccagauguacagcccgguguucgaguaccugagcggcgaccgccagguggaggaguggcccaaggccacgugcaccggggacugcccccagcggugcggcugcaccuccagcacgugccugcacaaggaguggccccacucccggaacuggcgcugcaacccgaccuggugcuggggcgucgggaccggcugcacgugcugcgggguggacgugaaggaccucuucaccgaccacauguucgucaaguggaagguggaguacaucaagaccgaggccaucgugugcgucgagcugaccagccaggagcgccagugcucccugaucgaggccggcacccgguucaaccuggggcccgugaccaucacccucagcgagccccgcaacauccagcagaagcugcccccggagaucaucacgcugcaccccaagaucgaggagggcuucuucgaccucaugcacgugcagaagguccuguccgcgagcaccgugugcaagcugcaguccugcacccacggcauccccggggaccuccagguguaccacaucggcaaccugcugaagggggaccgggucaacggccaccucauccacaagaucgagccccacuucaacaccagcuggauguccugggacggcugcgaccuggacuacuacugcaacaugggggacuggccgagcugcacguacaccggcgugacccagcacaaccacgccgccuucgugaaccugcucaacaucgagaccgacuacacgaagaccuuccacuuccacuccaagcgcgucaccgcccacggggacacgccccagcuggaccugaaggcccggcccaccuacggcgcgggggagaucaccgugcucguggaggucgccgacauggagcugcacaccaagaagguggagaucagcggccugaaguucgccucccucgccugcaccggcugcuacgccugcagcuccgggaucagcugcaaggugcgcauccacgucgacgagccggacgagcugacggugcacgucaagagcuccgaccccgacgugguggcggccggcaccagccugauggcccggaagcucgaguucgggaccgacuccaccuucaaggccuucagcgcgaugcccaagacgucccugugcuucuacaucguggagaaggaguacugcaagagcugcuccgaggacgacaccaagaagugcgucgacaccaagcuggagcagccccagagcauccucaucgagcaccgcggcaccaucaucgggaagcagaacgacacgugcaccgccaaggccuccugcuggcuggagagcgugaaguccuucuucuacggccugaagaacaugcucggcagcguguucgggaacuucuucaucggcauccugcuguuccucgccccguucguccugcuggugcuguucuucauguucggguggaagauccuguucugcuucaagugcugccggcgcacccggggccuguucaaguaccgccaccucaaggacgacgaggagaccggguaccggcgcaucaucgagcggcugaacaacaagaagggcaagaaccgccugcucgacggcgagcggcuggccgaccgcaagaucgcggagcuguucuccacgaagacccacaucggg

SEQ ID NO: 12236 - RNA, 2916 nt, Artificial Sequence
  derived and/or modified CDS sequence (opt1) from CCHFV(YL04057, Artificial)__FJ562094.1__Gn-4aa-Gc
gccgagggcgggagcuccgacugcaucagccgcacccagcuggugaagaccgaggucgccgagauccacgaggacuccuacggcgggcccggcgagaagaucacgaucugcaacgggagcaccaucguggaccagcggcucggccgcgagcugggcugcuacaccaucaaccgggugcgcuccuacaagcugugcgagaacagcgcguccggcaagagcugcgagaucgacuccaucccggucaagugcaagcagggguucugccucaagaucacccaggaggggcggggccacgugaagcugagccgcgggacggagaucgugcuggacgucugcgacuccagcugcgagcucaugauccccaagggcaccggcgacauccugguggacugcuccgggggccagcagcacuuccugcagaacaaccucaucgaccuggggugccccaacgugccccugcucggcaagauggccaucuacgucugccggaugagcaaccacccgaagaccaccauggccuuccuguucugguucuccuucggcuacgugaucacgugcaucgccugccgcgugcuguucuaccuccugaucgccaucgggaccgucggcaagaagcugaagcaguaccgggagcucaagccccagaccugcaucgugugcgagagcgugcccgucaacgcgaucgacgccgagaugcacgagcugaacugcuccuacaacaucugccccuacugcgccagccgccuguccaccgacgggcucauccggcacgugacgcagugcccgaagcgccgggagaagguggaggagaccgagcuguuccugaaccucgagcgcauccccuggcugguccggaagcugcuccaggugagcgagagcaccggcauggcccugaagcgcuccugcuggaugaucacccugcucauccugcugcucgugagcaucucccccguccagagcgcgcccguggggcggaagccgcuguuccuggacuccaucgccaagggcaagaagucccuccugaacagcacgagccuggagaccucccucagcaucgaggcccccuggggcgccaucaacgugcaguccaccuucaagcccaccgucagcgccgcgaacaucgcccuguccuggagcuccguggagcaccgcgggaacaagauccuggucagcggccgguccgagagcaucaugaagcucgaggagcgcacggggguguccuggaaccugggcguggaggacgccagcgagagcaagacccugaccgucuccgugauggaccucagccagauguacucccccguguucgaguaccugagcggggaccggcaggucgaggaguggccgaaggcgaccugcacgggcgacugccccgagcgcugcggcugcaccuccagcacgugccugcacaaggaguggccccacucccgcaacuggcggugcagccccaccuggugcuggggcguggggaccgggugcacgugcugcggccucgacgugaaggacuucuucaccgacuacaugcuggucaaguggaagguggaguacaucaagaccgaggccaucgugugcgucgagcugaccucccaggagcgccagugcagccugaucgaggccgggacccgguucaaccucggcccggugaccaucacccuguccgagccccgcaacgugcagcagcggcugccgcccgagaucgucacgcuccaccccaagaucgaggagggcuucuucgaccugaugcacgugcagaagauccugagcgccuccaccgugugcaagcuccagagcugcacccacgggguccccggcgacuuccagguguaccacguggggaaccugcugcgcggcgacaaggucaacggccacuccauccacaagaucgagccccacuucaacaccagcuggauguccugggacgggugcgaccucgacuacuucugcaacaugggcgacuggcccagcugcaccuacacgggggugacccagcacaaccgggccgccuucaucaacaugcugaacaucgagaccgacuacaccaagacguuccacuuccacagcaagcgcgugaccgcccacggcgacaccccgcagcuggaccucaaggcgcggcccgccuacggggccggcgaggucaccgugcugguggaggucgccgaccuggagcuccacacgaagaagcuggagguguccggccugaagaucgccagccugaccugcuccgggugcuacgcgugcagcuccggcaucagcugcaaggugcgcauccacgucaacgagcccgacgaguucaccgugcacgugcgguccagcgacccggacgucguggccgccggguccagccugauggcccgcaagaucgaguucggcgcggacuccaccuucaaggccuucagcuccaugcccaaggacagccugugcuucuacaucguggagaaggacuacugcuccagcugcacggacgacgacacccagaagugcgucaacaccaagcucgaccacccccaguccauccugaucgagcacaaggggaccaucaucggcaagcagaacgacacgugcagcaccaagaccuccugcuggcuggagagcgugaagggcuucuucuacgggcucaagaacaugcugagcggcaucuucgggaacguguuccugggcauccuccuguuccuggcccccuucguccuccugaucuucuucuucuucuucggguggcggcuccucuucugccugaagugcugccgccggacccgcggccugcucaaguacaagcaccugaaggacgaggaggaggccggcuacaagaagaucaucgagcggcugaacgggaagaagggcaagucccagcuguucgacggggagcgccucgccgaccggaagaucgcggagcuguucagcacgaagauccacaucggc

SEQ ID NO: 12237 - RNA, 2916 nt, Artificial Sequence
  derived and/or modified CDS sequence (opt1) from CCHFV(V42/81, Artificial)__GU477490.1__Gn-4aa-Gc
agcaaggagcccggcgacgacugcaucucccgcacccagcugaugcggaccgagacggccgagauccacgacgacaacuacgggggcccgggggacaagaucaccaucugcaacggcagcaccaucguggaccagcgccucggguccgagcugggcugcuacaccaucaaccgggucaagagcuucaagcugugcgagaacuccgccacgggcaaggcgugcgagguggacagcacccccgugaagugccgccagggguucugccucaagaucacccaggagggccgggggcacgucaagcugucccgcggcagcgagguggugcuggacgccugcgacuccagcugcgaggucaugauccccaaggggaccggcgacauccucguggacugcuccggcgggcagcagcacuuccugaaggacaaccugaucgaccucgagugcccccacaucccgcugcugggcaagcucgccaucuacaucugccggaugagcaaccacccccgcacgaccauggccuuccuguucugguucggguucggcuacgugaucaccugcauccugugcaaggcccucuucuacucccugaucaucaucggcacccuggggaagaagaucaagcaguaccgggagcucaagccccagacgugcaccaucugcgagaccgcgcccgucaacgccaucgacgccgagaugcacgaccugaacugcagcuacaacaucugcccguacugcgccucccgccugaccagcgacggccucgcgcggcacgugacgcagugccccaagcgcaaggagaagguggaggagaccgagcuguaccugaaccucgagcggauccccuggaucguccgcaagcugcugcagguguccgagagcaccggggugguccucaagcgguccagcuggcugaucgugcugcucgugcugcugaccgucagccucucccccgugcagagcgccccggugggccgcaagccccuguuccuggacuccaucgucaaggggaagaagaaccuccugaacagcacgucccuggagaccagccucuccaucgaggcccccuggggcgccaucaacauccagagcaccuucaagcccaccguguccgccgcgaacaucgcccugagcugguccagcguggagcaccggggcaacaagauccuggucuccgggcgcagcgaguccaucaugaagcucgaggagcggacgggcgugagcuggaaccugggggucgaggacgccuccgagagcaagcugcucaccguguccaucauggaccugagccagauguacagcccgguguucgaguaccuguccggcgaccgccaggucgaggaguggcccaaggccaccugcaccggggacugccccgagcggugcggcugcacgagcuccaccugccuccacaaggaguggccccacagccgcaacuggcgcugcaacccgaccuggugcuggggcguggggaccggcugcacgugcugcgggguggacgucaaggaccuguucaucgaccacauguucgugaaguggaagguggaguacaucaagaccgaggccaucgucugcguggagcugaccucccaggagcggcagugcagccugaucgaggcgggcacccgcuucaaccucgggcccgugacgaucacccuguccgagccccggaacauccagcagaagcugcccccggagaucaucacccuccaccccaagaucgaggagggcuucuucgaccugaugcacguccagaaggugcugagcgccuccaccgugugcaagcuccagagcugcacccacggcauccccggggaccugcaggucuaccacaucggcaaccugcucaagggggaccgcgugaacggccaccugauccacaagaucgagccccacuucaacacguccuggaugagcugggacggcugcgaccuggacuacuacugcaacaugggggacuggccguccugcaccuacaccggcgugacccagcacaaccacgccgccuucgucaaccuccugaacaucgagacggacuacaccaagaccuuccacuuccacagcaagcgggugaccgcccacggggagacgccccagcuggaccucaaggcgcgccccgccuacggcgccggggagaucaccgugcuggucgagguggccgacauggagcugcacaccaagaagguggagaucuccggccucaaguucgccagccuggcgugcaccggcugcuacgccugcuccagcgggaucagcugcaagguccggauccacguggacgagccggacgagcugacggugcacgucaaguccaacgaccccgacgugguggccgccagcaccucccucauggcgcgcaagcuggagagcggcaccgacuccaccuucaaggccuucagcgccaugcccaagacgucccugugcuucuacaucgucgagcgggaguacugcaagagcugcuccgaggacgacacccagaagugcguggagaccaagcucgagcagccccagagcauccugaucgagcacaaggggaccaucaucggcaagcagaacgacacgugcaccgccaaggccuccugcuggcuggagagcgugaaguccuucuucuacgggcucaagaacaugcugggcagcgucuucggcaacuucuucaucgggauccugcucuuccuggcgccguucgugcugcucgugcuguucuucauguucggcuggaagauccuguucugcuucaagugcugccgccggacccgcgggcucuucaaguaccggcaccugaaggaggacgaggagaccggcuaccgccggaucaucgagcgccugaacuccaagaaggggaagaaccggcuccuggacggcgagcgccuggccgaccggaagaucgccgagcucuucagcacgaagacccacaucggc

SEQ ID NO: 12238 - RNA, 2916 nt, Artificial Sequence
  derived and/or modified CDS sequence (opt1) from CCHFV(79121M18, Artificial)__GU477493.1__Gn-4aa-Gc
gccgagggcgggagcuccgacugcaucagccgcacccagcuggugaagaccgaggucgccgagauccacgaggacuccuacggcgggcccggcgagaagaucacgaucugcaacgggagcaccaucguggaccagggccucggcuccgagcuggggugcuacaccaucaaccgggugcgcagcuacaagcugugcgagaacuccgcgagcggcaaguccugcgagaucgacagcaucccggucaagugcaagcagggguucugccucaagaucacccaggagggccgggggcacgugaagcugucccgcggcacggagaucgugcuggacgucugcgacagcuccugcgagcucaugauccccaagggcaccggggacauccugguggacugcagcggcgggcagcagcacuuccugcagaacaaccucaucgaccugggcugccccaacgugccccugcucggcaagauggccaucuacgucugccggauguccaaccacccgaagaccaccauggccuuccuguucugguucagcuucggguacgugaucacgugcaucgccugccgcgugcuguucuaccuccugaucgccaucggcaccgucgggaagaagcugaagcaguaccgggagcucaagccccagaccugcaucgugugcgaguccgugcccgucaacgcgaucgacgccgagaugcacgagcugaacugcagcuacaacaucugccccuacugcgccucccgccugagcaccgacggccucauccggcacgugacgcagugcccgaagcgccgggagaagguggaggagaccgagcuguuccugaaccucgagcgcauccccuggcugguccggaagcugcuccaggugagcgaguccaccgggauggcccugaagcgcagcugcuggaugaucacccugcucauccugcugcucguguccaucagccccguccaguccgcgcccgugggccggaagccgcuguuccuggacagcacggccaagggcaugaagucccuccugaacagcaccucccuggagaccagccucuccaucgaggcccccuggggcgccaucaacgugcagagcaccuucaagcccacggucuccgccgcgaacaucgcccugagcugguccagcguggagcaccgcgggaacaagauccuggucuccgggcggagcgaguccaucaugaagcucgaggagcgcaccggcgugagcuggaaccuggggguggaggacgccagcgaguccaagacccugaccgucagcgugauggaccucucccagauguacagccccguguucgaguaccuguccggcgaccggcaggucgaggaguggccgaaggccacgugcaccggcgacugccccgagcgcugcgggugcaccagcuccacgugccugcacaaggaguggccccacagccggaacuggcgcugcaaccccaccuggugcuggggcguggggaccggcugcacgugcugcgggcucgacgugaaggacuucuucaccgacuacaugcuggucaaguggaagguggaguacaucaagaccgaggccaucgugugcgucgagcugaccucccaggagcgccagugcagccugaucgaggcgggcacccgguucaaccucggcccggugaccaucacgcuguccgagccccgcaacgugcagcagcggcugccgcccgagaucgucacccuccaccccaagaucgaggagggguucuucgaccugaugcacgugcagaagauccugagcgccuccaccgugugcaagcuccagagcugcacccacggcguccccggggacuuccagaucuaccacgugggcaaccugcugcgcggcgacaaggugaacgggcacuccauccacaagaucgagccccacuucaacaccagcuggauguccugggacggcugcgaccucgacuacuucugcaacaugggggacuggcccagcugcacguacaccggcgucacccagcacaaccgggccgccuucaucaacaugcugaacaucgagaccgacuacacgaagaccuuccacuuccacagcaagcgcgugaccgcccacggggacaccccgcagcuggaccucaaggcgcggcccgccuacggcgccggcgaggugacgguccugguggagguggccgaccuggagcuccacaccaagaagcuggaggucuccgggcugaagaucgccagccugaccugcuccggcugcuacgcgugcagcuccgggaucagcugcaaggugcgcauccacgugaacgagcccgacgaguucaccguccacgugcgguccagcgacccggacguggucgccgccggcuccagccucauggcccgcaagaucgaguucggggcggacuccacguucaaggccuucagcuccaugcccaaggacagccugugcuucuacaucguggagaaggacuacugcuccagcugcaccgacgacgacacccagaagugcgugaacaccaagcucgaccacccccaguccauccugaucgagcacaagggcacgaucaucggcaagcagaacgacacgugcagcaccaagaccuccugcuggcuggagagcgucaagggguucuucuacggccucaagaacaugcugagcgggaucuucggcaacguguuccuggggaucuuccucuuccuggcccccuucgugcugcucaucuucuucuucuucuucggcuggcggcugcuguucugccucaagugcugccgccggacccgcggccugcugaaguacaagcaccucaaggacgaggaggaggccggguacaagaagaucaucgagcggcugaacggcaagaaggggaagucccagcuguucgacggcgagcgccucgccgaccggaagaucgcggagcuguucagcaccaagauccacaucggg

SEQ ID NO: 12239 - RNA, 2916 nt, Artificial Sequence
  derived and/or modified CDS sequence (opt1) from CCHFV(Afg09-2990, Artificial)__HM452306.1__Gn-4aa-Gc
agcgaggaguccggcgacgacugcaucagccgcacccagcugcuccggaccgagacggccgaggugcacggggacaacuacggcgggcccggcgacaagaucaccaucugcaacggguccaccgucguggaccagcgccugggcagcgagcugggcugcuacaccaucaaccgggugcgcuccuucaagcucugcgagaacagcgccacggggaaguccugcgagaucgacagcaucccggucaagugcaagcagggcuacugccugaagaucacccaggaggggcggggccacgugaagcugucccgcgggagcgaggugguccucgacgugugcgacuccagcugcgaggugaugauccccaagggcaccggcgacauccuggucgacugcuccgggggccagcagcacuaccugaaggacaaccucguggaccuggggugccccaagaucccccugcucggcaagauggcgaucuacaucugccggaugagcaaccacccgaagaccacgauggccuuccuguucugguucuccuucggcuacgugaucacgugcauccugugcaaggccaucuucuuccuccugaucaucuucgggacccugggcaagcgcuucaagcaguaccgggagcucaagccccagaccugcaccaucugcgagaccacccccgucaacgccaucgacgccgagaugcacgaccugaacugcagcuacaacaucugccccuacugcgcgucccgccugaccagcgacgggcucgcccggcacgugacgcagugcccgcgccggaaggagaagguggaggagaccgagcuguaccugaaccucgagcgcauccccugggucgugcggaagcugcuccagguguccgagagcaccggcaccguccugaagcgcagcuccuggcugaucgugcugcucgugcuguucacggucagccugucccccgugcagagcgcccccaucgggcggcgcccccucuuccuggacuccaucgugaagggcaugaagaaccugcucaacagcaccucccuggagaccagccuguccaucgaggcccccuggggcgcgaucaacguccagagcaccuacaagcccacgguguccaccgccaacaucgcccucagcugguccagcgucgagcaccgggggaacaaggugcugguguccggccgcagcgaguccaucaugaagcuggaggagcggaccgggaucagcugggaccucggcgucgaggacgccuccgagagcaagcugcugaccgugagcgugauggaccucucccagauguacagccccgucuucgaguaccuguccggggaccgccagguggaggaguggccgaaggccacgugcaccggcgacugccccgagcgcugcggcugcaccagcuccacgugccugcacaaggaguggccccacagccggaacuggcgcugcaaccccaccuggugcuggggcguggggaccgggugcacgugcugcggccucgacgucaaggaccuguucaccgacuacauguucgugaaguggaagguggaguacaucaagaccgaggcgaucgucugcguggagcugaccucccaggagcggcagugcagccugaucgaggccgggacccgcuucaaccucggcuccgugaccaucacccugagcgagccgcggaacauccagcagaagcugccgcccgagaucaucacgcuccaccccaagaucgaggagggcuucuucgaccugaugcacguccagaaggugcuguccgccagcaccgugugcaagcuccaguccugcacccacggggucccgggcgaccuccagguguaccacaucgggaaccugcugaagggcgaccgcgugaacggccaccugauccacaagaucgagcagcacuucaacaccagcuggauguccugggacgggugcgaccuggacuacuacugcaacaugggcgacuggcccagcugcacguacaccggggucacccagcacaaccacgccuccuucgugaaccuccugaacaucgagaccgacuacacgaagaccuuccacuuccacagcaagcgggugaccgcccacggcgacacgccccagcuggaccucaaggcgcgccccaccuacggggccggcgagaucaccguccugguggagguggccgacauggagcugcacaccaagaagaucgagaucagcggccucaaguucgccgggcugaccugcacgggcugcuacgccugcuccagcgggaucuccugcaagguccggauccacguggacgagccggacgagcugaccgugcacgucaagagcgacgaccccgacgugguggcggccuccagcucccucauggcccgcaagcuggaguucggcaccgacagcaccuucaaggccuucuccgccaugcccaagacgagccugugcuucuacaucgucgagcgggaguacugcaaguccugcagcaaggaggacacccagaagugcgugaacaccaagcucgagcagccgcaguccauccugaucgagcacaaggggaccaucaucggcaagcagaacaacacgugcaccgcgaaggccagcugcuggcuggaguccgucaagagcuucuucuacggccucaagaacaugcucgggggcaucuucgggaacguguucaucggcaucuucaccuuccugacccccuucauccugcugauccuguucuucauguucggguggcgcauccucuucugcuucaagugcugccggcgcacgcggggccuguucaaguaccgccaccugaaggacgacgaggagaccggcuaccggaagaucaucgagcgccucaacaacaagaaggggaagaaccggcugcuggacggcgagcgccucgccgaccgcaagaucgccgagcuguucuccaccaagacccacaucggg

SEQ ID NO: 12240 - RNA, 2916 nt, Artificial Sequence
  derived and/or modified CDS sequence (opt1) from CCHFV(Sudan Al-Fulah 3-2008, Artificial)__HQ378184.1__Gn-4aa-Gc
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggugaaguccuucaagcucugcgagaacagcgccacgggcaaguccugcgugaucgacagcgugcccgucaagugccgccagggguacugccugcggaucacccaggagggccgcgggcacgugaagcugucccggggcagcgaggugguccucgacgcgugcgacaccuccugcgagaucaugauccccaaggggaccggcgacauccugguggacugcagcggcgggcagcagcacuuccugaaggacaaccucguggaccugggcugccccaagaucccgcugcucgggaagauggccaucuacaucugccgcauguccaaccaccccaagacgaccauggccuuccuguucugguucagcuucggcuacgucaucacgugcauccugugcaaggccaucuucuaccuccugaucaucaucggcacccuggggaagcgguuccgccaguaccgggagcucaagccccagaccugcaccaucugcgagaccacccccgugaacgccaucgacgcggagaugcacgaccugaacugcuccuacaacaucugcccguacugcgccagccgccugacguccgacggccucgcccggcacgugacccagugccccaagcgcaaggagaaggucgaggagaccgagcuguaccugaaccucgagcggauccccuggguggugcgcaagcugcugcaggucagcgaguccaccgggguggcccucaagcggagcagcuggcugaucgugcugcucguccuguucacggugucccugagccccgugcaguccgcgccgaucggccgccggccccucuuccuggacagcaucgucaaggggaugaagaaccugcucaacuccaccagccuggagaccucccugagcaucgaggcccccuggggcgccaucaacgugcaguccaccuacaagcccacggugagcaccgccaacaucgcccucuccuggagcuccgucgagcaccgcggcaacaagauccuggugagcgggcgguccgagagcaucaugaagcuggaggagcgcaccggcaucuccugggaccucggggucgaggacgcgagcgaguccaagcugcugaccgugagcgugauggaccucagccagauguacuccccggucuucgaguaccugagcggcgaccgccagguggaggaguggcccaaggccacgugcaccggggacugccccgagcggugcggcugcaccuccagcacgugccugcacaaggaguggccccacucccgcaacuggcggugcaacccgaccuggugcuggggcguggggaccggcugcacgugcugcgggcucgacgucaaggaccuguucaccgacuacauguucgugaaguggaagguggaguacaucaagaccgaggccaucgucugcguggagcugaccagccaggagcgccagugcucccugaucgaggccggcacccgguucaaccucgggcccgugaccaucacccugagcgagccccgcaacauccagcagaagcugcccccggagaucaucacgcuccacccccggaucgaggagggcuucuucgaccugaugcacguccagaaggugcuguccgccagcaccgugugcaagcuccaguccugcacccacggcguccccggggaccuccagguguaccacaucggcaaccugcucaagggggacaaggugaacggccaccugauccacaagaucgagccccacuucaacaccagcuggauguccugggacggcugcgaccuggacuacuacugcaacaugggggacuggccgagcugcacguacaccggcgucacccagcacaaccacgcguccuucgugaaccuccugaacaucgagaccgacuacacgaagaacuuccacuuccacagcaagcgcgugaccgcccacggggacacgccccagcuggaccucaaggcccggcccaccuacggcgccggggagaucaccguccugguggagguggccgacauggagcugcacaccaagaagaucgagaucuccggccucaaguucgcgagccugaccugcaccggcugcuacgccugcagcuccgggaucagcugcaagguccgcauccacguggacgagccggacgagcugacggugcacgucaaguccgacgaccccgacgugguggccgccagcuccagccucauggcccggaagcuggaguucggcaccgacuccaccuucaaggcguucagcgccaugcccaagaccucccugugcuucuacaucgucgagaaggaguacugcaagagcugcuccgaggaggacacgaagaagugcgugaacaccaagcucgagcagccccagagcauccugaucgagcacaaggggaccaucaucggcaagcagaacuccacgugcaccgccaaggugagcugcuggcuggaguccgccaagagcuucuucuacgggcucaaggacaugcuguccggcaucuucggcaacgucuucaucgggaucuuccuguuccucgcgccguucgugcugcugguccucuucuucauguucggcuggcgcauccugcugugcuuccggugcugccgccggacccgcggccucuucaaguaccggcaccugaaggacgacgaggagaccggguaccgccggaucaucgagcgccugaacaacaagaaggggaagaacaagcuccuggacggcgagcgccuggccgaccggaagaucgccgagcuguucagcaccaagacgcacaucggc

SEQ ID NO: 12241 - RNA, 2916 nt, Artificial Sequence
  derived and/or modified CDS sequence (opt1) from CCHFV(Sudan AB1-2009, Artificial)__HQ378187.1__Gn-4aa-Gc
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggugaaguccuucaagcucugcgagaacagcgccacgggcaagaacugcgagaucgacuccgugcccgugaagugccgccagggguacugccugcggaucacccaggagggccgcgggcacgucaagcugagccggggcuccgagguggugcucgacgcgugcgacaccagcugcgagaucaugauccccaaggggaccggcgacauccuggucgacugcuccggcgggcagcagcacuuccugaaggacaaccucaucgaccugggcugccccaagaucccgcugcucgggaagauggccaucuacaucugccgcaugagcaaccaccccaagacgaccauggccuuccuguucugguucuccuucggcuaccugaucacgugcauccucugcaaggccaucuucuaccugcugaucaucaucggcacccucgggaagcggcugaagcaguaccgcgagcugaagccccagaccugcaccaucugcgagaccacccccgugaacgccaucgacgcggagaugcacgaccucaacugcagcuacaacaucugcccguacugcgccucccggcugacgagcgacggccuggcccgccacgugauccagugccccaagcggaaggagaaggucgaggagaccgagcucuaccugaaccuggagcgcauccccuggguggugcggaagcuccugcaggucuccgagagcaccgggguggcccugaagcgcuccagcuggcucaucgugcugcugguccucuucaccgugagccugucccccgugcagagcgcgccgaucggccggaagccccuguuccucgacuccaucgccaaggggaugaagaaccugcugaacagcacgucccucgagaccagccuguccaucgaggcccccuggggcgccaucaacguccagagcaccuacaagcccaccguguccacggccaacaucgcgcugagcugguccagcguggagcaccgcggcaacaagauccucgucuccgggcggagcgaguccaucaugaagcuggaggagcgcaccggcaucagcugggaccuggggguggaggacgccuccgagagcaagcuccugaccguguccgucauggaccugagccagauguacagcccgguguucgaguaccucuccggcgaccggcaggucgaggaguggcccaaggcgaccugcacgggggacugccccgagcgcugcggcugcaccagcuccacgugccugcacaaggaguggccccacagccgcaacuggcggugcaacccgaccuggugcuggggcguggggaccggcugcacgugcugcgggcuggacgugaaggaccuguucaccgacuacauguucgucaaguggaagguggaguacaucaagaccgaggccaucgugugcgucgagcucaccucccaggagcgccagugcagccugaucgaggccggcacccgguucaaccuggggcccgugaccaucacccucuccgagccccgcaacauccagcagaagcugcccccggagaucaucacccugcacccccggaucgaggagggcuucuucgaccucaugcacgugcagaagguccugagcgccuccacggugugcaagcugcagagcugcacccacggcgugcccggggaccuccaggucuaccacaucggcaaccugcugaagggggacaaggugaacggccaccucauccacaagaucgagccccacuucaacaccuccuggaugagcugggacggcugcgaccuggacuacuacugcaacaugggggacuggccguccugcaccuacacgggcgugacccagcacaaccacgccagcuucgucaaccugcucaacaucgagaccgacuacaccaagaacuuccacuuccacuccaagcgcgugacggcccacggggacacgccccagcuggaccugaaggcccggcccaccuacggcgccggggagaucaccgugcucgucgagguggcggacauggagcugcacaccaagaagaucgagaucagcggccugaaguucgccucccugaccugcaccggcugcuacgccugcagcagcgggaucuccugcaaggugcgcauccacgucgacgagccggacgagcucaccgugcacgucaagagcgacgaccccgacgugguggccgccuccagcucccugauggcgcggaagcucgaguucggcacggacagcaccuucaaggccuucuccgccaugcccaagaccagccugugcuucuacaucguggagcgcgagcacugcaaguccugcaacgaggaggacaccaagaagugcgucaacacgaagcuggagcagccccagagcauccucaucgagcacaaggggaccaucaucggcaagcagaacuccacgugcaccgcccgggcgagcugcuggcuggaguccgucaagagcuucuucuacgggcugaagaacaugcucuccggcaucuucggcaacguguucauggggaucuuccuguuccuggccccguucauccuccugauccuguucuucauguucggcuggcgcauccucuucugcuucaagugcugccggcgcacccgggggcuguucaaguaccgccaccugaaggacgacgaggagaccggcuaccggcgcaucaucgagcggcucaacaacaagaaggggaagaacaagcugcuggacggcgagcgccucgccgaccgccggaucgccgagcuguucagcaccaagacccacaucggc

SEQ ID NO: 12242 - RNA, 2916 nt, Artificial Sequence
  derived and/or modified CDS sequence (opt1) from CCHFV(NIVA 118595, Artificial)__JN572083.1__Gn-4aa-Gc
agcgaggaguccggcgacgacugcaucagccgcacccagcugcuccggaccgagacggccgaggugcacggggacaacuacggcgggcccggcgacaagaucaccaucugcaacggguccaccgucguggaccagcgccugggcagcgagcugggcugcuacaccaucaaccgggugaaguccuucaagcucugcgagaacagcgccacggggaaguccugcgagaucgacagcaucccggucaagugccgccagggcuacugccugaagaucacccaggaggggcggggccacgugaagcugucccgcgggagcgaggugguccucgacgcgugcgacuccagcugcgaggugaugauccccaagggcaccggcgacauccugguggacugcuccgggggccagcagcacuuccugaaggacaaccucaucgaccuggggugccccaagaucccccugcucggcaagauggccaucuacaucugccggaugagcaaccacccgaagaccacgauggccuuccuguucugguucuccuucggcuacgucaucacgugcauccugugcaaggugaucuucuaccuccugaucaucuucgggacccugggcaagcgcuucaagcaguaccgggagcucaagccccagaccugcaccaucugcgagaccacccccgugaacgccaucgacgccgagaugcacgaccugaacugcagcuacaacaucugccccuacugcgcgucccgccugaccagcgacgggcucgcccggcacgucacgcagugcccgaagcgcaaggagaagguggaggagaccgagcuguaccugaaccucgagcggauccccugggugguccgcaagcugcuccagguguccgagagcaccggcaucgcccugaagcggagcuccuggcugaucgugcugcucguccuguucaccgugagcaucacgcccgugcaguccgcccccaucgggcgccggccgcuguuccucgacagcaucgucaagggcaugaagaaccugcugaacuccaccagccucgagaccucccugagcaucgaggcgcccuggggcgccaucaacgugcaguccaccuacaagcccacggugagcgccgccaacaucgcccuguccuggagcuccgucgagcaccgcgggaacaagauccucgugagcggccgguccgagagcaucaugaagcuggaggagcgcaccgggaucuccugggaccugggcgucgaggacgcgagcgaguccaagcuccugaccgugagcgugauggaccugagccagauguacucccccgucuucgaguaccucagcggggaccgccagguggaggaguggccgaaggcgaccugcacgggcgacugccccgagcggugcggcugcaccuccagcacgugccugcacaaggaguggccccacucccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccugggcagcgugaccaucacccucuccgagccgcgcaacauccagcagaagcugccgcccgagaucaucacccugcacccccggaucgaggagggcuucuucgaccucaugcacguccagaaggugcugagcgccuccacggugugcaagcugcagagcugcacccacgggguccccggcgaccuccagguguaccacaucgggaaccugcugaagggcgaccgcgugaacggccaccucauccacaagaucgagcagcaccugaacaccuccuggaugagcugggacgggugcgaccuggacuacuacugcaacaugggcgacuggcccuccugcaccuacacgggggucacccagcacaaccacgccagcuucgugaaccuccugaacaucgagaccgacuacaccaagacguuccacuuccacuccaagcgggugaccgcccacggcgacacgccccagcuggaccucaaggcccgccccaccuacggggccggcgagaucaccguccugguggagguggccgacauggagcugcacaccaagaagaucgagaucagcggccucaaguucgcgagccuguccugcaccgggugcuacgccugcagcuccggcaucagcugcaagguccggauccacguggacgagccggacgagcugaccgugcacgucaaguccgacgaccccgacgugguggccgccagcuccagccucauggcccgcaagcuggaguccgggacggacagcaccuucaaggcguucuccgccaugcccaagaccagccugugcuucuacaucgucgagcgggaguacugcaagggcugcuccaaggaggacacccagaagugcgugaacacgaagcucgagcagccgcagagcauccugaucgagcacaaggggaccaucaucggcaagcagaacaacacgugcaccgccaaggccuccugcuggcuggagagcgugaaguccuucuucuacggccucaagaacaugcugagcgggaucuucggcaacgucuuccuggggaucuucuccuuccucgcgcccuucgugcugcugauccucuucuucauguucggcuggcgcauccuguucugcuucaagugcugccggcgcacccgggggcuguucaaguaccgccaccucaaggacgacgaggagaccggcuaccggaagaucaucgagcgccugaacaacaagaagggcaagaacaagcugcucgacggggagcggcuggccgaccgcaagaucgccgagcuguucagcaccaagacccacaucggc

SEQ ID NO: 12243 - RNA, 2916 nt, Artificial Sequence
  derived and/or modified CDS sequence (opt1) from CCHFV(NIV 112143, Artificial)__JN572085.1__Gn-4aa-Gc
agcgaggaguccggcgacgacugcaucagccgcacccagcugcuccggaccgagacggccgaggugcacggggacaacuacggcgggcccggcgacaagaucaccaucugcaacggguccaccgucguggaccagcgccugggcagcgagcugggcugcuacaccaucaaccgggugaaguccuucaagcucugcgagaacagcgccacggggaaguccugcgagaucgacagcaucccggucaagugccgccagggcuacugccugaagaucacccaggaggggcggggccacgugaagcugucccgcgggagcgaggugguccucgacgcgugcgacuccagcugcgaggugaugauccccaagggcaccggcgacauccugguggacugcuccgggggccagcagcacuuccugaaggacaaccucaucgaccuggggugccccaagaucccccugcucggcaagauggccaucuacaucugccggaugagcaaccacccgaagaccacgauggccuuccuguucugguucuccuucggcuacgucaucacgugcauccugugcaaggugaucuucuaccuccugaucaucuucgggacccugggcaagcgcuucaagcaguaccgggagcucaagccccagaccugcaccaucugcgagaccacccccgugaacgccaucgacgccgagaugcacgaccugaacugcagcuacaacaucugccccuacugcgcgucccgccugaccagcgacgggcucgcccggcacgucacgcagugcccgaagcgcaaggagaagguggaggagaccgagcuguaccugaaccucgagcggauccccugggugguccgcaagcugcuccagguguccgagagcaccggcaucgcccugaagcggagcuccuggcugaucgugcugcucguccuguucaccgugagcaucacgcccgugcaguccgcccccaucgggcgccggccgcuguuccucgacagcaucgucaagggcaugaagaaccugcugaacuccaccagccucgagaccucccugagcaucgaggcgcccuggggcgccaucaacgugcaguccaccuacaagcccacggugagcgccgccaacaucgcccuguccuggagcuccgucgagcaccgcgggaacaagauccucgugagcggccgguccgagagcaucaugaagcuggaggagcgcaccgggaucuccugggaccugggcgucgaggacgcgagcgaguccaagcuccugaccgugagcgugauggaccugagccagauguacucccccgucuucgaguaccucagcggggaccgccagguggaggaguggccgaaggcgaccugcacgggcgacugccccgagcggugcggcugcaccuccagcacgugccugcacaaggaguggccccacucccgcaacuggcggugcaaccccaccuggugcuggggcguggggaccgggugcacgugcugcggccuggacgucaaggaccucuucaccgacuacauguucgugaaguggaagguggaguacaucaagaccgaggccaucgucugcguggagcugaccagccaggagcgccagugcucccugaucgaggccgggacccgguucaaccugggcagcgugaccaucacccucuccgagccgcgcaacauccagcagaagcugccgcccgagaucaucacccugcacccccggaucgaggagggcuucuucgaccucaugcacguccagaaggugcugagcgccuccacggugugcaagcugcagagcugcacccacgggguccccggcgaccuccagguguaccacaucgggaaccugcugaagggcgaccgcgugaacggccaccucauccacaagaucgagcagcaccugaacaccuccuggaugagcugggacgggugcgaccuggacuacuacugcaacaugggcgacuggcccuccugcaccuacacgggggucacccagcacaaccacgccagcuucgugaaccuccugaacaucgagaccgacuacaccaagacguuccacuuccacuccaagcgggugaccgcccacggcgacacgccccagcuggaccucaaggcccgccccaccuacggggccggcgagaucaccguccugguggagguggccgacauggagcugcacaccaagaagaucgagaucagcggccucaaguucgcgagccuguccugcaccgggugcuacgccugcagcuccggcaucagcugcaagguccggauccacguggacgagccggacgagcugaccgugcacgucaaguccgacgaccccgacgugguggccgccagcuccagccucauggcccgcaagcuggaguucgggacggacuccaccuucaaggcguucagcgccaugcccaagaccucccugugcuucuacaucgucgagcgggaguacugcaagggcugcagcaaggaggacacccagaagugcgugaacacgaagcucgagcagccgcaguccauccugaucgagcacaaggggaccaucaucggcaagcagaacaacacgugcaccgccaaggccagcugcuggcuggaguccgucaagagcuucuucuacggccucaagaacaugcuguccgggaucuucggcaacguguuccuggggaucuucagcuuccucgcgcccuucgugcugcugauccucuucuucauguucggcuggcgcauccuguucugcuucaagugcugccggcgcacccgggggcuguucaaguaccgccaccucaaggacgacgaggagaccggcuaccggaagaucaucgagcgccugaacaacaagaagggcaagaacaagcugcucgacggggagcggcuggccgaccgcaagaucgccgagcuguucuccaccaagacccacaucggc

SEQ ID NO: 12244 - RNA, 2916 nt, Artificial Sequence
  derived and/or modified CDS sequence (opt1) from CCHFV(SCT ex Afghanistan, Artificial)__KC344856.1__Gn-4aa-Gc
agcgaggaguccggcgacgacugcaucagccgcacccagcuccuccggaccgagacggccgaggugcacaacgacaacuacgggggccccggggacaagaucaccaucugcaacggcuccaccaucgucgaccagcgccuggggagcgagcugggcugcuacaccaucaaccgggugaaguccuucaagcucugcgagaacagcgccacgggcaaguccugcaagaucgacagcaccccggugaagugccgccagggguucugccugaagaucacccaggagggccgggggcacgucaagcugucccgcggcagcgagguggugcucgacgcgugcgacuccagcugcgagaucaugauccccaaggggaccggcgacauccuggucgacugcuccggcgggcagcagcacuuccugaaggacaaccucaucgaccugggcugccccaacaucccccugcucgggaagauggccaucuacaucugccggaugagcaaccacccgaagacgaccauggccuuccuguucugguucuccuucggcuacgugaucacgugcaucuucugcaaggugaucuucuaccugcucaucgucgugggcacccuggggaagaaguucaagcaguaccgcgagcugaagccccagaccugcaccaucugcgagaccacccccacgaacgccaucgacgccgagaugcacgaccucaacugcagcuacaacaucugccccuacugcgcgucccggcugaccagcgacggccuggcccgccacgugacccagugcccgaagcggaaggagaaggucgaggagaccgagcucuaccugaaccuggagcgcauccccuggaucgugcggaagcuccuccagguguccgagagcacgggggucgcccugaagcgcagcuccuggcucaucgugcugcuggugcuccugaccgucagccugucccccgugcagagcgcccccaucggccggaagccccucuuccugaacuccaucgugaaggggaugaagaaccugcucaacagcaccaaccuggagaccucccugagcaucgaggcgcccuggggcgccaucaacguccaguccacguucaagcccaccgugagcaccgccaacaucgcccucuccuggagcuccguggagcaccgcggcaacaagauccuggucagcgggcgguccgagagcaucaugaagcuggaggagcgcaccggcaucuccugggaccucgggguggaggacgccagcgaguccaagagccugacggucagcgugauggaccugucccagauguacagccccguguucgaguaccucuccggcgaccggcaggucgaggaguggccgaaggcgaccugcaccggggacugccccgagcgcugcggcugcaccagcuccacgugccugcacaaggaguggccccacagccggaacuggcgcugcaaccccaccuggugcuggggcguggggaccggcugcacgugcugcgggcuggacgugaaggaccucuucaccgacuacauguucgucaaguggaagguggaguacaucaagaccgaggccaucgugugcgucgagcugaccucccaggagcgccagugcagccugaucgaggccggcacccgguucaaccuggggccggugaccaucacgcucuccgagccccgcaacauccagcagaagcugccgcccgagaucaucacccugcacccgcggaucgaggagggcuucuucgaccucaugcacgugcagaagguccugagcgccuccaccgugugcaagcugcagagcugcacccacggcgugcccggggaccuccaggucuaccacaucggcaaccugcugaagggggacaagcucaacggccacaugauccacaagaucgagccccacuucaacacguccuggaugagcugggacggcugcgaccuggacuacuacugcaacaugggggacuggcccuccugcaccuacaccggcgugacccagcacaaccacgccgcguucgugaaccugcucaacaucgagacggacuacaccaagaacuuccacuuccacagcaagcgcgucaccgcccacggggacaccccgcagcuggaccugaaggcccggcccacguacggcgccggggagaucaccgugcucguggaggucgccgacauggagcugcacaccaagaagaucgacaucuccggccugaaguucgcgagccugaccugcgccggcugcuacgccugcagcuccgggaucagcugcaaggugcgcauccacguggacgagcccgacgagcugacgguccacgugaaguccgaggacccggacaucguggccgccagcaccucccugaucgcgcggaagcucgagcugggcaccgacagcaccuucaaggccuucuccgccaugcccaagacgagccugugcuucuacaucgucgagcgcgaguacugcaaguccugcagcaaggaggacacccagaagugcgugaacaccaagcucgagcacccccaggggauccugaucgagcacaagggcaccaucaucgggaagcagaacgacacgugcaccgccaaggcgggcugcuggcuggaguccgucaagagcuucuucuacggccucaagaacaugcuguccgggaucuucggcaacguguucaucgggaucuuccuguuccucgcccccuucgugcugcugauccucuucuucauguucggcuggcggcugcuguucugcuucaagugcugccgccggacccgcggccucuucaaguaccggcaccugaaggaggacgaggagagcggguaccgccggaucaucgagcgccugaacaacaagaagggcaagaacaagcuccuggacggggagcggcuggccgaccgccggaucgccgagcuguucuccaccaagacgcacaucggc

SEQ ID NO: 12245 - RNA, 2916 nt, Artificial Sequence
  derived and/or modified CDS sequence (opt1) from CCHFV(Zahedan 2007, Artificial)__KC867273.1__Gn-4aa-Gc
agcgaggaguccggcgacgacugcaucagccgcacccagcugcuccggaccgagacggccgaggugcacggggacaacuacggcgggcccggcgacaagaucaccaucugcaacggguccaccgucguggaccagcgccugggcagcgagcugggcugcuacaccaucaaccgggugcgcuccuucaagcucugcgagaacagcgccacggggaaguccugcgagaucgacagcaucccggucaagugcaagcagggcuucugccugaagaucacccaggaggggcggggccacgugaagcugucccgcgggagcgaggugguccucgacgugugcgacuccagcugcgaggugaugauccccaagggcaccggcgacauccuggucgacugcuccgggggccagcagcacuuccugaaggacaaccucguggaccuggggugccccaagaucccccugcucggcaagauggcgaucuacaucugccggaugagcaaccacccgaagaccacgauggccuuccuguucugguucuccuucggcuacgugaucacgugcauccugugcaaggccaucuucuuccuccugaucaucuucgggacccugggcaagcgcuucaagcaguaccgggagcucaagccccagaccugcaccaucugcgagaccacccccgucaacgccaucgacgccgagaugcacgaccugaacugcagcuacaacaucugccccuacugcgcgucccgccugaccagcgacgggcucgcccggcacgugacgcagugcccgcgccggaaggagaagguggaggagaccgagcuguaccugaaccucgagcgcauccccugggucgugcggaagcugcuccagguguccgagagcaccggcaccguccucaagcgcagcuccuggcugaucgugcugcucgugcuguucacggucagccugucccccgugcagagcgcccccaucgggcggcgcccccucuuccuggacuccaucgugaaggacaugaagaaccugcucaacagcaccucccuggagaccagccuguccaucgaggcccccuggggcgcgaucaacguccagagcaccuacaagcccacgguguccaccgccaacaucgcccucagcugguccagcgucgagcaccggggcaacaaggugcugguguccgggcgcagcgaguccaucaugaagcuggaggagcggaccggcaucagcugggaccucggggucgaggacgccuccgagagcaagcugcugaccgugagcgugauggaccucucccagauguacagccccgucuucgaguaccuguccggcgaccgccagguggaggaguggccgaaggccacgugcaccggggacugccccgagcgcugcggcugcaccagcuccacgugccugcacaaggaguggccccacagccggaacuggcgcugcaaccccaccuggugcuggggcguggggaccggcugcacgugcugcgggcucgacgucaaggaccuguucaccgacuacauguucgugaaguggaagguggaguacaucaagaccgaggcgaucgucugcguggagcugaccucccaggagcggcagugcagccugaucgaggccggcacccgcuucaaccucggguccgugaccaucacccugagcgagccgcggaacauccagcagaagcugccgcccgagaucaucacgcuccaccccaagaucgaggagggcuucuucgaccugaugcacguccagaaggugcuguccgccagcaccgugugcaagcuccaguccugcacccacggcgucccgggggaccuccagguguaccacaucggcaaccugcucaagggggaccgcgugaacggccaccugauccacaagaucgagcagcacuucaacaccagcuggauguccugggacggcugcgaccuggacuacuacugcaacaugggggacuggcccagcugcacguacaccggcgucacccagcacaaccacgccuccuucgugaaccuccugaacaucgagaccgacuacacgaagaccuuccacuuccacagcaagcgggugaccgcccacggggacacgccccagcuggaccucaaggcgcgccccaccuacggcgccggggagaucaccguccugguggagguggccgacauggagcugcacaccaagaagaucgagaucagcggccucaaguucgccggccugaccugcacggggugcuacgccugcuccagcggcaucuccugcaagguccggauccacguggacgagccggacgagcugaccgugcacgucaagagcgacgaccccgacgugguggcggccuccagcucccucauggcccgcaagcuggaguucgggaccgacagcaccuucaaggccuucuccgccaugcccaagacgagccugugcuucuacaucgucgagcgggaguacugcaaguccugcagcaaggaggacacccagaagugcgugaacaccaagcucgagcagccgcaguccauccugaucgagcacaagggcaccaucaucgggaagcagaacaacacgugcaccgcgaaggccagcugcuggcuggaguccgucaagagcuucuucuacggccucaagaacaugcugggcgggaucuucggcaacguguucaucgggaucuucaccuuccugacccccuucauccuccugaucuucuucuucauguucggcuggcgcauccuguucugcuucaagugcugccggcgcacgcgggggcuguucaaguaccgccaccugaaggacgacgaggagaccggcuaccggaagaucaucgagcgccugaacaacaagaagggcaagaaccggcuccuggacggggagcgccuggccgaccgcaagaucgccgagcuguucuccaccaagacccacaucggc

SEQ ID NO: 12246 - RNA, 2916 nt, Artificial Sequence
  derived and/or modified CDS sequence (opt1) from CCHFV(SPU 44/08, Artificial)__KJ682805.1__Gn-4aa-Gc
agcgaggaguccaacgacgacugccugagccgcacccagcuccugcggaccgagaacgccgagauccacuccgacaacuacggcgggcccggcgacaagaucacgaucugcaacgggagcaccaucguggaccagcgccugggcuccgagcucgggugcuacaccaucaaccgggucaagagcuucaagcugugcgagaacuccgccaccggcaagagcugcgagaucgacuccacgccggugcgcugccggcagggcuucugccugaagaucacccaggaggggcgcggccacgugaagcucagccggggguccgaggucgugcuggacgcgugcgacagcuccugcgagaucaugauccccaagggcaccggggacauccugguggacugcagcggcggccagcagcacuuccucaaggacaaccuggucgaccuggggugccccaacaucccccuccugggcaagauggccaucuacaucugccgcauguccaaccacccgaagaccacgauggccuuccuguucugguucagcuucggguacgugaucacgugcauccucugcaaggccaucuucuaccugcugaucguggucggcacccucggcaagaaguucaagcaguaccgggagcugaagccccagaccugcaccaucugcgagaccaaccccgugaacgccaucgacgcggagaugcacgaccugaacugcuccuacaacaucugccccuacugcgccagccgccucaccuccgacgggcuggcccggcacgugaugcagugcccgaagcgcaaggagaagaucgaggagaccgagcuguaccucaaccuggagcggauccccugggucgugcgcaagcugcuccaggugagcgagagcacgggcgucgcccugaagcgguccagcuggcuggugauccuccuggugcugcucaccgucucccugagccccgugcaguccgcgcccaucagccgcaagccgcuguuccucgacuccaucgugaaggggaugaagaaccugcugaacagcaccucccucgagaccagccuguccaucgaggcccccuggggcgccaucaacguccagagcacguucaagcccaccguguccgccgccaacaucgcgcugagcugguccagcguggagcaccgggggaacaagauccucgucuccggccgcagcgaguccaucaugaagcuggaggagcggaccggcaucagcugggaccuggggguggaggacgccagcgaguccaagcuccugaccgucagcgugauggaccugucccagauguacagccccguguucgaguaccucuccggcgaccgccaggucgaggaguggccgaaggccacgugcaccggggacugccccgagcggugcggcugcaccagcuccacgugccugcacaaggaguggccccacagccgcaacuggcgcugcaaccccaccuggugcuggggcguggggaccggcugcacgugcugcgggcuggacgugaaggaccuguucaccgacuacauguucgucaaguggaagguggacuacaucaagaccgaggccaucgugugcgucgagcucaccucccaggagcggcagugcagccugaucgaggccggcacccgcuucaaccuggggccggugaccaucacgcucuccgagccccggaacauccagcagaagcugccgcccgagaucgugacccugcacccccgcaucgaggagggcuucuucgaccucaugcacauccagaagguccugagcgcguccaccgugugcaagcugcagagcugcacccacggggugcccggcgaccuccagaucuaccacaucggcaaccugcugaagggggacaaggucaacggccaccucauccacaagaucgagccccacuucaacaccuccuggaugagcugggacgggugcgaccuggacuacuacugcaacaugggcgacuggcccuccugcagcuacacgggcgugacccagcacaaccacgccgccuucgugaacaugcugaacaucgagaccgacuacaccaagaacuuccacuuccacagcaagcgggucacggcccacggggacaccccgcagcucgaccugaaggcccgccccaccuacggcgcgggggagaucaccgugcugguggaggucgccgacauggagcuccacacgaagaagaucgagaucuccggccugaaguucgccagccugaccugcaccgggugcuacgccugcuccagcggcaucuccugcaaggugcggauccacguggacgagcccgacgagcucaccguccacgucaagagcgaggacccggacaucguggccgcguccagcucccugauggcccgcaagcuggaguucggcacggacagcaccuucaaggccuucuccgccaugcccaagaccagccucugcuucuacaucguggagcgggaguacugcaaguccugcagcaaggaggacacccagaagugcgugaacacgaagcuggagcagccccaguccauccugaucgagcacaaggggaccaucaucggcaagcagaacgacacgugcaccgcgaaggccagcugcuggcucgaguccaucaagagcuucuucuacgggcugaagaacaugcuguccggcaucuucgggaacguguucaucggcaucuuccucuuccuggcccccuucaucaugcugauccucuucuucauguucggcuggcgcauccuguucugcuucaagugcugccggcgcacccgggggcuguucaaguaccgccaccucaaggacgacgaggagaucggcuaccggaagaucaucgagcgccugaacaacaagaaggggaagaacaagcugcucgacggcgagcggcuggccgaccgcaagaucgccgagcuguucagcaccaagacccacaucggg

SEQ ID NO: 12247 - RNA, 2916 nt, Artificial Sequence
  derived and/or modified CDS sequence (opt1) from CCHFV(SPU 383/87, Artificial)__KJ682806.1__Gn-4aa-Gc
agcgaggaguccaacgacgacugccugagccgcacccagcuccugcggaccgagaacgccgagauccacuccgacaacuacggcgggcccggcgacaagaucacgaucugcaacgggagcaccaucguggaccagcgccugggcuccgagcucgggugcuacaccaucaaccgggucaagagcuucaagcugugcgagaacuccgccaccggcaagagcugcgagaucgacuccacgccggugcgcugccggcagggcuucugccugaagaucacccaggaggggcgcggccacgugaagcucagccggggguccgaggucgugcuggacgcgugcgacagcuccugcgagaucaugauccccaagggcaccggggacauccugguggacugcagcggcggccagcagcacuuccucaaggacaaccuggucgaccuggggugccccaacaucccccuccugggcaagauggccaucuacaucugccgcauguccaaccacccgaagaccacgauggccuuccuguucugguucagcuucggguacgugaucacgugcauccucugcaaggugaucuucuaccugcuggucguggugggcacccucggcaagaaguucaagcaguaccgggagcugaagccccagaccugcaccaucugcgagaccaaccccgucaacgccaucgacgccgagaugcacgaccugaacugcuccuacaacaucugccccuacugcgcgagccgccucaccuccgacgggcuggcccggcacgugauccagugcccgaagcgcaaggagaagaucgaggagaccgagcuguaccucaaccuggagcggauccccugggugguccgcaagcugcuccaggugagcgagagcacgggcguggcccugaagcgguccagcuggcuggucauccuccuggugcugcucaccgugucccugagccccguccaguccgcccccaucagccgcaagccgcuguuccucgacuccaucgugaaggggaugaagaaccugcugaacagcaccucccucgagaccagccuguccaucgaggcgcccuggggcgccaucaacgugcagagcacguucaagcccaccgucuccgccgccaacaucgcccugagcugguccagcguggagcaccgggggaacaagauccucgucuccggccgcagcgaguccaucaugaagcuggaggagcggaccggcaucagcugggaccuggggguggaggacgcgagcgaguccaagcuccugaccgugagcgucauggaccugucccagauguacagccccguguucgaguaccucuccggcgaccgccagguggaggaguggccgaaggccacgugcaccggggacugccccgagcggugcggcugcaccagcuccacgugccugcacaaggaguggccccacagccgcaacuggcgcugcaaccccaccuggugcuggggcgucgggaccggcugcacgugcugcgggcuggacgugaaggaccuguucaccgacuacauguucgugaaguggaaggucgacuacaucaagaccgaggccaucgugugcguggagcucaccucccaggagcggcagugcagccugaucgaggccggcacccgcuucaaccuggggccggucaccaucacgcucuccgagccccggaacauccagcagaagcugccgcccgagaucgugacccugcacccccgcaucgaggagggcuucuucgaccucaugcacauccagaaggugcugagcgccuccaccgucugcaagcugcagagcugcacccacggggugcccggcgaccuccagaucuaccacaucggcaaccugcugaagggggacaaggugaacggccaccucauccacaagaucgagccccacuucaacaccuccuggaugagcugggacgggugcgaccuggacuacuacugcaacaugggcgacuggcccuccugcagcuacacgggcgucacccagcacaaccacgcggccuucgugaacaugcugaacaucgagaccgacuacaccaagaacuuccacuuccacagcaagcgggugacggcccacggggacaccccgcagcucgaccugaaggcccgccccaccuacggcgccggggagaucaccguccugguggagguggcggacauggagcuccacacgaagaagaucgagaucuccggccugaaguucgccagccugaccugcaccgggugcuacgccugcuccagcggcaucuccugcaagguccggauccacguggacgagcccgacgagcucaccgugcacgucaagagcgaggacccggacaucguggccgccuccagcucccugauggcgcgcaagcuggaguucggcacggacagcaccuucaaggccuucuccgccaugcccaagaccagccucugcuucuacaucguggagcgggaguacugcaaguccugcagcaaggaggacacccagaagugcgucaacacgaagcuggagcagccccaguccauccugaucgagcacaaggggaccaucuucggcaagcagaacgacacgugcaccgccaaggcgagcugcuggcucgaguccgucaagagcuucuucuacgggcugaagaacaugcuguccggcaucuucgggaacguguucaucggcguguuccucuuccuggcccccuucaucaugcugauccucuucuucauguucggcuggcgcauccuguucugcuucaagugcugccggcgcacccgggggcuguucaaguaccgccaccucaaggacgacgaggagaucggcuaccggaagaucaucgagcgccugaacaacaagaaggggaagaacaagcugcucgacggcgagcggcuggccgaccgcaagaucgccgagcuguucagcaccaagacccacaucggg

SEQ ID NO: 12248 - RNA, 2916 nt, Artificial Sequence
  derived and/or modified CDS sequence (opt1) from CCHFV(SPU 130/89, Artificial)__KJ682807.1__Gn-4aa-Gc
agcgaggagcccaacuacgacugccucucccgcacccagcuccugcggaccgagaacgccgagauccacagcgacaacuacggcgggccgggcgacaagaucacgaucugcaacggguccaccaucguggaccagcgccugggcagcgagcucgggugcuacaccaucaaccgggucaaguccuucaagcugugcgagaacagcgccaccggcaaguccugcgagaucgacagcacgcccgugcgcugccggcagggcuucugccugaagaucacccaggaggggcgcggccacgugaagcucucccgggggagcgaggucgugcuggacgcgugcgacuccagcugcgagaucaugauccccaagggcaccggggacauccugguggacugcuccggcggccagcagcacuuccucaaggacaaccuggucgaccuggggugccccaacaucccgcuccugggcaagauggccaucuacaucugccgcaugagcaaccaccccaagaccacgauggccuuccuguucugguucuccuucggguacgugaucacgugcauccucugcaaggugaucuucuaccugcugaucgucgugggcacccucggcaagaaguucaagcaguaccgggagcugaagccccagaccugcaccaucugcgagaccaaccccgugaacgccaucgacgccgagaugcacgaccugaacugcagcuacaacaucugcccguacugcgcgucccgccucaccagcgacgggcuggcccggcacgucaugcagugccccaagcgcaaggagaagaucgaggagaccgagcuguaccucaaccuggagcggauccccuggguggugcgcaagcugcuccaggucuccgagagcacgggcguggcccugaagcggagcuccuggcuggugguccuccuggugcugcucaccgugagccugucccccguccagagcgccccgaucucccgcaagccccugagccucgacuccaucgugaaggggaugaagaaccugcugaacagcaccucccucgagaccagccuguccaucgaggcgcccuggggcgccaucaacgugcagagcacguucaagcccaccgucuccgccgccaacaucgcccugagcugguccagcguggagcaccgggggaacaagauccucgucuccggccgcagcgaguccaucaugaagcuggaggagcggaccggcaucagcugggaccuggggguggaggacgcgagcgaguccaagcuccugaccgugagcgucauggaccugucccagauguacagcccgguguucgaguaccucuccggcgaccgccagguggaggaguggcccaaggccacgugcaccggggacugccccgagcggugcggcugcaccagcuccacgugccugcacaaggaguggccccacagccgcaacuggcgcugcaacccgaccuggugcuggggcgucgggaccggcugcacgugcugcgggcuggacgugaaggaccuguucaccgacuacauguucgugaaguggaaggucgacuacaucaagaccgaggccaucgugugcguggagcucaccucccaggagcggcagugcagccugaucgaggccggcacccgcuucaaccuggggcccgucaccaucacgcucuccgagccccggaacauccagcagaagcugcccccggagaucgugacccugcacccccgcaucgaggagggcuucuucgaccucaugcacauccagaaggugcugagcgccuccaccgucugcaagcugcagagcugcacccacggggugcccggcgaccuccagaucuaccacaucggcaaccugcugaagggggacaaggugaacggccaccucauccacaagaucgagccccacuucaacaccuccuggaugagcugggacgggugcgaccuggacuacuacugcaacaugggcgacuggccguccugcagcuacacgggcgucacccagcacaaccacgcggccuucgugaacaugcugaacaucgagaccgacuacaccaagaacuuccacuuccacagcaagcgggugacggcccacggggacacgccccagcucgaccugaaggcccgccccaccuacggcgccggggagaucaccguccugguggagguggcggacauggagcuccacaccaagaaggucgagaucuccggccugaaguucgccagccugaccugcaccgggugcuacgccugcuccagcggcaucuccugcaaggugcggauccacguggacgagccggacgagcucaccguccacgucaagagcgaggaccccgacaucguggccgccuccagcucccugauggcgcgcaagcuggaguucggcacggacagcaccuucaaggccuucuccgccaugcccaagaccagccucugcuucuacaucguggagcgggagcacugcaaguccugcagcaaggaggacacccagcgcugcgugaacacgaagcuggagcagccccaguccauccugaucgagcacaaggggaccaucaucggcaagcagaacgacacgugcaccgccaaggcgagcugcuggcucgaguccaucaagagcuucuucuacgggcugaagaacaugcuguccggcaucuucgggaacguguucaucggcgucuuccucuuccuggccccguucaucauccugauccucuucuucauguucggcuggcggauccuguucugcuucaagugcugccgccggacccgcgggcugcucaaguaccggcaccugaaggacgacgaggagaucggcuaccgcaagaucaucgagcggcugaacaacaagaaggggaagaacaagcuccuggacggcgagcgccuggccgaccggaagaucgccgagcuguucagcaccaagacccacaucggg

SEQ ID NO: 12249 - RNA, 2916 nt, Artificial Sequence
  derived and/or modified CDS sequence (opt1) from CCHFV(SPU 497/88, Artificial)__KJ682808.1__Gn-4aa-Gc
agcgaggaguccaacgacgacugccugagccgcacccagcuccugcggaccgagaacgccgagauccacuccgacaacuacggcgggcccggcgacaagaucacgaucugcaacgggagcaccaucguggaccagcgccugggcuccgagcucgggugcuacaccaucaaccgggucaagagcuucaagcugugcgagaacuccgccaccggcaagagcugcgagaucgacuccacgccggugcgcugccggcagggcuucugccugaagaucacccaggaggggaagggccacgugaagcucagccgcggguccgaggucgugcuggacgcgugcgacagcuccugcgagaucaugauccccaagggcaccggggacauccugguggacugcagcggcggccagcagcacuuccucaaggacaaccuggucgaccuggggugccccaacaucccccuccugggcaagauggccaucuacaucugccggauguccaaccacccgaagaccacgaugguguuccuguucugguucagcuucggguacgugaucacgugcauccucugcaaggucaucuucuaccugcugaucguggugggcacccucggcaagaaguucaagcaguaccgcgagcugaagccccagaccugcaccaucugcgagaccaaccccgucaacgccaucgacgccgagaugcacgaccugaacugcuccuacaacaucugccccuacugcgccagccggcucaccuccgacgggcuggcgcgccacgugaugcagugcccgaagcggaaggagaagaucgaggagaccgagcuguaccucaaccuggagcgcauccccugggugguccggaagcugcuccaggugagcgagagcacgggcguggcccugaagcgcuccagcuggcuggucauccuccuggugcugcucaccgugucccugagccccguccaguccgcccccaucagccggaagccgcuguuccucgacuccaucgugaaggggaugcgcaaccugcugaacagcaccucccucgagaccagccuguccaucgaggcccccuggggcgcgaucaacgugcagagcacguucaagcccaccgucuccgccgccaacaucgcccugagcugguccagcguggagcaccgggggaacaagauccucgucuccggccgcagcgaguccaucaugaagcuggaggagcggaccggcaucagcugggaccuggggguggaggacgccagcgaguccaagcuccugaccgugagcgucauggaccugucccagauguacagccccguguucgaguaccucuccggcgaccgccagguggaggaguggccgaaggcgacgugcaccggggacugccccgagcggugcggcugcaccagcuccacgugccugcacaaggaguggccccacagccgcaacuggcgcugcaaccccaccuggugcuggggcgucgggaccggcugcacgugcugcgggcuggacgugaaggaccuguucaccgacuacauguucgugaaguggaaggucgacuacaucaagaccgaggccaucgugugcguggagcucaccucccaggagcggcagugcagccugaucgaggccggcacccgcuucaaccuggggccggucaccaucacgcucuccgagccccggaacauccagcagaagcugccgcccgagaucgugacccugcacccccgcaucgaggagggcuucuucgaccucaugcacauccagaaggugcugagcgccuccaccgucugcaagcugcagagcugcacccacggggugcccggcgaccuccagaucuaccacaucggcaaccugcugaagggggacaaggugaacggccaccucauccacaagaucgagccccacuucaacaccuccuggaugagcugggacgggugcgaccuggacuacuacugcaacaugggcgacuggcccuccugcagcuacacgggcgucacccagcacaaccacgccgcguucgugaacaugcugaacaucgagaccgacuacaccaagaacuuccacuuccacagcaagcgggugacggcccacggggacaccccgcagcucgaccugaaggcccgccccaccuacggcgccggggagaucaccguccugguggagguggccgacauggagcuccacacgaagaagaucgagaucuccggccugaaguucgcgagccugaccugcaccgggugcuacgccugcuccagcggcaucuccugcaagguccggauccacguggacgagcccgacgagcucaccgugcacgucaagagcgaggacccggacaucguggccgccuccagcucccugauggcccgcaagcuggaguucggcacggacagcaccuucaaggcguucuccgccaugcccaagaccagccucugcuucuacaucguggagcgggaguacugcaaguccugcagcaaggaggacacccagaagugcgucaacacgaagcuggagcagccccaguccauccugaucgagcacaaggggaccaucaucggcaagcagaacgacacgugcaccgcccgcgccagcugcuggcucgaguccaucaagagcuucuucuacgggcugaagaacaugcuguccggcaucuucgggaacguguucaucggcaucuuccucuucuucgcgcccuucaucaugcugauccuguucuucauguucggcuggcggauccucuucugcuucaagugcugccgccggacccgcgggcuguucaaguaccggcaccugaaggacgacgaggaggugggcuaccgcaagaucaucgagcggcucaacaacaagaaggggaagaacaagcugcuggacggcgagcgccucgccgaccggaagaucgccgagcuguucagcaccaagacccacaucggg

SEQ ID NO: 12250 - RNA, 2916 nt, Artificial Sequence
  derived and/or modified CDS sequence (opt1) from CCHFV(SPU 18/88, Artificial)__KJ682810.1__Gn-4aa-Gc
agcgaggaguccaacgacgacugccugagccgcacccagcuccugcggaccgagaacgccgagauccacuccgacaacuacggcgggcccggcgacaagaucacgaucugcaacgggagcaccaucguggaccagcgccugggcuccgagcucgggugcuacaccaucaaccgggucaagagcuucaagcugugcgagaacuccgccaccggcaagagcugcgagaucgacuccacgccggugcgcugccggcagggcuucugccugaagaucacccaggaggggcgcggccacgugaagcucagccggggguccgaggucgugcuggacgcgugcgacagcuccugcgagaucaugauccccaagggcaccggggacauccugguggacugcagcggcggccagcagcacuuccucaaggacaaccuggucgaccuggggugccccaacaucccccuccugggcaagauggccaucuacaucugccgcauguccaaccacccgaagaccacgaugggguuccuguucugguucagcuucggcuacgugaucacgugcauccucugcaaggugaucuucuaccugcugaucgucgugggcacccucgggaagaaguucaagcaguaccgggagcugaagccccagaccugcaccaucugcgagaccaaccccgugaacgccaucgacgccgagaugcacgaccugaacugcuccuacaacaucugccccuacugcgccagccgccucaccuccgacggccuggcgcggcacgucaugcagugcccgaagcgcaaggagaagaucgaggagaccgagcuguaccucaaccuggagcggauccccuggguggugcgcaagcugcuccaggucagcgagagcacggggguggcccugaagcgguccagcuggcuggugauccuccugguccugcucaccgugucccugagccccgugcaguccgcccccaucagccgcaagccgcuguuccucgacuccaucgucaagggcaagaagaaccugcugaacagcaccucccucgagaccagccuguccaucgaggcccccuggggcgcgaucaacgugcagagcacguucaagcccaccguguccgccgccaacaucgcccugagcugguccagcgucgagcaccgggggaacaagauccucguguccggccgcagcgaguccaucaugaagcuggaggagcggaccgggaucagcugggaccugggcgucgaggacgccagcgaguccaagcuccugaccgugagcgugauggaccugucccagauguacagccccgucuucgaguaccucuccggggaccgccagguggaggaguggccgaaggcgacgugcaccggcgacugccccgagcggugcgggugcaccagcuccacgugccugcacaaggaguggccccacagccgcaacuggcgcugcaaccccaccuggugcuggggcgugggcaccgggugcacgugcugcggccuggacgucaaggaccuguucaccgacuacauguucgugaaguggaagguggacuacaucaagaccgaggccaucgucugcguggagcucaccucccaggagcggcagugcagccugaucgaggccgggacccgcuucaaccugggcccggugaccaucacgcucuccgagccccggaacauccagcagaagcugccgcccgagaucgucacccugcacccccgcaucgaggagggguucuucgaccucaugcacauccagaaggugcugagcgccuccaccgugugcaagcugcagagcugcacccacggcguccccggcgaccuccagaucuaccacaucgggaaccugcugaagggcgacaaggugaacgggcaccucauccacaagaucgagccccacuucaacaccuccuggaugagcugggacggcugcgaccuggacuacuacugcaacaugggcgacuggcccuccugcagcuacacgggggugacccagcacaaccacgccgcguucgucaacaugcugaacaucgagaccgacuacaccaagaacuuccacuuccacagcaagcgggugacggcccacggcgacaccccgcagcucgaccugaaggcccgccccaccuacggggccggcgagaucaccgugcuggucgagguggccgacauggagcuccacacgaagaagaucgagaucuccgggcugaaguucgcgagccugaccugcaccggcugcuacgccugcuccagcggcaucuccugcaaggugcggauccacgucgacgagcccgacgagcucaccgugcacgucaagagcgaggacccggacaucguggccgccuccagcucccugauggcccgcaagcuggaguucgggacggacagcaccuucaaggcguucuccgccaugcccaagaccagccucugcuucuacaucguggagcgggaguacugcaaguccugcagcaaggaggacacccagaagugcgugaacacgaagcuggagcagccccaguccauccugaucgagcacaagggcaccaucaucgggaagcagaacgacacgugcaccggcaaggccgggugcuggcucgagagcaucaaguccuucuucuacggccugaagaacaugcugagcggcaucuucgggaacgucuucaucggcaucuuccucuuccuggcccccuucaucaugcugauccucuucuucauguucggguggcgcauccuguucugcuucaagugcugccggcgcacccggggccuguucaaguaccgccaccucaaggacgacgaggagaucggguaccggaagaucaucgagcgccugaagaacaagaagggcaagaacaagcugcucgacggcgagcggcuggcggaccgcaagaucgccgagcuguucuccaccaagacccacaucggg

SEQ ID NO: 12251 - RNA, 2916 nt, Artificial Sequence
  derived and/or modified CDS sequence (opt1) from CCHFV(SPU 431/85, Artificial)__KJ682812.1__Gn-4aa-Gc
agcgaggaguccgacggcgacugcaucagccgcacccagcugcuccggaccgagacgaccgagauccacuccgacaacuacgggggccccggggacaagaucaccaucugcaacggcagcaccaucguggaccagcgccugggguccgagcugggcugcuacacgaucaaccgggucaagagcuucaagcucugcgagaacuccgccaccggcaagagcugcgagaucgacuccaccccggugaagugccgccagggguucugccugaagaucacccaggagggccgggggcacgugaagcugagccgcggcuccgagaucguccucgacgccugcgacagcaacugcgagaucaugauccccaaggggacgggcgacauccugguggacugcuccggcgggcagcagcacuuccugaaggacaaccucaucgaccugggcugccccaacaucccccugcucgggaagauggcgaucuacaucugccggaugagcaaccacccgaagaccaccauggccuuccuguucugguucuccuucggcuacgugaucaccugcauccugugcaaggucaucuucuaccuccugaucguggccggcacgguggggaagaaguucaagcaguaccgcgagcugcggccccagaccugcaccaucugcgagaccauccccgucaacgccaucgacgccgagaugcacgaccucaacugcagcuacaacaucugccccuacugcgcgucccgccugacgagcgacggccuggcccggcacgugaugcagugcccgaagcgcaaggagaagguggaggagaccgagcucuaccugaaccuggagcggauccccugggucgugcgcaagcuccugcagguguccgagagcaccggggucgcccugaagcggagcuccuggcucaccgugcugcuggugcuccugaucgucagccugucccccgugcagagcgcccccaucggccgcaagccgcucuuccuggacuccaucgugaaggggcggaagaaccugcucaacagcacgucccuggagaccagccuguccaucgaggcgcccuggggcgccaucaacguccagagcaccuucaagcccaccguguccgccgccaacaucgcccucagcugguccagcguggagcaccgcggcaacaagauccuggucuccgggcggagcgaguccaucaugaagcuggaggagcgcacgggcaucagcugggaccucgggguggaggacgcguccgagagcaagcugcugaccgucagcgugauggaccucucccagauguacagccccguguucgaguaccuguccggcgaccggcaggucgaggaguggccgaaggccaccugcaccggggacugccccgagcgcugcggcugcacgagcuccaccugccugcacaaggaguggccccacagccgcaacuggcggugcaaccccaccuggugcuggggcguggggaccggcugcacgugcugcgggcucgacgugaaggaccuguucaccgacuacauguucgucaaguggaagguggaguacaucaagaccgaggccaucgugugcgucgagcugaccucccaggagcgccagugcagccugaucgaggccggcacgcgguucaaccucgggccggugaccaucacccuguccgagccccgcaacauccagcagaagcugccccccgagaucaucacccuccacccgcggaucgaggagggcuucuucgaccugaugcacgugcagcgcguccugagcgccuccaccgugugcaagcuccagagcugcacgcacggcgugcccggggaccugcaggucuaccacaucggcaaccugcucaagggggacaaggugaacggccaccugauccacaagaucgagccccacuucaacaccuccuggaugagcugggacggcugcgaccuggacuacuacugcaacaugggggacuggcccuccugcaccuacaccggcgugacgcagcacaaccacgcggccuucgucaaccuccugaacaucgagaccgacuacaccaagaacuuccacuuccacagcaagcgggugaccgcccacggggacacgccgcagcuggaccucaaggcccgccccaccuacggcgccggggaggugaccguccugguggagguggcggacauggagcugcacaccaagaagaucgagaucuccggccucaaguucgccagccugacgugcaccggcugcuacgccugcagcuccgggaucagcugcaaggucaagauccacguggacgagcccgacgagcugaccgugcacgucaaguccgaggacccggacaucguggccgccggcagcucccucauggcgcggaagcuggaguucggggccgacagcaccuucaaggccuucuccgccaugcccaagacgagccugugcuucuacaucguggagcgcgaguacugcaaguccugcagccgggaggacacccgcaagugcgucaacaccaagcucgaccggccccaguccauccugaucgagcacaagggcaccaucaucgggaagcagaacaacacgugcaccgcgaaggccagcugcuggcuggaguccgugaagagcuucuucuacggccucaagaacaugcuguccggcaucuucgggaacguguucaucggcaucuuccuguucaucgcccccuucguccuccugauccuguucuucauguucggguggcgcauccucuucugcuucaagugcugccggcgcacccggggccuguucaaguaccgccaccugaaggacgacgaggagaccggguaccggaagaucaucgagcgccucaacaacaagaagggcaagaacaagcugcuggacggcgagcgccucgccgaccggaagaucgccgagcuguucagcacgaagucccacaucggg

SEQ ID NO: 12252 - RNA, 2916 nt, Artificial Sequence
  derived and/or modified CDS sequence (opt1) from CCHFV(SPU 48/90, Artificial)__KJ682813.1__Gn-4aa-Gc
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggucaaguccuucaagcucugcgagaacagcgccacgggcaaguccugcgugaucgacagcgugcccgucaagugccgccagggguacugccugcggaucacccaggagggccgcgggcacgugaagcugucccggggcagcgaggugguccucgacgcgugcgacaccuccugcgagaucaugauccccaaggggaccggcgacauccugguggacugcagcggcgggcagcagcacuuccugaaggacaaccucaucgaccugggcugccccaagaucccgcugcucgggaagauggccaucuacaucugccgcauguccaaccaccccacgaccaccauggccuuccuguucugguucagcuucggcuacgugaucacgugcauccugugcaaggccaucuucuaccuccugaucaucaucggcacccuggggaagcgguuccgccaguaccgggagcucaagccccagaccugcaccaucugcgagaccacgcccgucaacgccaucgacgcggagaugcacgaccugaacugcuccuacaacaucugcccguacugcgccagccgccugaccuccgacggccucgcccggcacgugacccagugccccaagcgcaaggagaagguggaggagaccgagcuguaccugaaccucgagcggauccccugggucgugcgcaagcugcuccaggugagcgaguccacgggggucgcccucaagcggagcagcuggcugaucgugcugcucgugcuguucaccgucucccugagccccgugcaguccgcgccgaucggccgcaagccccucuuccgggacagcaucgugaaggggaugaagaaccugcugaacuccaccagccucgagaccucccugagcaucgaggcccccuggggcgccaucaacguccaguccacguacaagcccaccgugagcaccgccaacaucgcccuguccuggagcuccguggagcaccgcggcaacaagauccucgucagcgggcgguccgagagcaucaugaagcuggaggagcgcaccggcaucuccugggaccuggggguggaggacgcgagcgaguccaagcuccugacggucagcgugauggaccugagccagauguacuccccgguguucgaguaccucagcggcgaccgccaggucgaggaguggcccaaggcgaccugcaccggggacugccccgagcggugcggcugcaccuccagcacgugccugcacaaggaguggccccacucccgcaacuggcggugcaacccgaccuggugcuggggcguggggaccggcugcacgugcugcgggcuggacgugaaggaccucuucaccgacuacauguucgucaaguggaagguggaguacaucaagaccgaggccaucgugugcgucgagcugaccagccaggagcgccagugcucccugaucgaggccggcacccgguucaaccuggggcccgugaccaucacgcucagcgagccccgcaacauccagcagaagcugcccccggagaucaucacccugcacccccggaucgaggagggcuucuucgaccucaugcacgugcagaagguccuguccgccagcaccgugugcaagcugcaguccugcacccacggcgugcccggggaccuccaggucuaccacaucggcaaccugcugaagggggacaaggugaacggccaccucauccacaagaucgagccccacuucaacacgagcuggauguccugggacggcugcgaccuggacuacuacugcaacaugggggacuggccgagcugcaccuacaccggcgugacccagcacaaccgcgccuccuucgucaaccugcucaacaucgagacggacuacaccaagaacuuccacuuccacagcaagcgggugaccgcccacggggacacgccccagcuggaccugaaggcccgccccaccuacggcgccggggagaucaccgugcucgucgagguggccgacauggagcugcacaccaagaagaucgagaucuccggccugaaguucgcgagccugaccugcacgggcugcuacgccugcagcuccgggaucagcugcaaggugcggauccacgucgacgagccggacgagcugaccgugcacgugaaguccgacgaccccgacgucguggccgccagcuccagccugauggcccgcaagcucgaguucggcaccgacuccaccuucaaggcguucagcgccaugcccaagacgucccugugcuucuacaucguggagaaggaguacugcaagagcugcuccgaggaggacaccaagaagugcgucaacaccaagcuggagcagccccagagcauccucaucgagcacaaggggaccaucaucggcaagcagaacuccacgugcaccgccaaggugagcugcuggcuggaguccgccaagagcuucuucuacgggcugaaggacaugcucuccggcaucuucggcaacguguucaucgggaucuuccuguuccuggcgccguucauccuccugauccuguucuucauguucggcuggcggauccuccugugcuucaagugcugccgccggacccgcgggcuguucaaguaccggcaccucaaggacgacgaggagaccggcuaccgccggaucaucgagcgccugaacaacaagaaggggaagaacaagcugcucgacggcgagcgccuggccgaccggcgcaucgccgagcuguucagcacgaagacccacaucggc

SEQ ID NO: 12253 - RNA, 2916 nt, Artificial Sequence
  derived and/or modified CDS sequence (opt1) from CCHFV(SPU 187/90, Artificial)__KJ682814.1__Gn-4aa-Gc
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggucaaguccuucaagcucugcgagaacagcgccacgggcaaguccugcgagaucgacagcgugcccgugaagugccgccagggguacugccugcggaucacccaggagggccgcgggcacgucaagcugucccggggcagcgagguggugcucgacgcgugcgacaccuccugcgagaucaugauccccaaggggaccggcgacauccuggucgacugcagcggcgggcagcagcacuuccugaaggacaaccucaucgaccugggcugccccaagaucccgcugcucgggaagauggccaucuacaucugccgcauguccaaccaccccaagacgaccauggccuuccuguucugguucagcuucggcuacgugaucacgugcauccugugcaaggccaucuucuaccuccugaucaucaucggcacccuggggaagcgguucaagcaguaccgcgagcucaagccccagaccugcaccaucugcgagaccacccccgugaacgccaucgacgcggagaugcacgaccugaacugcuccuacaacaucugcccguacugcgccagccggcugacguccgacggccucgcccgccacgucacccagugccccaagcggaaggagaagguggaggagaccgagcuguaccugaaccucgagcgcauccccugggugguccggaagcugcuccaggugagcgaguccaccgggguggcccugaagcgcagcagcuggcugaucguccugcucgugcuguucacggugucccugagccccguccaguccgcgccgaucggccggcgcccccucuuccuggacagcaucgugaaggggaugaagaaccugcucaacuccaccagccuggagaccucccugagcaucgaggcccccuggggcgccaucaacgugcaguccaccuacaagcccacggucagcaccgccaacaucgcccucuccuggagcuccguggagcaccggggcaacaagauccuggugagcgggcgcuccgagagcaucaugaagcuggaggagcggaccggcaucuccugggaccucggggucgaggacgcgagcgaguccaagcugcugaccgugagcgucauggaccucagccagauguacuccccgguguucgaguaccugagcggcgaccgccagguggaggaguggcccaaggccacgugcaccggggacugccccgagcgcugcggcugcaccuccagcacgugccugcacaaggaguggccccacucccggaacuggcgcugcaacccgaccuggugcuggggcgucgggaccggcugcacgugcugcgggcucgacgugaaggaccuguucaccgacuacauguucgugaaguggaaggucgaguacaucaagaccgaggccaucgugugcguggagcugaccagccaggagcggcagugcucccugaucgaggccggcacccgcuucaaccucgggcccgucaccaucacccugagcgagccccggaacauccagcagaagcugcccccggagaucaucacgcuccacccccgcaucgaggagggcuucuucgaccugaugcacgugcagaaggugcuguccgccagcaccgucugcaagcuccaguccugcacccacggcgugcccggggaccuccagguguaccacaucggcaaccugcugaagggggacaaggucaacggccaccugauccacaagaucgagccccacuucaacaccagcuggauguccugggacggcugcgaccuggacuacuacugcaacaugggggacuggccgagcugcacguacaccggcgugacccagcacaaccacgcguccuucgugaaccuccugaacaucgagaccgacuacacgaagaacuuccacuuccacagcaagcgggucaccgcccacggggacacgccccagcuggaccucaaggcccgccccaccuacggcgccggggagaucaccgugcugguggaggucgccgacauggagcugcacaccaagaagaucgagaucuccggccucaaguucgcgagccugaccugcaccggcugcuacgccugcagcuccgggaucagcugcaaggugcggauccacguggacgagccggacgagcugacgguccacgugaaguccgacgaccccgacguggucgccgccagcuccagccucauggcccgcaagcuggaguucggcaccgacuccaucuucaaggcguucagcgccaugcccaagaccucccugugcuucuacaucguggagcgggagcacugcaagagcugcuccgaggaggacaccaagaagugcgugaacacgaagcucgagcagccccagagcauccugaucgagcacaaggggaccaucaucggcaagcagaacuccacgugcaccgccaagaccagcugcuggcuggaguccgucaagagcuucuucuacgggcucaagaacaugcuguccggcaucuucggcaacguguucaucgggaucuuccuguuccucgccccguucauccugcugauccucuucuucauguucggcuggcgcauccuguucugcuucaagugcugccggcgcacccgggggcuguucaaguaccgccaccucaaggacgacgaggagaccggcuaccggcgcaucaucgagcggcugaacaacaagaaggggaagaacaagcugcucgacggcgagcgccuggcggaccgccggaucgccgagcuguucagcaccaagacgcacaucggc

SEQ ID NO: 12254 - RNA, 2916 nt, Artificial Sequence
  derived and/or modified CDS sequence (opt1) from CCHFV(Haskovo-V46/13, Artificial)__KR092379.1__Gn-4aa-Gc
agcgaggagcugggcgacgacugcaucucccgcacccagcuccugcggaccgagacggccgagauccacgacgacaacuacgggggccccggggacaagaucaccaucugcaacggcagcaccaucguggaccagcgccugggguccgagcucggcugcuacaccaucaaccggggcaagagcuucaagcugugcgagaacuccgccacggggaagaccugcgagaucgacagcaccccggucaagugccgccagggcuucugccugaagaucacccaggaggggcggggccacgugaagcucucccgcgggagcgaggugguccuggacgcgugcgacuccagcugcgaggugaugauccccaagggcacgggcgacauccugguggacugcuccgggggccagcagcacuuccucaaggacaaccugaucgaccuggggugcccccacaucccccuccugggcaagauggccaucuacaucugccggaugagcaaccacccgcgcaccaccauggccuuccuguucugguucuccuucggcuacgucaucacgugcaucuucugcaaggcccucuucuacagccugaucaucaucgggacccugggcaagaagaucaagcaguaccgggagcucaagccccagaccugcaccaucugcgagaccacgcccgugaacgccaucgacgcggagaugcacgaccugaacugcuccuacaacaucugccccuacugcgccagccgccugaccuccgacgggcucgcccggcacgugacccagugcccgaagcgcaaggagaaggucgaggagaccgagcuguaccugaaccucgagcggauccccuggaucgugcgcaagcugcuccaggugagcgaguccacgggcgucgcccugaagcggagcagcuggcugaucgugcugcucgugcugcugcccgucucccucagccccgugcaguccgcgccgguggggcgcaagccccuguuccuggacagcaucgucaagggcaugaagaaccuccugaacuccaccagccuggagaccucccucagcaucgaggcccccuggggcgccaucaacgugcaguccaccuucaagcccacggugagcaccgccaacaucgcccuguccuggagcuccgucgagcaccgggggaacaagauccuggugaccggccgcagcgaguccaucaugaagcucgaggagcggaccggggugagcugggaccugggcgucgaggacgcguccgagagcaagcugcucacgguguccaucauggaccugagccagauguacagcccggucuucgaguaccuguccggggaccgccagguggaggaguggcccaaggcgaccugcaccggcgacugccccgagcggugcggcugcaccagcuccacgugccuccacaaggaguggccccacagccgcaacuggcgcugcaacccgaccuggugcuggggcguggggaccgggugcacgugcugcggcgucgacgugaaggaccuguucaccgaccacauguucgugaaguggaaggucgaguacaucaagaccgaggccaucgugugcguggagcugaccucccaggagcggcagugcagccugaucgaggccgggacccgcuucaaccucggccccgucaccaucacgcuguccgagccccggaacauccagcagaagcugcccccggagaucaucacccuccaccccaagaucgaggagggcuucuucgaccugaugcacgugcagaaggugcugagcgccuccaccgucugcaagcuccagagcugcacccacgggauccccggcgaccuccagguguaccacaucgggaaccugcugaagggcgaccgcgugaacggccaccugauccacaagaucgagccccacuucaacacguccuggaugagcugggacgggugcgaccuggacuacuacugcaacaugggcgacuggccguccugcaccuacaccggggucacccagcacaaccacgccgccuucgugaaccuccugaacaucgagacggacuacaccaagaccuuccacuuccacagcaagcgggugaccgcccacggcgacacgccccagcuggaccucaaggcccgccccaccuacggggccggcgagaucaccguccugguggagguggcggacauggagcugcacaccaagaaggucgagaucuccggccucaaguucgccagccugacgugcaccgggugcuacgccugcuccagcggcaucagcugcaaggugcggauccacguggacgagccggacgagcugaccguccacgugaaguccagcgaccccgacguggucgccgccgggaccucccucauggcgcgcaagcuggaguucggcacggacagcaccuucaaggccuucuccgccaugcccaagaccagccugugcuucuacaucguggagcgggaguacugcaaguccugcagcgaggacgacacccagaagugcguggacacgaagcucgagcagccccaguccauccugaucgagcacaaggggaccaucaucggcaagcagaacgacacgugcaccgcccgcgcgagcugcuggcuggaguccgucaagagcuucuucuacggccucaagaacaugcugggguccguguucggcaacuuccugaucgggauccuccuguuccuggccccguucgugcuccugguccuguucuucauguucggcuggaagauccucuucugcuucaagugcugccggcgcacccgggggcuguucaaguaccgccaccugaaggacgacgaggagaccggcuaccggcgcaucaucgagcggcucaacagcaagaagggcaagaaccgccugcuggacggggagcggcucgccgaccgcaagaucgccgagcuguucuccaccaagacccacaucggc

SEQ ID NO: 12255 - RNA, 2916 nt, Artificial Sequence
  derived and/or modified CDS sequence (opt1) from CCHFV(24-R-2012, Artificial)__KR814856.1__Gn-4aa-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacacguccugcgaggugaugauccccaaggggaccggcgacauccuggucgacugcagcggcgggcagcagcacuuccugaaggacaaccucaucgaccugggcugcccccacaucccgcugcucgggaagauggccaucuacaucugccggauguccaaccacccccgcaccaccauggccuuccuguucugguucagcuucggcuacgugaucacgugcaucuucugcaaggcccuguucuacucccucaucaucaucggcacccuggggaagaagaucaagcaguaccgggagcugaagccccagaccugcaccaucugcgagacggcccccgugaacgcgaucgacgccgagaugcacgaccucaacugcagcuacaacaucugcccguacugcgccucccgccugaccagcgacggccuggcccggcacgucccccagugccccaagcgcaaggagaagguggaggagaccgagcucuaccugaaccuggagcggauccccuggaucgugcgcaagcuccugcaggucuccgagagcaccgggguggcgcugaagcgguccagcuggcucaucgugcugcugguccuccugacggugagccuguccccggugcagagcgcccccgucggccgcaagccccucuuccuggacuccaucgugaaggggaugaagaaccugcucaacagcaccucccuggagaccagccuguccaucgaggcccccuggggcgccaucaacgugcagagcaccuucaagccgacggucuccaccgccaacaucgcgcucagcugguccagcguggagcaccggggcaacaagauccuggugaccgggcgcuccgagagcaucaugaagcuggaggagcggaccggcgucuccugggaccucgggguggaggacgccagcgaguccaagcugcugacggucagcaucauggaccucucccagauguacagccccguguucgaguaccugagcggcgaccgccagguggaggaguggcccaaggcgaccugcaccggggacugccccgagcggugcggcugcaccuccagcacgugccugcacaaggaguggccgcacucccgcaacuggcgcugcaaccccaccuggugcuggggcgucgggaccggcugcacgugcugcgggguggacgugaaggaccucuucaccgaccacauguucgucaaguggaagguggaguacaucaagaccgaggccaucgugugcgucgagcugaccagccaggagcggcagugcucccugaucgaggccggcacccgcuucaaccuggggcccgugaccaucacgcucagcgagccccggaacauccagcagaagcugccgcccgagaucaucacccugcaccccaagguggaggagggcuucuucgaccucaugcacguccagaaggugcuguccgccagcaccgugugcaagcugcaguccugcacccacggcauccccggggaccuccaggucuaccacaucggcaaccugcugaagggggaccgcgugaacggccaccucauccacaagaucgagccgcacuucaacacgagcuggauguccugggacggcugcgaccuggacuacuacugcaacaugggggacuggcccagcugcaccuacaccggcgugacccagcacaaccacgccgccuucgucaaccugcucaacaucgagacggacuacaccaagaccuuccacuuccacuccaagcgggugaccgcccacggggacacgccccagcuggaccugaaggcccgcccgaccuacggcgcgggggagaucaccgugcucgucgagguggccgacauggagcugcacaccaagaagguggagaucagcggccugaaguucgccucccucgccugcacgggcugcuacgccugcagcuccgggaucagcugcaagguccggauccacguggacgagcccgacgagcugaccgugcacgucaagagcaacgaccccgacgugguggcggccuccaccagccugauggcccgcaagcucgaguucggcaccgacuccacguucaaggccuucagcgcgaugcccaagaccucccugugcuucuacaucgucgagcgggaguacugcaagagcugcuccgaggaggacacccagaagugcguggacaccaagcuggagcagccgcagagcauccucaucgagcacaaggggacgaucaucggcaagcagaacgacacgugcaccgccaaggccuccugcuggcuggagagcgugaaguccuucuucuacgggcugaagaacaugcucggcagcgucuucggcaacuucuucaucgggauccugcuguuccucgcccccuucgugcugcuggugcuguucuucauguucggcuggaagauccucuucugcuucaagugcugccgccggacccgcgggcugcucaaguaccggcugcugaaggacgacgaggagaccggcuaccgccggaucaucgagcgccucaacaacaagaaggggaagaaccggcugcuggacggcgagcgccucgccgaccggaagaucgcggagcuguucuccaccaagacccacaucggc

SEQ ID NO: 12256 - RNA, 2916 nt, Artificial Sequence
  derived and/or modified CDS sequence (opt1) from CCHFV(36-ST-2014, Artificial)__KR814857.1__Gn-4aa-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccuccaggugagcgaguccaccggggucgcgcugaagcgcagcagcuggcucaucgugcugcuggugcuccugacggucucccugagccccgugcaguccgccccggugggccggaagccccucuuccuggacagcaucgucaaggggaugaagaaccugcucaacuccaccagccuggagaccucccugagcaucgaggcccccuggggcgccaucaacgugcaguccaccuucaagcccacggugagcaccgccaacaucgcgcucuccuggagcuccgucgagcaccgcggcaacaagauccuggugaccgggcggagcgaguccaucaugaagcuggaggagcgcaccggcgugagcugggaccucggggucgaggacgccuccgagagcaagcugcugacgguguccaucauggaccucagccagauguacagcccggucuucgaguaccuguccggcgaccgccagguggaggaguggcccaaggcgaccugcaccggggacugccccgagcggugcggcugcaccagcuccacgugccugcacaaggaguggccccacagccggaacuggcgcugcaacccgaccuggugcuggggcguggggaccggcugcacgugcugcggggucgacgugaaggaccucuucaccgaccacauguucaucaaguggaagguggaguacaucaagaccgaggccaucgucugcguggagcugaccucccaggagcgccagugcagccugaucgaggccggcacccgguucaaccuggggcccgugaccaucacgcucuccgagccccgcaacauccagcagaagcugcccccggagaucaucacccugcaccccaagaucgaggagggcuucuucgaccucaugcacguccagaaggugcugagcgccuccaccgugugcaagcugcagagcugcacccacggcauccccggggaccuccagaucuaccacaucggcaaccugcugaagggggaccggcucaacggccaccugauccacaagaucgagccccacuucaacacguccuggaugagcugggacggcugcgaccuggacuacuacugcaacaugggggacuggccguccugcaccuacaccggcgucacccagcacaaccacgccgccuucgugaaccuccugaacaucgagacggacuacaccaagaccuuccacuuccacagcaagcgcgugaccgcccacggggacacgccccagcuggaccucaaggcccggcccaccuacggcgcgggggagaucaccguccugguggagguggccgacauggagcugcacaccaagaaggucgagaucuccggccucaaguucgccagccuggccugcacgggcugcuacgccugcuccagcgggaucagcugcaaggugcgcauccacguggacgagccggacgagcugaccguccacgugaaguccagcgaccccgacguggucgcggccuccaccagccucauggcccggaagcuggaguucggcaccgacuccacguucaaggccuucagcgcgaugcccaagaccucccugugcuucuacaucguggagcgcgaguacugcaagagcugcuccgaggacgacaccaagaagugcguggacaccaagcucgaccagccccagagcauccugaucgagcacaaggggacgaucaucggcaagcagaacgacacgugcaccgccaaggccuccugcuggcuggagagcgucaaguccuucuucuacgggcucaagaacaugcugggcagcguguucggcaacuucuucguggggauccuccucuuccuggccccguucguccugcucgugcuguucuucaugugcggcuggaaguuccuguucugcuucaagugcugccggcgcacccgggggcuguucaaguaccgccaccugaaggacgacgaggagaccggcuaccggcgcaucaucgagcggcugaacuccaagaaggggaagaaccgccuccuggacggcgagcggcuggccgaccgcaagaucgcggagcuguucagcaccaagucccacaucggc

SEQ ID NO: 12257 - RNA, 2916 nt, Artificial Sequence
  derived and/or modified CDS sequence (opt1) from CCHFV(37-R-2013, Artificial)__KR814858.1__Gn-4aa-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacacguccugcgaggugaugauccccaaggggaccggcgacauccuggucgacugcagcggcgggcagcagcacuuccugaaggacaaccucaucgaccugggcugcccccacaucccgcugcucgggaagauggccaucuacaucugccggauguccaaccacccccgcaccaccauggccuuccuguucugguucagcuucggcuacgugaucacgugcaucuucugcaaggcccuguucuacucccucaucaucaucggcacccuggggaagaagaucaagcaguaccgggagcugaagccccagaccugcaccaucugcgagacggcccccgugaacgcgaucgacgccgagaugcacgaccucaacugcagcuacaacaucugcccguacugcgccucccgccugaccagcgacggccuggcccggcacgucccccagugccccaagcgcaaggagaagguggaggagaccgagcucuaccugaaccuggagcggauccccuggaucgugcgcaagcuccugcaggucuccgagagcaccgggguggcgcugaagcgguccagcuggcucaucgugcugcugguccuccugacggugagccuguccccggugcagagcgcccccgucggccgcaagccccucuuccuggacuccaucgugaaggggaugaagaaccugcucaacagcaccucccuggagaccagccuguccaucgaggcccccuggggcgccaucaacgugcagagcaccuucaagccgacggucuccaccgccaacaucgcgcucagcugguccagcguggagcaccggggcaacaagauccuggugaccgggcgcuccgagagcaucaugaagcuggaggagcggaccggcgucuccugggaccucgggguggacgacgccagcgaguccaagcugcugacggucagcaucauggaccucucccagauguacagccccguguucgaguaccugagcggcgaccgccagguggaggaguggcccaaggcgaccugcaccggggacugccccgagcggugcggcugcaccuccagcacgugccugcacaaggaguggccgcacucccgcaacuggcgcugcaaccccaccuggugcuggggcgucgggaccggcugcacgugcugcgggguggacgugaaggaccucuucaccgaccacauguucgucaaguggaagguggaguacaucaagaccgaggccaucgugugcgucgagcugaccagccaggagcggcagugcucccugaucgaggccggcacccgcuucaaccuggggcccgugaccaucacgcucagcgagccccggaacauccagcagaagcugccgcccgagaucaucacccugcaccccaagguggaggagggcuucuucgaccucaugcacguccagaaggugcuguccgccagcaccgugugcaagcugcaguccugcacccacggcauccccggggaccuccaggucuaccacaucggcaaccugcugaagggggaccgcgugaacggccaccucauccacaagaucgagccgcacuucaacacgagcuggauguccugggacggcugcgaccuggacuacuacugcaacaugggggacuggcccagcugcaccuacaccggcgugacccagcacaaccacgccgccuucgucaaccugcucaacaucgagacggacuacaccaagaccuuccacuuccacuccaagcgggugaccgcccacggggacacgccccagcuggaccugaaggcccgcccgaccuacggcgcgggggagaucaccgugcucgucgagguggccgacauggagcugcacaccaagaagguggagaucagcggccugaaguucgccucccucgccugcacgggcugcuacgccugcagcuccgggaucagcugcaagguccggauccacguggacgagcccgacgagcugaccgugcacgucaagagcaacgaccccgacgugguggcggccuccaccagccugauggcccgcaagcucgaguucggcaccgacuccacguucaaggccuucagcgcgaugcccaagaccucccugugcuucuacaucgucgagcgggaguacugcaagagcugcuccgaggaggacacccagaagugcguggacaccaagcuggagcagccgcagagcauccucaucgagcacaaggggacgaucaucggcaagcagaacgugaccugcaccgccaaggccuccugcuggcuggagagcgucaaguccuucuucuacgggcugaagaacaugcucggcagcguguucggcaacuucuucaucgggauccugcuguuccucgcccccuucgugcugcugguccucuucuucauguucggcuggaagauccuguucugcuucaagugcugccgccggacccgcgggcugcucaaguaccggcugcugaaggacgacgaggagacgggcuaccgccggaucaucgagcgccucaacaacaagaaggggaagaaccggcugcuggacggcgagcgccucgccgaccggaagaucgcggagcuguucuccaccaagacccacaucggc

SEQ ID NO: 12258 - RNA, 2916 nt, Artificial Sequence
  derived and/or modified CDS sequence (opt1) from CCHFV(44-ST-2010, Artificial)__KR814859.1__Gn-4aa-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccugcugugguucuccuucggcuacgucaucacgugcaucuucugcaaggcccucuucuacagccugaucaucaucggcacccuggggaagaagaucaagcaguaccgcgagcucaagccccagaccugcaccaucugcgagaccgcccccgugaacgcgaucgacgccgagaugcacgaccugaacugcuccuacaacaucugcccguacugcgccagccggcugacguccgacggccucgcccgccacgugacccagugccccaagcggaaggagaaggucgaggagaccgagcuguaccugaaccucgagcgcauccccuggaucgugcggaagcugcuccaggugagcgaguccaccggggucgcgcugaagcgcagcagcuggcugaucgugcugcucgugcugcugacggucucccucagccccgugcaguccgccccggugggccggaagccccuguuccuggacagcaucgucaaggggaugaagaaccuccugaacuccaccagccuggagaccucccucagcaucgaggcccccuggggcgccaucaacgugcaguccaccuucaagcccacggugagcaccgccaacaucgcgcuguccuggagcuccgucgagcaccgcggcaacaagauccuggugaccgggcggagcgaguccaucaugaagcucgaggagcgcaccggcgugagcugggaccugggggucgaggacgccuccgagagcaagcugcucacgguguccaucauggaccugagccagauguacagcccggucuucgaguaccuguccggcgaccgccagguggaggaguggcccaaggcgaccugcaccggggacugccccgagcggugcggcugcaccagcuccacgugccuccacaaggaguggccccacagccggaacuggcgcugcaacccgaccuggugcuggggcguggggaccggcugcacgugcugcggggucgacgugaaggaccuguucaccgaccacauguucaucaaguggaagguggaguacaucaagaccgaggccaucgucugcguggagcugaccucccaggagcgccagugcagccugaucgaggccggcacccgguucaaccucgggcccgugaccaucacgcuguccgagccccgcaacauccagcagaagcugcccccggagaucaucacccuccaccccaagaucgaggagggcuucuucgaccugaugcacguccagaaggugcugagcgccuccaccgugugcaagcuccagagcugcacccacggcauccccggggaccugcagaucuaccacaucggcaaccugcucaagggggaccggcugaacggccaccugauccacaagaucgagccccacuucaacacguccuggaugagcugggacggcugcgaccucgacuacuacugcaacaugggggacuggccguccugcaccuacaccggcgucacccagcacaaccacgccgccuucgugaaccugcugaacaucgagacggacuacaccaagaccuuccacuuccacagcaagcgcgugaccgcccacggggacacgccccagcucgaccugaaggcccggcccaccuacggcgcgggggagaucaccguccugguggagguggccgacauggagcuccacaccaagaaggucgagaucuccggccugaaguucgccagccuggccugcacgggcugcuacgccugcuccagcgggaucagcugcaaggugcgcauccacguggacgagccggacgagcucaccguccacgugaaguccagcgaccccgacguggucgcggccuccaccagccugauggcccggaagcuggaguucggcaccgacuccacguucaaggccuucagcgcgaugcccaagaccucccucugcuucuacaucguggagcgcgaguacugcaagagcugcuccgaggacgacaccaagaagugcguggacaccaagcuggaccagccccagagcauccugaucgagcacaaggggacgaucaucggcaagcagaacgacacgugcaccgccaaggccuccugcuggcucgagagcgucaaguccuucuucuacgggcugaagaacaugcugggcagcguguucggcaacuucuucguggggauccuccuguuccuggccccguucguccuccuggugcuguucuucaugugcggcuggaagauccucuucugcuucaagugcugccggcgcacccgggggcuguucaaguaccgccaccugaaggacgacgaggagaccggcuaccggcgcaucaucgagcggcucaacuccaagaaggggaagaaccgccugcuggacggcgagcggcucgccgaccgcaagaucgcggagcuguucagcaccaagucccacaucggc

SEQ ID NO: 12259 - RNA, 2916 nt, Artificial Sequence
  derived and/or modified CDS sequence (opt1) from CCHFV(46-ST-2012, Artificial)__KR814860.1__Gn-4aa-Gc
agcgaggagcccggcgacgacugcaucucccgcacccagcuccuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugaccgugucccugagcccggugcaguccgcccccgucggccgcaagccccucuuccuggacagcaucgugaaggggaugaagaaccugcucaacuccacgagccuggagaccucccugagcaucgaggcccccuggggcgccaucaacgugcaguccaccuucaagccgaccgucagcacggccaacaucgcgcucuccuggagcuccguggagcaccggggcaacaagauccuggugaccgggcgcagcgaguccaucaugaagcuggaggagcggaccggcgucagcugggaccucgggguggaggacgccuccgagagcaagcugcugaccgucuccaucauggaccucagccagauguacagccccguguucgaguaccuguccggcgaccgccagguggaggaguggcccaaggccacgugcaccggggacugccccgagcggugcggcugcaccagcuccacgugccugcacaaggaguggccgcacagccgcaacuggcgcugcaaccccaccuggugcuggggcgucgggaccggcugcacgugcugcgggguggacgugaaggaccucuucaccgaccacauguucgucaaguggaagguggaguacaucaagaccgaggccaucgugugcgucgagcugaccucccaggagcggcagugcagccugaucgaggccggcacccgcuucaaccuggggcccgugaccaucacccucuccgagccccggaacauccagcagaagcugccgcccgagaucaucacgcugcaccccaagguggaggagggcuucuucgaccucaugcacguccagaaggugcugagcgcguccaccgugugcaagcugcagagcugcacccacggcauccccggggaccuccaggucuaccacaucggcaaccugcugaagggggaccgcaucaacggccaccucauccacaagaucgagccgcacuucaacaccuccuggaugagcugggacggcugcgaccuggacuacuacugcaacaugggggacuggcccuccugcacguacaccggcgugacccagcacaaccacgccgccuucgugaaccugcucaacaucgagaccgacuacacgaagaccuuccacuuccacagcaagcgggucaccgcccacggggacacgccccagcuggaccugaaggcccgcccgaccuacggcgcgggggagaucaccgugcucguggaggucgccgacauggagcugcacaccaagaagguggagaucuccggccugaaguucgccagccucgccugcaccggcugcuacgccugcuccagcgggaucagcugcaaggugcggauccacgucgacgagcccgacgagcugacggugcacgugaaguccagcgaccccgacgucguggcggccuccaccagccugauggcccgcaagcucgaguucggcaccgacuccaccuucaaggccuucagcgcgaugcccaagacgucccugugcuucuacaucguggagcgggaguacugcaagagcugcuccgaggaggacacccagaagugcgucgacacccgccuggagcagccgcagagcauccucaucgagcacaaggggaccaucaucggcaagcagaacgacacgugcaccgccaaggccuccugcuggcuggagagcgugaaguccuucuucuacgggcugaagaacaugcucggcagcguguucggcaacuucuucaucgggauccugcuguuccucgcccccuucguccugcuggugcuguucuucauguucggcuggaagauccucuucugcuucaagugcugccggcgcacccgggggcugcucaaguaccgccaccugaaggacgacgaggagaccggcuaccggcgcaucaucgagcggcugaacaacaagaaggggaagaaccgccuccuggacggcgagcggcuggccgaccgcaagaucgcggagcuguucuccacgaagacccacaucggc

SEQ ID NO: 12260 - RNA, 2916 nt, Artificial Sequence
  derived and/or modified CDS sequence (opt1) from CCHFV(47-ST-2013, Artificial)__KR814861.1__Gn-4aa-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcaagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccuccaggugagcgaguccaccggggucgcgcugaagcgcagcagcuggcugaucgugcugcuggugcuccugacggucucccugagccccgugcaguccgccccggugggccggaagccccucuuccuggacagcaucgucaaggggaugaagaaccugcucaacuccaccagccuggagaccucccugagcaucgaggcccccuggggcgccaucaacgugcaguccaccuucaagcccacggugagcaccgccaacaucgcgcucuccuggagcuccgucgagcaccgcggcaacaagauccuggugaccgggcggagcgaguccaucaugaagcuggaggagcgcaccggcgugagcugggaccucggggucgaggacgccuccgagagcaagcugcugacgguguccaucauggaccucagccagauguacagcccggucuucgaguaccuguccggcgaccgccagguggaggaguggcccaaggcgaccugcaccggggagugccccgagcggugcggcugcaccagcuccacgugccugcacaaggaguggccccacagccggaacuggcgcugcaacccgaccuggugcuggggcguggggaccggcugcacgugcugcggggucgacgugaaggaccucuucaccgaccacauguucaucaaguggaagguggaguacaucaagaccgaggccaucgucugcguggagcugaccucccaggagcgccagugcagccugaucgaggccggcacccgguucaaccuggggcccgugaccaucacgcucuccgagccccgcaacauccagcagaagcugcccccggagaucaucacccugcaccccaagaucgaggagggcuucuucgaccucaugcacguccagaaggugcugagcgccuccaccgugugcaagcugcagagcugcacccacggcauccccggggaccuccagaucuaccacaucggcaaccugcugaagggggaccgggucaacggccaccucauccacaagaucgagccccacuucaacacguccuggaugagcugggacggcugcgaccuggacuacuacugcaacaugggggacuggccguccugcaccuacaccggcgugacccagcacaaccacgccgccuucgugaaccugcucaacaucgagacggacuacaccaagaccuuccacuuccacagcaagcgcgucaccgcccacggggacacgccccagcuggaccugaaggcccggcccaccuacggcgcgggggagaucaccgugcucguggaggucgccgacauggagcugcacaccaagaagguggagguguccggccugaaguucgccagccucgccugcacgggcugcuacgccugcuccagcgggaucagcugcaagguccgcauccacguggacgagccggacgagcugaccgugcacgucaaguccagcgaccccgacgugguggcggccuccaccagccugauggcccggaagcucgaguucggcaccgacuccacguucaaggccuucagcgcgaugcccaagaccucccugugcuucuacaucgucgagcgcgaguacugcaagagcugcuccgaggacgacaccaagaagugcguggacaccaagcuggagcagccccagagcauccucaucgagcacaaggggacgaucaucggcaagcagaacgacacgugcaccgccaaggccuccugcuggcuggagagcgugaaguccuucuucuacgggcugaagaacaugcucggcagcgucuucggcaacuucuucguggggauccugcuguuccucgccccguucgugcugcugguccucuucuucauguucggcuggaagauccuguucugcuucaagugcugccggcgcacccgggggcuguucaaguaccgccaccucaaggacgacgaggagaccggcuaccggcgcaucaucgagcggcugaacuccaagaaggggaagaaccgccugcucgacggcgagcggcuggccgaccgcaagaucgcggagcuguucagcaccaagacccacaucggc

SEQ ID NO: 12261 - RNA, 2916 nt, Artificial Sequence
  derived and/or modified CDS sequence (opt1) from CCHFV(52-R-2014, Artificial)__KR814862.1__Gn-4aa-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacacguccugcgaggugaugauccccaaggggaccggcgacauccuggucgacugcagcggcgggcagcagcacuuccugaaggacaaccucaucgaccugggcugcccccacgugccgcugcucgggaagauggccaucuacaucugccggauguccaaccacccccgcaccaccauggccuuccuguucugguucagcuucggcuacgugaucacgugcaucuucugcaaggcccuguucuacucccucaucaucaucggcacccuggggaagaagaucaagcaguaccgggagcugaagccccagaccugcaccaucugcgagacggcccccgucaacgcgaucgacgccgagaugcacgaccucaacugcagcuacaacaucugcccguacugcgccucccgccugaccagcgacggccuggcccggcacgugccccagugccccaagcgcaaggagaagguggaggagaccgagcucuaccugaaccuggagcggauccccuggaucguccgcaagcuccuccagguguccgagagcaccgggguggcgcugaagcgguccagcuggcugaucguccugcuggugcuccugacggugagccuguccccgguccagagcgcccccgugggccgcaagccccucuuccuggacuccaucgugaaggggaugaagaaccugcucaacagcaccucccuggagaccagccuguccaucgaggcccccuggggcgccaucaacguccagagcaccuucaagccgacgguguccaccgccaacaucgcgcucagcugguccagcguggagcaccggggcaacaagauccuggucaccgggcgcuccgagagcaucaugaagcuggaggagcggaccggcguguccugggaccucggggucgacgacgccagcgaguccaagcugcugacggugagcaucauggaccucucccagauguacagccccguguucgaguaccugagcggcgaccgccaggucgaggaguggcccaaggcgaccugcaccggggacugccccgagcggugcggcugcaccuccagcacgugccugcacaaggaguggccgcacucccgcaacuggcgcugcaaccccaccuggugcuggggcguggggaccggcugcacgugcugcgggguggacgucaaggaccucuucaccgaccacauguucgugaaguggaagguggaguacaucaagaccgaggccaucgucugcguggagcugaccagccaggagcggcagugcucccugaucgaggccggcacccgcuucaaccuggggcccgugaccaucacgcucagcgagccccggaacauccagcagaagcugccgcccgagaucaucacccugcaccccaaggucgaggagggcuucuucgaccucaugcacgugcagaaggugcuguccgccagcaccgucugcaagcugcaguccugcacccacggcauccccggggaccuccagguguaccacaucggcaaccugcugaagggggaccgcgugaacggccaccucauccacaagaucgagccgcacuucaacacgagcuggauguccugggacggcugcgaccuggacuacuacugcaacaugggggacuggcccagcugcaccuacaccggcgucacccagcacaaccacgccgccuucgugaaccugcucaacaucgagacggacuacaccaagaccuuccacuuccacuccaagcgggugaccgcccacggggacacgccccagcuggaccugaaggcccgcccgaccuacggcgcgggggagaucaccguccucguggagguggccgacauggagcugcacaccaagaaggucgagaucagcggccugaaguucgccucccucgccugcacgggcugcuacgccugcagcuccgggaucagcugcaaggugcggauccacguggacgagcccgacgagcugaccguccacgucaagagcaacgaccccgacgugguggcggccuccaccagccugauggcccgcaagcucgaguucggcaccgacuccacguucaaggccuucagcgcgaugcccaagaccucccugugcuucuacaucguggagcgggaguacugcaagagcugcuccgaggaggacacccagaagugcguggacaccaagcuggagcagccgcagagcauccucaucgagcacaaggggacgaucaucggcaagcagaacgacacgugcaccgccaaggccgggugcuggcuggaguccgucaagagcuucuucuacggccugaagaacaugcucggcuccguguucgggaacuucuucaucggcauccugcuguuccucgcccccuucgugcugcugguccucuucuucauguucggguggaagauccuguucugcuucaagugcugccgccggacccgcggccugcucaaguaccggcugcugaaggacgacgaggagaccggguaccgccggaucaucgagcgccucaacaacaagaagggcaagaaccggcugcuggacggcgagcgccucgccgaccggaagaucgcggagcuguucagcaccaagacccacaucggg

SEQ ID NO: 12262 - RNA, 2916 nt, Artificial Sequence
  derived and/or modified CDS sequence (opt1) from CCHFV(75-R-2012, Artificial)__KR814863.1__Gn-4aa-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcgcgcccgugaagugccgccagggguucugccugaagaucacccaggagggccgggggcacgugaagcugucccgcggcagcgaggucgugcucgacgccugcgacuccagcugcgaggugaugauccccaaggggaccggcgacauccuggucgacugcuccggcgggcagcagcacuuccugaaggacaaccucaucgaccugggcugcccccacaucccgcugcucgggaagauggccaucuacaucugccggaugagcaaccacccccgcacgaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcgcccgugaacgccaucgacgccgagaugcacgaccucaacugcuccuacaacaucugcccguacugcgccagccgccugaccuccgacggccuggcgcggcacgucccccagugccccaagcgcaaggagaagguggaggagacggagcucuaccugaaccuggagcggauccccuggaucgugcgcaagcuccugcaggucagcgaguccaccgggguggcccugaagcggagcagcuggcucaucgugcugcugguccuccugaccgugucccugagcccggugcaguccgcccccgucggccgcaagccccucuuccuggacagcaucgugaaggggaugaagaaccugcucaacuccaccagccuggagacgucccugagcaucgaggcccccuggggcgccaucaacgugcaguccaccuucaagccgaccgucagcaccgcgaacaucgcccucuccuggagcuccguggagcaccggggcaacaagauccuggugacggggcgcagcgaguccaucaugaagcuggaggagcggaccggcgucagcugggaccucgggguggaggacgccuccgagagcaagcugcugaccgucuccaucauggaccucagccagauguacagccccguguucgaguaccuguccggcgaccgccagguggaggaguggcccaaggcgaccugcacgggggacugccccgagcggugcggcugcaccagcuccacgugccugcacaaggaguggccgcacagccgcaacuggcgcugcaaccccaccuggugcuggggcgucgggaccggcugcacgugcugcgggguggacgugaaggaccucuucaccgaccacauguucgucaaguggaagguggaguacaucaagaccgaggccaucgugugcgucgagcugaccucccaggagcggcagugcagccugaucgaggccggcacccgcuucaaccuggggcccgugaccaucacccucuccgagccccggaacauccagcagaagcugccgcccgagaucaucacccugcaccccaagguggaggagggcuucuucgaccucaugcacguccagaaggugcugagcgccuccacggugugcaagcugcagagcugcacccacggcauccccggggaccuccaggucuaccacaucggcaaccugcugaagggggaccgcgugaacggccaccucauccacaagaucgagccgcacuucaacaccuccuggaugagcugggacggcugcgaccuggacuacuacugcaacaugggggacuggcccuccugcaccuacacgggcgugacccagcacaaccacgccgccuucgucaaccugcucaacaucgagaccgacuacaccaagacguuccacuuccacagcaagcgggugaccgcccacggggacacgccccagcuggaccugaaggcgcgcccgaccuacggcgccggggagaucaccgugcucgucgagguggccgacauggagcugcacaccaagaagguggagaucuccggccugaaguucgccagccucgccugcaccggcugcuacgcgugcuccagcgggaucagcugcaagguccggauccacguggacgagcccgacgagcugaccgugcacgucaaguccagcgaccccgacgugguggccgccuccacgagccugauggcccgcaagcucgaguucggcaccgacuccaccuucaaggcguucagcgccaugcccaagaccucccugugcuucuacaucgucgagcgggaguacugcaagagcugcuccgaggaggacacgcagaagugcguggacaccaagcuggagcagccgcagagcauccucaucgagcacaaggggaccaucaucggcaagcagaacgacacgugcaccgccaaggccuccugcuggcuggagagcgugaaguccuuccuguacgggcucaagaacaugcugggcagcgucuucggcaacuucuucaucgggauccuccuguuccuggcccccuucgugcugcucgugcuguucuucauguucggcuggaagauccuguucugcuucaagugcugccgccggacccgcgggcuccugaaguaccggcugcucaaggacgacgaggagaccggcuaccgccggaucaucgagcgccugaacaacaagaaggggaagaaccggcugcucgacggcgagcgccuggcggaccggaagaucgccgagcuguucuccaccaagacgcacaucggc

SEQ ID NO: 12263 - RNA, 2916 nt, Artificial Sequence
  derived and/or modified CDS sequence (opt1) from CCHFV(75-ST-2010, Artificial)__KR814864.1__Gn-4aa-Gc
agcgaggaguccggcgacgacugcaucagccgcacccagcugcuccggaccgagacggccgagauccacgacgacaacuacgggggccccggggacaagaucaccaucugcaacggcuccaccaucguggaccagcgccuggggagcgagcugggcugcuacaccaucaaccgggucaaguccuucaagcucugcgagaacagcgccacgggcaagaccugcgagaucgacuccaccccggugaagugccgccagggguucugccugaagaucacccaggagggccgggggcacgugaagcugagccgcggcuccgaggucgugcucgacgcgugcgacagcuccugcgaggugaugauccccaaggggacgggcgacauccuggucgacugcagcggcgggcagcagcacuuccugaaggacaaccucaucgaccugggcugcccccacaucccccugcucgggaagauggccaucuacaucugccggauguccaaccacccgcgcaccaccauggccuuccuguucugguucagcuucggcuacgugaucacgugccuguucugcaaggcccucuucuacucccugaucaucaucggcacccuggggaagaagaucaagcaguaccgggagcuccgcccccagaccugcaccaucugcgagaccgcccccgugaacgcgaucgacgccgagaugcacgaccugaacugcagcuacaacaucugccccuacugcgccucccggcugacgagcgacggccucgcccgccacgucccgcagugccccaagcggaaggagaagguggaggagaccgagcuguaccugaaccucgagcgcauccccuggaucgugcggaagcugcugcaggucuccgagagcaccgggguggcgcucaagcgcagcuccuggcugaucgugcugcucguccugcugaccgugagccucucccccgugcagagcgccccggucggccggaagccccuguuccuggacuccaucgugaaggggaugaagaaccuccugaacagcacgucccuggagaccagccucuccaucgaggcccccuggggcgccaucaacgugcagagcaccuucaagcccaccgucuccacggccaacaucgcgcugagcugguccagcguggagcaccgcggcaacaagauccuggugaccgggcgguccgagagcaucaugaagcucgaggagcgcaccggcgucuccugggaccuggggguggaggacgccagcgaguccaagcugcucaccgucagcaucauggaccugagccagauguacuccccgguguucgaguaccugagcggcgaccgccagguggaggaguggcccaaggccacgugcaccggggacugccccgagcggugcggcugcaccuccagcacgugccuccacaaggaguggccccacucccgcaacuggcggugcaacccgaccuggugcuggggcgucgggaccggcugcacgugcugcgggguggacgugaaggaccuguucaccgaccacauguucgucaaguggaagguggaguacaucaagaccgaggccaucgugugcgucgagcugaccagccaggagcgccagugcucccugaucgaggccggcacccgguucaaccucgggcccgugaccaucacccugagcgagccccgcaacauccagcagaagcugcccccggagaucaucacgcuccaccccaagguggaggagggcuucuucgaccugaugcacguccagaaggugcuguccgcgagcaccgugugcaagcuccaguccugcacccacggcauccccggggaccugcaggucuaccacaucggcaaccugcucaagggggaccgggugaacggccaccugauccacaagaucgagccccacuucaacaccagcuggauguccugggacggcugcgaccuggacuacuacugcaacaugggggacuggccgagcugcacguacaccggcgugacccagcacaaccacgccgccuucgucaaccuccugaacaucgagaccgacuacacgaagaccuuccacuuccacuccaagcgcgugaccgcccacggggacacgccccagcuggaccucaaggcccggcccaccuacggcgcgggggagaucaccgugcuggucgagguggccgacauggagcugcacaccaagaagguggagaucagcggccucaaguucgccucccuggccugcaccggcugcuacgccugcagcagcgggaucuccugcaagguccgcauccacguggacgagccggacgagcugacggugcacgucaagagcuccgaccccgacgugguggcggccagcaccucccucauggcccggaagcuggaguucggcaccgacagcaccuucaaggccuucuccgcgaugcccaagacgagccugugcuucuacaucgucgagcgcgaguacugcaaguccugcagcgaggaggacacccagaagugcguggacaccaagcucgagcagccccaguccauccugaucgagcacaaggggaccaucaucggcaagcagaacgacacgugcaccgccaaggccagcugcuggcuggaguccgucaagagcuucuucuacgggcucaagaacaugcugggcuccguguucggcaacuucuucaucgggauccuccuguuccuggccccguucgugcugcucgugcuguucuucauguucggcuggaagauccuguucugcuucaagugcugccggcgcgcccgggggcuccugaaguaccgccaccugaaggacgacgaggagaccggcuaccggaagaucaucgagcgccucaacaacaagaaggggaagaaccggcugcuggacggcgagcgccucgcggaccggaagaucgccgagcuguucagcaccaagacgcacaucggc

SEQ ID NO: 12264 - RNA, 2916 nt, Artificial Sequence
  derived and/or modified CDS sequence (opt1) from CCHFV(3756-ST-2007, Artificial)__KR814866.1__Gn-4aa-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccuccaggugagcgaguccaccggggucgcgcugaagcgcagcagcuggcucaucgugcugcuggugcuccugacggucucccugagccccgugcaguccgccccggugggccggaagccccucuuccuggacagcaucgucaaggggaugaagaaccugcucaacuccaccagccuggagaccucccugagcaucgaggcccccuggggcgccaucaacgugcaguccaccuucaagcccacggugagcaccgccaacaucgcgcucuccuggagcuccgucgagcaccgcggcaacaagauccuggugaccgggcggagcgaguccaucaugaagcuggaggagcgcaccggcgugagcugggaccucggggucgaggacgccuccgagagcaagcugcugacgguguccaucauggaccucagccagauguacagcccggucuucgaguaccuguccggcgaccgccagguggaggaguggcccaaggcgaccugcaccggggacugccccgagcggugcggcugcaccagcuccacgugccugcacaaggaguggccccacagccggaacuggcgcugcaacccgaccuggugcuggggcguggggaccggcugcacgugcugcggggucgacgugaaggaccucuucaccgaccacauguucaucaaguggaagguggaguacaucaagaccgaggccaucgucugcguggagcugaccucccaggagcgccagugcagccugaucgaggccggcacccgguucaaccuggggcccgugaccaucacgcucuccgagccccgcaacauccagcagaagcugcccccggagaucaucacccugcaccccaagaucgaggagggcuucuucgaccucaugcacguccagaaggugcugagcgccuccaccgugugcaagcugcagagcugcacccacggcauccccggggaccuccagaucuaccacaucggcaaccugcugaagggggaccgggucaacggccaccucauccacaagaucgagccccacuucaacacguccuggaugagcugggacggcugcgaccuggacuacuacugcaacaugggggacuggccguccugcaccuacaccggcgugacccagcacaaccacgccgccuucgugaaccugcucaacaucgagacggacuacaccaagaccuuccacuuccacagcaagcgcgucaccgcccacggggacacgccccagcuggaccugaaggcccggcccaccuacggcgcgggggagaucaccgugcucguggaggucgccgacauggagcugcacaccaagaagguggagaucuccggccugaaguucgccagccucacgugcaccggcugcuacgccugcuccagcgggaucagcugcaaggugcgcauccacgucgacgagccggacgagcugaccgugcacgugaaguccagcgaccccgacgucguggccgcguccaccagccugauggcccggaagcucgaguucggcacggacuccaccuucaaggccuucagcgccaugcccaagaccucccugugcuucuacaucguggagcgcgaguacugcaagagcugcuccgaggacgacaccaagaagugcgucgacacgaagcuggagcagccccagagcauccucaucgagcacaaggggaccaucaucggcaagcagaacgacacgugcaccgcgaaggccuccugcuggcuggagagcgugaaguccuucuucuacgggcugaagaacaugcucggcagcguguucggcuccuucuucgucgggauccugcuguuccucaccccguucgugcugcuggugcuguucuucauguucggcuggaagauccuguucugcuucaagugcugccggcgcacccgggggcuguucaaguaccgccaccucaaggacgacgaggagaccggcuaccggcgcaucaucgagcggcugaacagcaagaaggggaagaaccgccugcucgacggcgagcggcuggccgaccgcaagaucgccgagcuguucuccaccaagacgcacaucggc

SEQ ID NO: 12265 - RNA, 2916 nt, Artificial Sequence
  derived and/or modified CDS sequence (opt1) from CCHFV(3809-ST-2007, Artificial)__KR814867.1__Gn-4aa-Gc
agcgaggagcccggcgacgacugcaucucccgcacccagcuccuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugaccgugucccugagcccggugcaguccgcccccgucggccgcaagccccucuuccuggacagcaucgugaaggggaugaagaaccugcucaacuccacgagccuggagaccucccugagcaucgaggcccccuggggcgccaucaacgugcaguccaccuucaagccgaccgucagcacggccaacaucgcgcucuccuggagcuccguggagcaccggggcaacaagauccuggugaccgggcgcagcgaguccaucaugaagcuggaggagcggaccggcgucagcugggaccucgggguggaggacgccuccgagagcaagcugcugaccgucuccaucauggaccucagccagauguacagccccguguucgaguaccuguccggcgaccgccagguggaggaguggcccaaggccacgugcaccggggacugccccgagcggugcggcugcaccagcuccacgugccugcacaaggaguggccgcacagccgcaacuggcgcugcaaccccaccuggugcuggggcgucgggaccggcugcacgugcugcgggguggacgugaaggaccucuucaccgaccacauguucgucaaguggaagguggaguacaucaagaccgaggccaucgugugcgucgagcugaccucccaggagcggcagugcagccugaucgaggccggcacccgcuucaaccuggggcccgugaccaucacccucuccgagccccggaacauccagcagaagcugccgcccgagaucaucacgcugcaccccaagguggaggagggcuucuucgaccucaugcacguccagaaggugcugagcgcguccaccgugugcaagcugcagagcugcacccacggcauccccggggaccuccaggucuaccacaucggcaaccugcugaagggggaccgcgugaacggccaccucauccacaagaucgagccgcacuucaacaccuccuggaugagcugggacggcugcgaccuggacuacuacugcaacaugggggacuggcccuccugcacguacaccggcgugacccagcacaaccacgccgccuucgucaaccugcucaacaucgagaccgacuacacgaagaccuuccacuuccacagcaagcgggugaccgcccacggggacacgccccagcuggaccugaaggcccgcccgaccuacggcgcgggggagaucaccgugcucgucgagguggccgacauggagcugcacaccaagaagguggagaucuccggccugaaguucgccagccucgccugcaccggcugcuacgccugcuccagcgggaucagcugcaagguccggauccacguggacgagcccgacgagcugacggugcacgucaaguccagcgaccccgacgugguggcggccuccaccagccugauggcccgcaagcucgaguucggcaccgacuccaccuucaaggccuucagcgcgaugcccaagacgucccugugcuucuacaucgucgagaaggaguacugccggagcugcuccgaggaggacacccagaagugcguggacaccaagcuggagcagccgcagagcauccucaucgagcacaaggggaccaucaucggcaagcagaacgacacgugcaccgccaaggccuccugcuggcuggagagcgugaaguccuucuucuacgggcugaagaacaugcucggcagcgucuucggcaacuucuucaucgggauccugcuguuccucacccccuucgugcugcuggugcuguucuucauguucggcuggaagauccucuucugcuucaagugcugccgccggacccgcgggcugcucaaguaccggcaccugaaggacgacgaggagacgggcuaccgccggaucaucgagcgccugaacaacaagaaggggaagaaccggcuccuggacggcgagcgccuggccgaccggaagaucgccgagcuguucuccaccaagacccacaucggc

SEQ ID NO: 12266 - RNA, 2916 nt, Artificial Sequence
  derived and/or modified CDS sequence (opt1) from CCHFV(3820-ST-2007, Artificial)__KR814868.1__Gn-4aa-Gc
agcgaggagcccggcgacgacugcaucucccgcacccagcugcucaagaccgagacggccgagauccacgacgacaacuacgggagcccgggcgacaagaucaccaucugcaacggguccaccaucguggaccagcggcugggcagcgagcuggggugcuacaccaucaaccgcgugaaguccuucaagcucugcgagaacagcgccacgggcaagaccugcgagaucgacuccacccccgugaagugccggcagggcuucugccugaagaucacccaggaggggcgcggccacgugaagcugagccggggguccgaggucgugcucgacgcgugcgacagcuccugcgagaucaugauccccaagggcacgggggacauccugguggacugcagcggcggccagcagcacuuccugaaggacaaccucaucgaccuggggugcccccacaucccgcugcucggcaagauggccaucuacaucugccgcauguccaaccacccccggaccaccauggccuuccuguucugguucagcuucggguacgucaucacgugcaucuucugcaaggcccuguucuacucccucaucaucaucggcacccugggcaagaagaucaagcaguaccgcgagcugaagccccagaccugcaccaucugcgagaccgcccccgugaacgcgaucgacgccgagaugcacgaccucaacugcagcuacaacaucugcccguacugcgccucccggcugacgagcgacgggcuggcccgccacgugacccagugccccaagcggaaggagaaggucgaggagaccgagcucuaccugaaccuggagcgcauccccuggaucgugcggaagcuccuccagguguccgagagcaccggcgucgcgcugaagcgcagcuccuggcucaucgugcugcuggugcuccuggccgucagccugucccccgugcagagcgccccgguggggcggaagccccucuuccuggacuccaucgucaagggcaugaagaaccugcucaacagcacgucccuggagaccagccuguccaucgaggcccccuggggcgccaucaacgugcagagcaccuucaagcccaccguguccacggcgaacaucgcccucagcugguccagcgucgagcaccgcgggaacaagauccuggugaccggccgguccgagagcaucaugaagcuggaggagcgcaccgggguguccugggaccucggcgucgaggacgccagcgaguccaagcugcugaccgugagcaucauggaccucagccagauguacuccccggucuucgaguaccugagcggggaccgccagguggaggaguggcccaaggccacgugcaccggcgacugccccgagcggugcgggugcaccuccagcacgugccugcacaaggaguggccccacucccggaacuggcgcugcaacccgaccuggugcuggggcgugggcaccgggugcacgugcugcggcgucgacgugaaggaccucuucaccgaccacauguucaucaaguggaagguggaguacaucaagaccgaggccaucgucugcguggagcugaccagccaggagcgccagugcucccugaucgaggcggggacccgguucaaccugggccccgugaccaucacccucagcgagccccgcaacauccagcagaagcugcccccggagaucaucacgcugcaccccaagaucgaggagggguucuucgaccucaugcacguccagaaggugcuguccgccagcaccgugugcaagcugcaguccugcacccacggcauccccggcgaccuccagaucuaccacaucgggaaccugcugaagggcgaccgggucaacgggcaccucauccacaagaucgagccccacuucaacaccagcuggauguccugggacggcugcgaccuggacuacuacugcaacaugggcgacuggccgagcugcacguacaccggggugacccagcacaaccacgccgccuucgugaaccugcucaacaucgagaccgacuacacgaagaccuuccacuuccacuccaagcgcgucaccgcccacggcgacacgccccagcuggaccugaaggcgcggcccaccuacggggccggcgagaucaccgugcucguggaggucgccgacauggagcugcacaccaagaagguggagaucagcgggcugaaguucgccucccugaccugcacgggcugcuacgccugcagcagcggcaucuccugcaaggugcgcauccacgucgacgagccggacgagcugaccgugcacgucaagagcuccgaccccgacgugguggcggccagcaccucccugauggcccggaagcucgaguucgggaccgacagcacguucaaggccuucuccgcgaugcccaagaccagccugugcuucuacaucguggagcgcgaguacugcaaguccugcagcgaggacgacaccaagaagugcgucgacaccaagcuggagcagccccaguccauccucaucgagcacaagggcacgaucaucgggaagcagaacgacacgugcaccgccaaggccagcugcuggcuggaguccgucaagagcuucuucuacggccugaagaacaugcucggguccguguucggcagcuucuucgugggcauccugcuguuccucgccccguucgugcugcugguccucuucuucauguucggguggaagauccuguucugcuucaagugcugccggcgcacccggggccuguucaaguaccgccaccucaaggacgacgaggagaccggguaccggcgcaucaucgagcggcugaacuccaagaagggcaagaaccgccugcucgacggggagcggcuggccgaccgcaagaucgcggagcuguucagcaccaagacccacaucggc

SEQ ID NO: 12267 - RNA, 2916 nt, Artificial Sequence
  derived and/or modified CDS sequence (opt1) from CCHFV(4495-ST-2008, Artificial)__KR814869.1__Gn-4aa-Gc
agcgaggaguccggcgacgacugcaucagccgcacccagcugcuccggaccgagacggccgagauccacgacgacaacuacgggggccccggggacaagaucaccaucugcaacggcuccaccaucguggaccagcgccuggggagcgagcugggcugcuacaccaucaaccgggucaaguccuucaagcucugcgagaacagcgccacgggcaagaccugcgagaucgacuccaccccggugaagugccgccagggguucugccugaagaucacccaggagggccgggggcacgugaagcugagccgcggcuccgaggucgugcucgacgcgugcgacagcuccugcgaggugaugauccccaaggggacgggcgacauccuggucgacugcagcggcgggcagcagcacuuccugaaggacaaccucaucgaccugggcugcccccacaucccccugcucgggaagauggccaucuacaucugccggauguccaaccacccgcgcaccaccauggccuuccuguucugguucagcuucggcuacgugaucacgugccuguucugcaaggcccucuucuacucccugaucaucaucggcacccuggggaagaagaucaagcaguaccgggagcuccgcccccagaccugcaccaucugcgagaccgcccccgugaacgcgaucgacgccgagaugcacgaccugaacugcagcuacaacaucugccccuacugcgccucccggcugacgagcgacggccucgcccgccacgucccgcagugccccaagcggaaggagaagguggaggagaccgagcuguaccugaaccucgagcgcauccccuggaucgugcggaagcugcugcaggucuccgagagcaccgggguggcgcucaagcgcagcuccuggcugaucgugcugcucguccugcugaccgugagccucucccccgugcagagcgccccggucggccggaagccccuguuccuggacuccaucgugaaggggaugaagaaccuccugaacagcacgucccuggagaccagccucuccaucgaggcccccuggggcgccaucaacgugcagagcaccuucaagcccaccgucuccacggccaacaucgcgcugagcugguccagcguggagcaccgcggcaacaagauccuggugaccgggcgguccgagagcaucaugaagcucgaggagcgcaccggcaucuccugggaccugggggucgaggacgccagcgaguccaagcugcucaccgugagcaucauggaccugagccagauguacuccccggucuucgaguaccugagcggcgaccgccagguggaggaguggcccaaggccacgugcaccggggacugccccgagcggugcggcugcaccuccagcacgugccuccacaaggaguggccccacucccgcaacuggcggugcaacccgaccuggugcuggggcguggggaccggcugcacgugcugcggggucgacgugaaggaccuguucaccgaccacauguucgugaaguggaaggucgaguacaucaagaccgaggccaucgugugcguggagcugaccagccaggagcgccagugcucccugaucgaggccggcacccgguucaaccucgggcccgucaccaucacccugagcgagccccgcaacauccagcagaagcugcccccggagaucaucacgcuccaccccaagguggaggagggcuucuucgaccugaugcacgugcagaagguccuguccgcgagcaccgugugcaagcuccaguccugcacccacggcauccccggggaccuccagguguaccacaucggcaaccugcucaagggggaccgggucaacggccaccugauccacaagaucgagccccacuucaacaccagcuggauguccugggacggcugcgaccuggacuacuacugcaacaugggggacuggccgagcugcacguacaccggcgugacccagcacaaccacgccgccuucgugaaccuccugaacaucgagaccgacuacacgaagaccuuccacuuccacuccaagcgcgucaccgcccacggggacacgccccagcuggaccucaaggcccggcccaccuacggcgcgggggagaucaccgugcugguggaggucgccgacauggagcugcacaccaagaagguggagaucagcggccucaaguucgccucccuggccugcaccggcugcuacgccugcagcagcgggaucuccugcaaggugcgcauccacgucgacgagccggacgagcugacggugcacgucaagagcuccgaccccgacgugguggcggccagcaccucccucauggcccggaagcuggaguucggcaccgacagcaccuucaaggccuucuccgcgaugcccaagacgagccugugcuucuacaucguggagcgcgaguacugcaaguccugcagcgaggaggacacccagcggugcgucgacaccaagcucgagcagccccaguccauccugaucgagcacaaggggaccaucaucggcaagcagaacgacacgugcaccgccaaggccagcugcuggcuggaguccgucaagagcuucuucuacgggcucaagaacaugcugggcuccguguucggcaacuucuucaucgggauccugcuguuccuggccccguucgugcugcucgugcuguucuucauguucggcuggaagauccuguucugcuucaagugcugccgccgggcccgcgggcuccugaaguaccggcaccugaaggacgacgaggagaccggcuaccgcaagaucaucgagcggcucaacaacaagaaggggaagaaccgccugcuggacggcgagcggcucgcggaccgcaagaucgccgagcuguucagcaccaagacgcacaucggc

SEQ ID NO: 12268 - RNA, 2916 nt, Artificial Sequence
  derived and/or modified CDS sequence (opt1) from CCHFV(4691-ST-2009, Artificial)__KR814871.1__Gn-4aa-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccuccaggugagcgaguccaccggggucgcgcugaagcgcagcagcuggcucaucgugcugcuggugcuccugacggucucccugagccccgugcaguccgccccggugggccggaagccccucuuccuggacagcaucgucaaggggaugaagaaccugcucaacuccaccagccuggagaccucccugagcaucgaggcccccuggggcgccaucaacgugcaguccaccuucaagcccgccgugagcacggcgaacaucgcccucuccuggagcuccgucgagcaccgcggcaacaagauccuggugaccgggcggagcgaguccaucaugaagcuggaggagcgcaccggcgugagcugggaccucggggucgaggacgccuccgagagcaagcugcugaccguguccaucauggaccucagccagauguacagcccggucuucgaguaccuguccggcgaccgccagguggaggaguggcccaaggccacgugcaccggggacugccccgagcggugcggcugcaccagcuccacgugccugcacaaggaguggccccacagccggaacuggcgcugcaacccgaccuggugcuggggcguggggaccggcugcacgugcugcggggucgacgugaaggaccucuucaccgaccacauguucaucaaguggaagguggaguacaucaagaccgaggccaucgucugcguggagcugaccucccaggagcgccagugcagccugaucgaggcgggcacccgguucaaccuggggcccgugaccaucacccucuccgagccccgcaacauccagcagaagcugcccccggagaucaucacgcugcaccccaagaucgaggagggcuucuucgaccucaugcacguccagaaggugcugagcgccuccaccgugugcaagcugcagagcugcacccacggcauccccggggaccuccagaucuaccacaucggcaaccugcugaagggggaccgggucaacggccaccucauccacaagaucgagccccacuucaacaccuccuggaugagcugggacggcugcgaccuggacuacuacugcaacaugggggacuggccguccugcacguacaccggcgugacccagcacaaccacgccgccuucgugaaccugcucaacaucgagaccgacuacacgaagaccuuccacuuccacagcaagcgcgucaccgcccacggggacacgccccagcuggaccugaaggcgcggcccaccuacggcgccggggagaucaccgugcucguggaggucgccgacauggagcugcacaccaagaagguggagaucuccggccugaaguucgccagccucgccugcaccggcugcuacgcgugcuccagcgggaucagcugcaaggugcgcauccacgucgacgagccggacgagcugacggugcacgugaaguccagcgaccccgacgucguggccgccuccaccagccugauggcccggaagcucgaguucggcaccgacuccaccuucaaggcguucagcgccaugcccaagacgucccugugcuucuacaucguggagcgcgaguacugcaagagcugcuccgaggacgacaccaagaagugcgucgacaccaagcuggagcagccccagagcauccucaucgagcacaaggggaccaucaucggcaagcagaacgacacgugcaccgccaaggccuccugcuggcuggagagcgugaaguccuucuucuacgggcugaagaacaugcucggcagcguguucggcaacuucuucgucgggauccugcuguuccucgccccguucgugcugcuggugcuguucuucauguucggcuggaagauccuguucugcuucaagugcugccggcgcacccgggggcuguucaaguaccgccaccucaaggacgacgaggagaccggcuaccggcgcaucaucgagcggcugaacuccaagaaggggaagaaccgccugcucgacggcgagcggcuggcggaccgcaagaucgccgagcuguucagcacgaagacccacaucggc

SEQ ID NO: 12269 - RNA, 2916 nt, Artificial Sequence
  derived and/or modified CDS sequence (opt1) from CCHFV(4701-ST-2009, Artificial)__KR814872.1__Gn-4aa-Gc
agcgaggagcccggcgacgacugcaucucccgcacccagcugcucaagaccgagacggccgagauccacgacgacaacuacgggggcccgggggacaagaucaccaucugcaacggcagcaccguggucgaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgagguggugcucgacgcgugcgacuccagcugcgagaucaugauccccaaggggacgggcgacauccuggucgacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgugaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgucacccagugccccaagcggaaggagaagguggaggagaccgagcucuaccugaaccuggagcgcauccccuggaucgugcggaagcuccugcaggucagcgaguccaccgggguggcgcugaagcgcagcagcuggcucaucgugcugcugguccuccugacggugucccugagccccgugcaguccgccccggucggccggaagccccucuuccuggacagcaucgugaaggggaugaagaaccugcucaacuccaccagccuggagaccucccugagcaucgaggcccccuggggcgccaucaacgugcaguccaccuucaagcccacggucagcaccgccaacaucgcgcucuccuggagcuccguggagcaccgcggcaacaagauccuggugaccgggcggagcgaguccaucaugaagcuggaggagcgcaccggcgucagcugggaccucgggguggaggacgccuccgagagcaagcugcugacggucuccaucauggaccucagccagauguacagcccgguguucgaguaccuguccggcgaccgccagguggaggaguggcccaaggcgaccugcaccggggacugccccgagcggugcggcugcaccagcuccacgugccugcacaaggaguggccccacagccggaacuggcgcugcaacccgaccuggugcuggggcgucgggaccggcugcacgugcugcgggguggacgugaaggaccucuucaccgaccacauguucaucaaguggaaggucgaguacaucaagaccgaggccaucgugugcguggagcugaccucccaggagcgccagugcagccugaucgaggccggcacccgguucaaccuggggcccgucaccaucacgcucuccgagccccgcaacauccagcagaagcugcccccggagaucaucacccugcaccccaagaucgaggagggcuucuucgaccucaugcacgugcagaaggugcugagcgccuccaccgucugcaagcugcagagcugcacccacggcauccccggggaccuccagaucuaccacaucggcaaccugcugaagggggaccgggugaacggccaccucauccacaagaucgagccccacuucaacacguccuggaugagcugggacggcugcgaccuggacuacuacugcaacaugggggacuggccguccugcaccuacaccggcgugacccagcacaaccacgccgccuucgucaaccugcucaacaucgagacggacuacaccaagaccuuccacuuccacagcaagcgcgugaccgcccacggggacacgccccagcuggaccugaaggcccggcccaccuacggcgcgggggagaucaccgugcucgucgagguggccgacauggagcugcacaccaagaagguggagaucuccggccugaaguucgccagccucacgugcaccggcugcuacgccugcuccagcgggaucagcugcaagguccgcauccacguggacgagccggacgagcugaccgugcacgucaaguccagcgaccccgacgugguggccgcguccaccagccugauggcccggaagcucgaguucggcacggacuccaccuucaaggccuucagcgccaugcccaagaccucccugugcuucuacaucgucgagcgcgaguacugcaagagcugcuccgaggacgacaccaagaagugcguggacacgaagcuggagcagccccagagcauccucaucgagcacaaggggaccaucaucggcaagcagaacgacacgugcaccgcgaaggccuccugcuggcuggagagcgugaaguccuucuucuacgggcugaagaacaugcucggcagcgucuucggcggguucuucgugggcauccugcuguuccucgccccguucgugcugcugguccucuucuucauguucggguggaagauccuguucugcuucaagugcugccggcgcacccggggccuguucaaguaccgccaccucaaggacgacgaggagaccggguaccggcgcaucaucgagcggcugaacuccaagaagggcaagaaccgccugcucgacggcgagcggcuggccgaccgcaagaucgccgagcuguucagcaccaagacccacaucggg

SEQ ID NO: 12270 - RNA, 2916 nt, Artificial Sequence
  derived and/or modified CDS sequence (opt1) from CCHFV(5170-R-2011, Artificial)__KR814873.1__Gn-4aa-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgugugcgacuccagcugcgagaucaugauccccaaggggacgggcgacauccuggucgacugcuccggcgggcagcagcacuuccugaaggacaaccucaucgaccugggcugcccccacaucccgcugcucgggaagauggcgaucuacaucugccgcaugagcaaccacccccggaccaccauggccuuccuguucugguucuccuucggcuacgugaucacgugcaucuucugcaaggcccuguucuacagccucaucaucaucggcacccuggggaagaagaucaagcaguaccgcgagcugaagccccagaccugcaccaucugcgagaccgcccccgugaacgccaucgacgcggagaugcacgaccucaacugcuccuacaacaucugcccguacugcgccagccggcugacguccgagggccuggcccgccacgucacccagugccccaagcggaaggagaagguggaggagaccgagcucuaccugaaccuggagcgcauccccuggaucgugcggaagcuccugcaggucagcgaguccaccgggguggcccugaagcgcagcagcuggcucaucgugcugcugguccuccugacggugucccugagccccgugcaguccgcgccggucggccggaagccccucuuccuggacagcaucgugaaggggaugaagaaccugcucaacuccaccagccuggagaccucccugagcaucgaggcccccuggggcgccaucaacgugcaguccaccuucaagcccacggucagcaccgccaacaucgcccucuccuggagcuccguggagcaccgcggcaacaagauccuggugaccgggcggagcgaguccaucaugaagcuggaggagcgcaccggcgucagcugggaccucgggguggaggacgcguccgagagcaagcugcugacggucuccaucauggaccucagccagauguacagcccgguguucgaguaccuguccggcgaccgccagguggaggaguggcccaaggcgaccugcaccggggacugccccgagcggugcggcugcaccagcuccacgugccugcacaaggaguggccccacagccggaacuggcgcugcaacccgaccuggugcuggggcgucgggaccggcugcacgugcugcgggguggacgugaaggaccucuucaccgaccacauguucaucaaguggaaggucgaguacaucaagaccgaggccaucgugugcguggagcugaccucccaggagcgccagugcagccugaucgaggccggcacccgguucaaccuggggcccgucaccaucacgcucuccgagccccgcaacauccagcagaagcugcccccggagaucaucacccugcaccccaagaucgaggagggcuucuucgaccucaugcacgugcagaaggugcugagcgccuccaccgucugcaagcugcagagcugcacccacggcauccccggggaccuccagaucuaccacaucggcaaccugcugaagggggaccgggugaacggccaccucauccacaagaucgagccccacuucaacacguccuggaugagcugggacggcugcgaccuggacuacuacugcaacaugggggacuggccguccugcaccuacaccggcgugacccagcacaaccacgccgccuucgucaaccugcucaacaucgagacggacuacaccaagaccuuccacuuccacagcaagcgcgugaccgcccacggggacacgccccagcuggaccugaaggcccggcccaccuacggcgccggggagaucaccgugcucgucgagguggcggacauggagcugcacaccaagaagguggagaucuccggccugaaguucgccagccucacgugcaccggcugcuacgccugcuccagcgggaucagcugcaagguccgcauccacguggacgagccggacgagcugaccgugcacgucaaguccagcgaccccgacgugguggccgccuccaccagccugauggcgcggaagcucgaguucggcacggacuccaccuucaaggccuucagcgccaugcccaagaccucccugugcuucuacaucgucgagcgcgaguacugcaagagcugcuccgaggacgacaccaagaagugcguggacacgaagcuggagcagccccagagcauccucaucgagcacaaggggaccaucaucggcaagcagaacgacacgugcaccgccaaggcguccugcuggcuggagagcgugaaguccuucuucuacgggcugaagaacaugcucggcagcgucuucggcuccuucuucguggggauccugcuguuccucgccccguucgugcugcugguccucuucuucauguucggcuggaagauccuguucugcuucaagugcugccggcgcacccgggggcuguucaaguaccgccaccucaaggacgacgaggagaccggcuaccggcgcaucaucgagcggcugaacagcaagaaggggaagaaccgccugcucgacggcgagcggcuggccgaccgcaagaucgccgagcuguucuccaccaagacccacaucggc

SEQ ID NO: 12271 - RNA, 2916 nt, Artificial Sequence
  derived and/or modified CDS sequence (opt1) from CCHFV(Oman-199809166, Artificial)__KR864901.1__Gn-4aa-Gc
agcgaggaguccggcgaggacugcaucagccgcacccagcugcuccggaccgagacggccgagauccacggggacaacuacggcgggcccggcgacaagaucaccaucugcaacggguccaccaucguggaccagcgccugggcagcgagcugggcugcuacaccaucaaccgggugaaguccuucaagcucugcgagaacagcgccacggggaaguccugcgagaucgacaacaccccggugaagugcaagcagggcuucugccugaagaucacccaggaggggcgcggccacgugaagcugagccgggacuccgaggucgugcucgacgcgugcgacagcuccugcgagaucaugauccccaaggggaccggcgacauccugguggacugcagcggcgggcagcagcacuuccugaaggacaaccucaucgaccugggcugccccaacaucccccugcucgggaagauggccaucuacaucugccgcauguccaaccacccgaagacgaccauggccuuccuguucugguucagcuucggcuacgucaucacgugcauccugugcaaggugaucuucuaccuccugaucguggucggcacccuggggaagaaguucaagcaguaccgggagcucaagccccagaccugcaccaucugcgagaccacccccgugaacgccaucgacgccgagaugcacgaccugaacugcuccuacaacaucugccccuacugcgcgagccgccugacguccgacggccucgcccggcacgugaugcagugcccgaagcgcaaggagaagaucgaggagaccgagcuguaccugaaccucgagcggauccccugggucgugcgcaagcugcuccaggugagcgaguccaccggggucgcccucaagcggagcagcuggcugaucgugcugcucgugcugcugaccgucucccucagccccgugcaguccgcccccaucggccgcaagccgcuguuccuggacagcaucgcgaaggggaugaagaaccuccugaacuccacgagccuggagaccucccucagcaucgaggcccccuggggcgccaucaacgugcaguccaccuucaagcccaccgucagcacggccaacaucgcccuguccuggagcuccguggagcaccggggcaacaagauccuggugagcgggcgcuccgagagcaucaugaagcucgaggagcggaccggcaucuccugggaccugggggucgaggacgcgagcgaguccaagcugcucaccgugagcgucauggaccugagccagauguacucccccguguucgaguaccugagcggcgaccgccagguggaggaguggccgaaggcgaccugcacgggggacugccccgagcggugcggcugcaccuccagcacgugccuccacaaggaguggccccacucccgcaacuggcggugcaaccccaccuggugcuggggcgucgggaccggcugcacgugcugcgggcuggacgugaaggaccuguucaccgacuacauguucgugaaguggaaggucgaguacaucaagaccgaggccaucgugugcguggagcugaccagccaggagcgccagugcucccucaucgaggccggcacccgcuucaaccuggggccggucaccaucacccugagcgagccccggaacauccagcagaagcucccgcccgagaucgugacccugcacccccgcaucgaggagggcuucuucgaccugaugcacgugcagaagguccucuccgccagcacggugugcaagcugcaguccugcacccacggcgugcccggggaccugcaggucuaccacaucggcaaccuccugaagggggacaaggugaacggccaccugauccacaagguggagccccacuucaacaccagcuggauguccugggacggcugcgaccucgacuacuacugcaacaugggggacuggcccagcugcaccuacacgggcgucacccagcacaaccacgccgccuucgugaaccugcugaacaucgagaccgacuacaccaagaacuuccacuuccacuccaagcgggugacggcccacggggacaccccgcagcucgaccugaaggcccgccccaacuacggcgccggggagaucaccguccugguggagguggcggacauggagcuccacaccaagaagaucgagaucagcggccugaaguucgccucccugacgugcaccggcugcuacgccugcagcagcgggaucuccugcaagguccggauccacguggacgagcccgacgagcucaccgugcacgucaagagcgaggacccggacaucguggccgccuccagcucccugauggcgcgcaagcuggaguucggcaccgacagcacguucaaggccuucuccgccaugcccaagaccagccucugcuucuacaucguggagcgggaguacugcaaguccugcagcaaggaggacacccagaagugcgucaacgccaagcuggagcgcccccaguccauccugaucgagcacaaggggaccaucaucggcaagcagaacgacacgugcaccgcgaaggccagcugcuggcucgaguccgucaagagcuucuucuacgggcugaagaacaugcuguccggcaucuucggcaacguguucaucgggaucuuccucuuccuggcccccuucauccugcucauccuguucuucauguucggcuggcggauccuguucugcuucaagugcugccgccggacccgcggccucuucaaguaccggcaccugaaggacgacgaggagaccggguaccgcaagaucaucgagcggcugaacaacaagaaggggaagaacaagcuccuggacggcgagcgccuggccgaccggaagaucgccgagcuguucagcacgaagacccacaucggc

SEQ ID NO: 12272 - RNA, 2916 nt, Artificial Sequence
  derived and/or modified CDS sequence (opt1) from CCHFV(200406546-Turkey, Artificial)__KR864902.1__Gn-4aa-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgugugcgacuccagcugcgaggucaugauccccaaggggacgggcgacauccugguggacugcuccggcgggcagcagcacuuccugaaggacaaccucaucgaccugggcugcccccacgugccgcugcucgggcggauggcgaucuacaucugccgcaugagcaaccacccccggaccaccauggccuuccuguucugguucuccuucggcuacgucaucacgugcaucuucugcaaggcccuguucuacagccucaucaucaucggcacccuggggaagaaguucaagcaguaccgcgagcugaagccccagaccugcaccaucugcgagaccgcccccgugaacgccaucgacgcggagaugcacgaccucaacugcuccuacaacaucugcccguacugcgccagccggcugacguccgacggccuggcccgccacgugccccagugccccaagcggaaggagaaggucgaggagaccgagcucuaccugaaccuggagcgcauccccuggaucgugcggaagcuccuccaggugagcgaguccaccggggucgcccugaagcgcagcagcuggcugaucgugcugcuggugcuccugaccgucucccugagcccggugcaguccgcgcccgugggccggaagccccucuuccuggacagcaucgucaaggggaugaagaaccugcucaacuccacgagccuggagaccucccugagcaucgaggcccccuggggcgccaucaacgugcaguccaccuucaagccgaccgugagcacggccaacaucgcccucuccuggagcuccaucgagcaccgcggcaacaagauccuggucaccgggcggagcgaguccaucaugaagcuggaggagcgcaccggcgugagcugggaccucggggucgaggacgcguccgagagcaagcugcugaccguguccaucauggaccucagccagauguacagccccguguucgaguaccuguccggcgaccggcaggucgaggaguggcccaaggccacgugcaccggggacugccccgagcgcugcggcugcaccagcuccacgugccugcacaaggaguggccgcacagccgcaacuggcggugcaaccccaccuggugcuggggcguggggaccggcugcacgugcugcgggguggacgucaaggaccucuucaccgaccacauguucgugaaguggaagguggaguacaucaagaccgaggccaucgucugcguggagcugaccucccaggagcgccagugcagccugaucgaggccggcacccgguucaaccuggggcccgugaccaucacccucuccgagccccgcaacauccagcagaagcugccgcccgagaucaucacgcugcaccccaaggucgaggagggcuucuucgaccucaugcacgugcagaaggugcugagcgccuccaccgucugcaagcugcagagcugcacccacggcauccccggggaccuccagguguaccacaucggcaaccugcugaagggggaccgggugaacggccaccucauccacaagaucgagccgcacuucaacaccuccuggaugagcugggacggcugcgaccuggacuacuacugcaacaugggggacuggcccuccugcacguacaccggcgucacccagcacaaccacgcggccuucgugaaccugcucaacaucgagaccgacuacacgaagaccuuccacuuccacagcaagcgcgugaccgcccacggggacacgccccagcuggaccugaaggcccggccgaccuacggcgccggggagaucaccguccucguggagguggcggacauggagcugcacaccaagaaggucgagaucuccggccugaaguucgccagccucgccugcaccggcugcuacgccugcuccagcgggaucagcugcaaggugcgcauccacguggacgagcccgacgagcugacgguccacgugaaguccagcgaccccgacguggucgccgcguccaccagccugaccgcccggaagcucgaguucggcaccgacuccacguucaaggccuucagcgccaugcccaagaccucccugugcuucuacaucguggagaaggaguacugcaagagcugcaacgaggacgacacccagaagugcguggacaccaagcuggagcagccgcaguccauccucaucgagcacaaggggacgaucaucggcaagcagaacgacacgugcaccgcgaaggccagcugcuggcuggaguccgucaagagcuucuucuacgggcugaagaacaugcucggcuccguguucggcaacuucuucaucgggauccugcuguuccucgcccccuucgugcugcugguccucuucuucauguucggcuggaagauccuguucugcuucaagugcugccgccggacccgcgggcuguucaaguaccggcaccucaaggacgacgaggagaccggcuacaagcgcaucaucgagcggcugaacaacaagaaggggaagaaccgccugcucgacggcgagcggcuggccgaccgcaagaucgccgagcuguucagcaccaagacccacaucggc

SEQ ID NO: 12273 - RNA, 2916 nt, Artificial Sequence
  derived and/or modified CDS sequence (opt1) from CCHFV(1-CR/HU-2015, Artificial)__KU161584.1__Gn-4aa-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucacccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugacggugucccugagccccgugcaguccgccccggucggccgcaagccccucuuccuggacagcaucgugaaggggaugaagaaccugcucaacuccaccagccuggagaccucccugagcaucgaggcccccuggggcgccaucaacgugcaguccaccuucaagcccacggucagcaccgccaacaucgcgcucuccuggagcuccguggagcaccggggcaacaagauccuggugaccgggcgcagcgaguccaucaugaagcuggaggagcggaccggcgucagcugggaccucgggguggaggacgccuccgagagcaagcugcugacggucuccaucauggaccucagccagauguacagcccgguguucgaguaccuguccggcgaccgccagguggaggaguggcccaaggcgaccugcaccggggacugccccgagcggugcggcugcaccagcuccacgugccugcacaaggaguggccccacagccgcaacuggcgcugcaacccgaccuggugcuggggcgucgggaccggcugcacgugcugcgggguggacgugaaggaccucuucaccgaccacauguucgucaaguggaagguggaguacaucaagaccgaggccaucgugugcgucgagcugaccucccaggagcggcagugcagccugaucgaggccggcacccgcuucaaccuggggcccgugaccaucacgcucuccgagccccggaacauccagcagaagcugcccccggagaucaucacccugcaccccaagaucgaggagggcuucuucgaccucaugcacgugcagaagguccugagcgccuccaccgugugcaagcugcagagcugcacccacggcauccccggggaccuccagguguaccacaucggcaaccugcugaagggggaccgcgucaacggccaccucauccacaagaucgagccccacuucaacacguccuggaugagcugggacggcugcgaccuggacuacuacugcaacaugggggacuggccguccugcaccuacaccggcgugacccagcacaaccacgccgccuucgugaaccugcucaacaucgagacggacuacaccaagaccuuccacuuccacagcaagcgggucaccgcccacggggacacgccccagcuggaccugaaggcccgccccaccuacggcgcgggggagaucaccgugcucguggaggucgccgacauggagcugcacaccaagaagguggagaucuccggccugaaguucgccagccucgccugcacgggcugcuacgccugcuccagcgggaucagcugcaaggugcggauccacgucgacgagccggacgagcugaccgugcacgugaaguccagcgaccccgacgucguggcggccuccaccagccugauggcccgcaagcucgaguucggcaccgacuccacguucaaggccuucagcgcgaugcccaagaccucccugugcuucuacaucguggagcgggaguacugcaagagcugcuccgaggacgacaccaagaagugcgucgacaccaagcuggagcagccccagagcauccucaucgagcacaaggggacgaucaucggcaagcagaacgacacgugcaccgccaaggccuccugcuggcuggagagcgugaaguccuucuucuacgggcugaagaacaugcucggcagcguguucggcaacuucuucaucgggauccugcuguuccucgccccguucguccugcuggugcuguucuucauguucggcuggaagauccucuucugcuucaagugcugccgccggacccgcgggcuguucaaguaccggcaccucaaggacgacgaggagaccggcuaccgccggaucaucgagcgccugaacaacaagaaggggaagaaccggcugcucgacggcgagcgccuggccgaccggaagaucgcggagcuguucuccaccaagacccacaucggc

SEQ ID NO: 12274 - RNA, 2916 nt, Artificial Sequence
  derived and/or modified CDS sequence (opt1) from CCHFV(Gaib, Artificial)__KX013445.1__Gn-4aa-Gc
agcgaggaguccagcgacgacugcaucucccgcacccagcugcuccggaccgagacggccgagauccacaacgacaacuacggcgggcccggcgacaagaucaccaucugcaacgggagcaccaucguggaccagcgccugggcuccgagcuggggugcuacaccaucaaccgggucaagagcuucaagcucugcgagaacuccgccacgggcaagagcugcgagaucgacuccaucccggugaagugccgccagggcuucugccugaagaucacccaggaggggcggggccacgugaagcugagccgcggguccgaggucgugcucgacgcgugcgacagcuccugcgagaucaugauccccaagggcaccggggacauccugguggacugcagcggcggccagcagcacuuccugaaggacaaccucaucgaccuggggugccccaacaucccccugcucggcaagauggccaucuacaucugccggauguccaaccacccgaagaccacgauggccuuccuguucugguucagcuucggguacgucaucaccugcaucuucugcaaggccaucuucuaccugcucaucaucgugggcacccugggcaagaaguucaagcaguaccgcgagcugaagccccagaccugcacgaucugcgagaccacccccgugaacgccaucgacgcggagaugcacgaccucaacugcuccuacaacaucugccccuacugcgccagccggcugaccuccgacgggcuggcccgccacgucgugcacugcccgaagcggaaggagaagaucgaggagacggagcucuaccugaaccuggagcgcgugcccugggucgugcggaagcuccugcaggugagcgagagcaccggcgucgcccugaagcgcuccagcuggcucaucgugcugcuggugcuccugaccgucucccugagccccgugcaguccgcgcccaucgggcggaagccgcucuucagcgacuccaucgugaagggcaugaagaaccugcugaacagcaccucccucgagacgagccuguccaucgaggcccccuggggggccaucaacguccagagcaccuucaagcccaccguguccaccgccaacaucgcccugagcugguccagcaucgagcaccgcggcaacaagauccucguguccggccggagcgaguccaucaugaagcuggaggagcgcacggggaucagcugggaccugggcgucgaggacgcgagcgagucccggcuccugaccgugagcgucauggaccugucccagauguacagccccguguucgaguaccucuccggggaccgccagguggaggaguggccgaaggccaccugcaccggcgacugccccgagcggugcgggugcacgagcuccaccugccugcacaaggaguggccccacagccgcaacuggcgcugcaaccccaccuggugcuggggcgucggcaccgggugcacgugcugcggccuggacgugaaggaccucuucaccgacuacauguucgugaaguggaaggucgaguacaucaagaccgaggccaucgugugcguggagcugaccucccaggagcggcagugcagccugaucgaggccgggacgcgcuucaaccugggcccggucaccaucacccucuccgagccccggaacauccagcagaagcugccccccgagaucaucacccugcacccgcgcaucgaggagggguucuucgaccucaugcacgugcagaaggugcugagcgccuccaccgucugcaagcugcagagcugcacgcacggcgugcccggcgaccuccagguguaccacaucgggaaccugcugaagggcgacaaggucaacgggcaccucauccacaagaucgagccccacuucaacaccuccuggaugagcugggacggcugcgaccuggacuacuacugcaacaugggcgacuggcccuccugcaccuacaccggggugacgcagcacaaccacgcggccuucgugaaccugcucaacaucgagaccgacuacaccaagaacuuccacuuccacagcaagcgggucaccgcccacggcgacacgccgcagcuggaccugaaggcccgccccaccuacggggccggcgagaucaccgugcucguggaggucgcggacauggagcugcacaccaagaagaucgagaucagcgggcugaaguucgccucccucacgugcaccggcugcuacgccugcagcuccggcaucagcugcaaggugcggauccacguggacgagcccgacgagcugaccguccacgugaaguccgaggacccggacaucguggccgccagcuccagccugauggcgcgcaagcucgaguucgggaccgacuccacguucaaggccuucagcgccaugcccaagaccucccugugcuucuacaucgucgagcgggaguacugcaagagcugcucccgcgaggacacccagaagugcgugagcaccaagcuggagcagccccaguccauccucaucgagcacaagggcacgaucaucgggaagcagaacaacaccugcaccaccaagacgaccugcuggcuggagagcgugaaguccuucuucuacggccugaagaacaugcucagcuccaucuucgggaacgucuucgugggcaucuucagcuuccuggcccccuucauccugcucauccuguucuucauguucggcuggcggauccuguucugcuucaagugcugccgccggacccgcgggcucuucaaguaccggcaccugaaggacgacgaggagaccggcuaccgccggaucaucgagcgccugaacaacaagaaggggaagagcaagcuccuggacggcgagcggcuggcggaccgcaagaucgccgagcucuucuccacgaagacccacaucggg

SEQ ID NO: 12275 - RNA, 2916 nt, Artificial Sequence
  derived and/or modified CDS sequence (opt1) from CCHFV(Hodzha, Artificial)__KX013448.1__Gn-4aa-Gc
agcgaggaguccggcgacgacugcaucagccgcacccagcugcuccggaccgagacggccgagauccacggggacgacuacggcgggcccggcgacaagaucaccaucugcaacggguccaccaucguggaccagcgccugggcagcgagcugggcugcuacaccaucaaccgggucaaguccuucaagcucugcgagaacagcgccacggggaaguccugcgagaucgacagcaccccggugaagugccgccagggcuacugccugaagaucacccaggaggggcggggccacgugaagcugucccgcgggagcgaggucgugcucgacgcgugcgacuccagcugcgaggugaugauccccaagggcaccggcgacauccuggucgacugcuccgggggccagcagcacuuccugaaggacaaccucaucgaccuggggugcccccggaucccccugcucggcaagauggccaucuacaucugccgcaugagcaaccacccggagacgaccauggccuuccuguucugguucuccuucggcuacgugaucacgugcauccugugcaaggccaucuucuaccuccugaucaucguggggacccugggcaagcgguucaagcaguaccgcgagcucaagccccagaccugcaccaucugcgagaccacccccgccaacgcgaucgacgccgagaugcacgaccugaacugcagcuacaacaucugccccuacugcgccucccggcugacgagcgacgggcucgcccgccacgucacccagugcccgaagcggaaggagaagguggaggagaccgagcuguaccugaaccucgagcgcauccccuggaucgugcggaagcugcugcaggucuccgagagcaccggcguggcgcucaagcgcagcuccuggcugaucgugcugcucguccuguucgccgugagccugucccccgugcagagcgcccccaucgggcggcgcccccucuuccuggacuccaucgucaagggcaagaagaaccugcucaacagcacgucccuggagaccagccuguccaucgaggcccccuggggcgccaucaacgugcagagcaccuacaagcccaccguguccacggcgaacaucgcccucagcugguccagcgucgagcaccgggggaacaagauccugguguccggccgcagcgaguccaucaugaagcuggaggagcggaccgggaucagcugggaccucggcguggaggacgccuccgagagcaagcugcugaccgucagcgugauggaccucucccagauguacagccccgucuucgaguaccuguccggggaccgccagguggaggaguggccgaaggcgaccugcacgggcgacugcagcgagcgcugcggcugcaccuccagcacgugccugcacaaggaguggccccacucccggaacuggcgcugcaaccccaccuggugcuggggcguggggaccgggugcacgugcugcggccucgacgucaaggaccuguucaccgacuacauguucgugaaguggaagguggacuacaucaagaccgaggccaucgucugcguggagcugaccagccaggagcggcagugcucccugguggaggccgggacccgcuucaaccucggccccgucaccaucacccugagcgagccgcggaacauccagcagaagcugccgcccgagaucaucacccuccacccccgcaucgaggagggcuucuucgaccugaugcacgugcagaaggugcuguccgccagcacggucugcaagcuccaguccugcacccacggggugccgggcgaccuccagguguaccacaucgggaaccugcugaagggcgacaaggucaacggccaccugauccacaagaucgagccccacuucaacaccagcuggauguccugggacgggugcgaccuggacuacuacugcaacaugggcgacuggcccagcugcaccuacacgggggugacccagcacaaccacgccuccuucgugaaccuccugaacaucgagaccgacuacaccaagagcuuccacuuccacagcaagcgggucacggcccacggcgacacgccccagcuggaccucaaggcccgcccgaccuacggggcgggcgagaucaccgugcugguggaggucgccgacauggagcugcacaccaagaagaucgagaucaccggccucaaguucgccucccugaccugcaccgggugcuacgccugcagcuccggcaucagcugcaaggugcggauccacguggacgagcccgacgagcugacgguccacgugaaguccgacgaccccgacguggucgccgcgagcuccagccucauggcccgcaagcuggaguucgggaccgacuccaccuucaaggccuucagcgccaugccgaagaccucccugugcuucuacaucguggagcgggaguacugcaagagcugcuccaaggaggacacgcagaagugcgugaacaccaagcucgagcagccccagagcauccugaucgagcagaagggcaccaucaucgggaagcagaacaacacgugcaccgcgaaggccuccugcuggcuggagagcgucaaguccuucuucuacggccucaagaacaugcugagcggcaucuucgggaacguguucgugggcaucuuccuguuccucgcccccuucauccugcugauccucuucuucauguucggguggcgcauccuguucugcuucaagugcugccggcgcacccggggccuguucaaguacaagcaccucaaggacgacgaggagaccggguaccgccggaucaucgagcgccugaacaacaagaagggcaagaacaagcugcucgacggcgagcggcuggccgaccgccgcaucgccgagcuguucuccaccaagacgcacaucggg

SEQ ID NO: 12276 - RNA, 2916 nt, Artificial Sequence
  derived and/or modified CDS sequence (opt1) from CCHFV(IbAn7620, Artificial)__KX013451.1__Gn-4aa-Gc
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggucaaguccuucaagcucugcgagaacagcgccacgggcaagaacugcgagaucgacuccgugcccgugaagugccgccagggguacugccugcggaucacccaggagggccgcgggcacgucaagcugagccggggcuccgagaucgugcucgacgcgugcgacaccagcugcgagaucaugauccccaaggggaccggcgacauccugguggacugcuccggcgggcagcagcacuuccugaaggacaaccucaucgaccugggcugccccaagaucccgcugcucgggaagauggccaucuacaucugccgcaugagcaaccaccccaagacgaccauggccuuccuguucugguucuccuucggcuacgucaucacgugcauccugugcaaggccaucuucuaccuccugaucaucaucggcacccuggggaagcggcucaagcaguaccgcgagcugaagccccagaccugcaccaucugcgagaccacccccgugaacgccaucgacgcggagaugcacgaccugaacugcagcuacaacaucugcccguacugcgccucccggcucacgagcgacggccuggcccgccacgugauccagugccccaagcggaaggagaaggucgaggagaccgagcuguaccucaaccuggagcgcauccccuggguggugcggaagcugcuccaggucuccgagagcaccgggguggcccugaagcgcuccagcuggcugaucgugcuccugguccuguucaccgugagccucucccccgugcagagcgcgccgaucggccggaagccccuguuccuggacuccaucgccaaggggaugaagaacccccucaacagcacgucccuggagaccagccuguccaucgaggcccccuggggcgccaucgacguccagagcaccuacaagccgaccguguccacggccaacaucgcgcucagcugguccagcguggagcaccgcggcaacaagauccuggucuccgggcggagcgaguccaucaugaagcuggaggagcgcaccggcaucagcugggaccucgggguggaggacgccuccgagagcaagcugcugaccguguccgucauggaccucagccagauguacagccccguguucgaguaccuguccggcgaccggcaggucgaggaguggcccaaggcgaccugcacgggggacugccccgagcgcugcggcugcaccagcuccacgugccugcacaaggaguggccgcacagccgcaacuggcggugcaaccccaccuggugcuggggcguggggaccggcugcacgugcugcgggcucgacgugaaggaccuguucaccgacuacauguucgucaaguggaagguggaguacaucaagaccgaggccaucgugugcgucgagcugaccucccaggagcgccagugcagccugaucgaggccggcacccgguucaaccucgggcccgugaccaucacccuguccgagccccgcaacauccagcagaagcugccgcccgagaucaucacccuccacccccggaucgaggagggcuucuucgaccugaugcacgugcagaagguccugagcgccuccacggugugcaagcuccagagcugcacccacggcgugcccggggaccugcaggucuaccacaucggcaaccugcucaagggggacaaggugaacggccaccugauccacaagaucgagccgcacuucaacaccuccuggaugagcugggacggcugcgaccuggacuacuacugcaacaugggggacuggcccuccugcaccuacacgggcgugacccagcacaaccacgccagcuucgucaaccuccugaacaucgagaccgacuacaccaagaacuuccacuuccacuccaagcgcgugacggcccacggggacacgccccagcuggaccucaaggcccggccgaccuacggcgccggggagaucaccgugcuggucgagguggcgaacauggagcugcacaccaagaagaucgagaucagcggccucaaguucgccucccugaccugcaccggcugcuacgccugcagcagcgggaucuccugcaaggugcgcauccacgucgacgagcccgacgagcugaccgugcacgucaagagcgacgaccccgacgugguggccgccuccagcucccucauggcgcggaagcuggaguucggcacggacagcaccuucaaggccuucuccgccaugcccaagaccagccugugcuucuacaucguggagcgcgagcacugcaaguccugcagcgaggaggacaccaagaagugcgucaacacgaagcucgagcagccgcaguccauccugaucgagcacaaggggaccaucaucggcaagcagaacagcacgugcaccgccaaggcguccugcuggcuggagagcgugaaguccuucuucuacgggcucaagaacaugcugagcggcaucuucggcaacguguucauggggaucuuccuguuccucgcccccuucauccugcugauccucuucuucauguucggcuggcggauccuguucugcuucaagugcugccgccggacccgcgggcuguucaaguaccggcaccucaaggacgacgaggagaccggcuaccgccggaucaucgagcgccugaacaacaagaaggggaagaacaagcugcucgacggcgagcggcuggccgaccgccgcaucgccgagcuguucuccaccaagacccacaucggc

SEQ ID NO: 12277 - RNA, 2916 nt, Artificial Sequence
  derived and/or modified CDS sequence (opt1) from CCHFV(K128_76, Artificial)__KX013454.1__Gn-4aa-Gc
agcgacgaguccggcgacgacugcaucagccgcacccagcugcuccggaccgagacggccgagauccacggggacaacuacggcgggcccggcgacaagaucaccaucugcaacggguccaccaucguggaccagcgccugggcagcgagcugggcugcuacaccaucaaccgggucaaguccuucaagcucugcgagaacagcgccacggggaaguccugcgagaucgacagcaucccggugaagugccgccagggcuacugccugaagaucacccaggaggggcggggccacgugaagcugucccgcgggagcgaggucgugcucgacgcgugcgacuccagcugcgaggugaugauccccaagggcaccggcgacauccuggucgacugcuccgggggccagcagcacuuccugaaggacaaccucaucgaccuggggugccccaagaucccccugcucggcaagauggccaucuacaucugccggaugagcaaccacccgaagaccacgauggccuuccuguucugguucuccuucggcuacgugaucacgugcaucgugugcaaggccaucuucuaccugcucaucaucgucgggacccugggcaagcgcuucaagcaguaccgggagcugaagccccagaccugcaccaucugcgagaccacccccaccaacgccaucgacgcggagaugcacgaccucaacugcagcuacaacaucugccccuacugcgccucccgccugacgagcgacgggcuggcccggcacgugacccacugcccgaagcgcaaggagaagguggaggagaccgagcucuaccugaaccuggagcggauccccugggucgugcgcaagcuccuccagguguccgagagcaccggcgucgcccugaagcggagcuccuggcucaucgugcugcugguccucuucgcggugagccugucccccgugcagagcgcccccaucucccgccggccgcuguuccaggacagcaucgugaaggggaugaagaaccuccugaacuccacgagccuggagaccucccucagcaucgaggcccccuggggcgccaucaacguccaguccaccuacaagcccgccgugagcgcggccaacaucgcccuguccuggagcuccguggagcaccgcggcagcaagauccuggucuccgggcggagcgaguccaucaugaagcucgaggagcgcaccggcaucagcugggaccuggggguggaggacgccagcgaguccaagcugcucacggucagcgugauggaccugucccagauguacagccccguguucgaguaccuguccggcgaccggcaggucgaggaguggccgaaggcgaccugcaccggggacugccccgagcgcugcggcugcaccagcuccacgugccuccacaaggaguggccccacagccgcaacuggcggugcaaccccaccuggugcuggggcguggggaccggcugcacgugcugcgggcuggacgugaaggaccuguucaccgacuacauguucgucaaguggaagguggaguacaucaagaccgaggccaucgugugcgucgagcucaccucccaggagcgccagugcagccugaucgaggccggcacccgguucaaccuggggccggugacgaucacccuguccgagccccgcaacauccagcagaagcucccgcccgagaucaucacccugcacccccggaucgaggagggcuucuucgaccugaugcacgugcagaagguccucagcgccuccaccgugugcaagcugcagagcugcacccacggcgugcccggggaccugcaggucuaccacaucggcaaccuccugaagggggaccgcgugaacggccaccugauccacaagaucgagccccacuucaacacguccuggaugagcugggacggcugcgaccucgacuacuacugcaacaugggggacuggcccuccugcaccuacaccggcgugacccagcacaaccacgccagcuucgucaaccugcugaacaucgagacggacuacaccaagagcuuccacuuccacuccaagcgggugaccgcccacggggacaccccgcagcucgaccugaaggcgcgccccaacuacggcgccggggagaucacggugcuggucgagguggccgacauggagcuccacaccaagaagaucgagaucagcggccugaaguucgccucccugaccugcaccggcugcuacgccugcagcuccgggaucagcugcaaggugcggauccacgucgacgagcccgacgagcucacggugcacgugaaguccgacgacccggacgucguggcggccagcuccagccugauggcccgcaagcuggaguucggcaccgacuccaccuucaaggccuucagcgcgaugcccaagaccucccucugcuucuacaucguggagcgggaguacugcaagagcugcuccaaggaggacacgcagaagugcgucaacaccaagcuggagcagccccagagcauccugaucgagcacaaggggaccaucaucggcaagcagaacaacacgugcaccgccaagaccuccugcuggcucgagagcgugaaguccuucuucuacgggcugaagaacaugcugagcggcaucuucggcaacguguucgucgggaucuuccucuuccuggcccccuucauccugcucauccuguucuucauguucggcuggcgcauccuguucugcuucaagugcugccggcgcacccggggccucuuccgcuacaagcaccuggagaacgacgaggagaccggguaccggcgcaucaucgagcggcugaacaacaagaaggggaagaacaagcuccuggacggcgagcgccuggccgaccgccggaucgccgagcuguucagcacgaagacccacaucggc

SEQ ID NO: 12278 - RNA, 2916 nt, Artificial Sequence
  derived and/or modified CDS sequence (opt1) from CCHFV(K168_40, Artificial)__KX013457.1__Gn-4aa-Gc
agcgacgaguccggcgacgacugcaucagccgcacccagcugcuccggaccgagacggccgagauccacggggacaacuacggcgggcccggcgacaagaucaccaucugcaacggguccaccaucguggaccagcgccugggcagcgagcugggcugcuacaccaucaaccgggucaaguccuucaagcucugcgagaacagcgccacggggaaguccugcgagguggacagcaucccggugaagugccgccagggcuacugccugaagaucacccaggaggggcggggccacgucaagcugucccgcgggagcgagguggugcucgacgcgugcgacuccagcugcgaggucaugauccccaagggcaccggcgacauccugguggacugcuccgggggccagcagcacuuccugaaggacaaccucaucgaccuggggugccccaagaucccccugcucggcaagauggccaucuacaucugccggaugagcaaccacccgaagaccacgauggccuuccuguucugguucuccuucggcuacgugaucaccugcaucgucugcaaggccaucuucuaccugcucaucaucguggggacccugggcaagcgcuucaagcaguaccgggagcugaagccccagaccugcacgaucugcgagaccacccccaccaacgccaucgacgcggagaugcacgaccucaacugcagcuacaacaucugccccuacugcgccucccgccugacgagcgacgggcuggcccggcacgugacccacugcccgaagcgcaaggagaaggucgaggagaccgagcucuaccugaaccuggagcggauccccuggguggugcgcaagcuccugcaggucuccgagagcaccggcguggcccugaagcggagcuccuggcucaucgugcugcugguccucuucgcggugagccugucccccgugcagagcgcccccaucgggcgccggccgcuguuccucgacggcaucgucaagggcaugaagaaccugcugaacuccacgagccucgagaccucccugagcaucgaggcccccuggggggccaucaacgugcaguccaccuacaagcccaccgugagcgccgcgaacaucgcccuguccuggagcuccgucgagcaccgcggcaacaagauccucgugagcgggcgguccgagagcaucaugaagcuggaggagcgcacgggcaucuccugggaccugggggucgaggacgccagcgaguccaagcuccugaccgugagcgugauggaccugagccagauguacucccccgucuucgaguaccucagcggcgaccggcagguggaggaguggccgaaggccaccugcaccggcgacugccccgagcgcugcgggugcacguccagcaccugccugcacaaggaguggccccacucccgcaacuggcggugcaaccccaccuggugcuggggcguggggaccggcugcacgugcugcgggcuggacgucaaggaccucuucaccgacuacauguucgugaaguggaagguggaguacaucaagaccgaggccaucgucugcguggagcugaccagccaggagcgccagugcucccugaucgaggcgggcacgcgguucaaccugggcccggugaccaucacccucagcgagccccgcaacauccagcagaagcugccccccgagaucaucacccugcacccgcggaucgaggagggguucuucgaccucaugcacguccagaaggugcuguccgccagcaccgugugcaagcugcaguccugcacgcacggcguccccggggaccuccagguguaccacaucggcaaccugcugaagggcgacaaggugaacgggcaccucauccacaagaucgagccccacuucaacaccagcuggauguccugggacggcugcgaccuggacuacuacugcaacaugggggacuggcccagcugcaccuacaccggcgucacgcagcacaaccacgccuccuucaucaaccugcucaacaucgagaccgacuacaccaagagcuuccacuuccacuccaagcgcgugaccgcccacggggacacgccgcagcuggaccugaaggcccggcccaacuacggcgcgggcgagaucaccgugcucgucgagguggccgacauggagcugcacaccaagaagaucgagaucagcgggcugaaguucgccagccucaccugcacgggcugcuacgccugcuccagcgggaucuccugcaaggugcgcauccacgucgacgagcccgacgagcugaccgugcacgugaagagcgacgacccggacgucguggccgcguccagcucccugauggcccggaagcucgaguucggcaccgacagcaccuucaaggccuucuccgccaugcccaagacgagccugugcuucuacaucguggagcgcgaguacugcaaguccugcagcaaggaggacacccagaagugcgucaacaccaagcuggagcacccccaguccauccucaucgagcacaaggggaccaucaucggcaagcagaacaacacgugcaccgcgaagaccagcugcuggcuggaguccgugaagagcuucuucuacggccugaagaacaugcucuccgggaucuucggcaacguguucgucgggaucuuccuguuccuggcccccuucauccuccugauccuguucuucauguucggcuggcggauccucuucugcuucaagugcugccgccggacccgcgggcuguuccgguacaagcaccuggaggacgacgaggagacgggcuaccgccggaucaucgagcgccucaacaacaagaagggcaagaacaagcugcuggacggggagcggcucgccgaccgccgcaucgccgagcuguucagcaccaagacccacaucggc

SEQ ID NO: 12279 - RNA, 2916 nt, Artificial Sequence
  derived and/or modified CDS sequence (opt1) from CCHFV(K168_125, Artificial)__KX013460.1__Gn-4aa-Gc
agcgacgaguccggcgacgacugcaucagccgcacccagcugcuccggaccgagacggccgagauccacggggacaacuacggcgggcccggcgacaagaucaccaucugcaacggguccaccaucguggaccagcgccugggcagcgagcugggcugcuacaccaucaaccgggucaaguccuucaagcucugcgagaacagcgccacggggaaguccugcgagguggacagcaucccggugaagugccgccagggcuacugccugaagaucacccaggaggggcggggccacgucaagcugucccgcgggagcgagguggugcucgacgcgugcgacuccagcugcgaggucaugauccccaagggcaccggcgacauccugguggacugcuccgggggccagcagcacuuccugaaggacaaccucaucgaccuggggugccccaaggugccccugcucggcaagauggccaucuacaucugccggaugagcaaccacccgaagaccacgauggccuuccuguucugguucuccuucggcuacgucaucaccugcaucgugugcaaggccaucuucuaccugcucaucaucguggggacccugggcaagcgcuucaagcaguaccgggagcugaagccccagaccugcacgaucugcgagaccacccccaccaacgccaucgacgcggagaugcacgaccucaacugcagcuacaacaucugccccuacugcgccucccgccugacgagcgacgggcuggcccggcacgucacccacugcccgaagcgcaaggagaagguggaggagaccgagcucuaccugaaccuggagcggauccccugggugguccgcaagcuccugcagguguccgagagcaccggcguggcccugaagcggagcuccuggcucaucguccugcuggugcucuucgcggugagccugucccccguccagagcgcccccaucgggcgccggccgcuguuccucgacuccaucgugaagggcaagaagaaccugcugaacagcacgucccucgagaccagccuguccaucgaggcccccuggggcgccaucaacgugcagagcaccuacaagcccaccgucuccgccgcgaacaucgcccugagcugguccagcguggagcaccgcgggaacaagauccucgucuccggccggagcgaguccaucaugaagcuggaggagcgcacggggaucagcugggaccugggcguggaggacgccuccgagagcaagcuccugaccgugagcgucauggaccugucccagauguacagccccguguucgaguaccucuccggggaccggcagguggaggaguggccgaaggccaccugcaccggcgacugccccgagcgcugcggcugcacgagcuccaccugccugcacaaggaguggccccacagccgcaacuggcggugcaaccccaccuggugcuggggggucggcaccgggugcacgugcugcggccuggacgugaaggaccucuucaccgacuacauguucgugaaguggaaggucgaguacaucaagaccgaggccaucgugugcguggagcugaccucccaggagcgccagugcagccugaucgaggcggggacgcgguucaaccugggcccggucaccaucacccucuccgagccccgcaacauccagcagaagcugccccccgagaucaucacccugcacccgcggaucgaggagggcuucuucgaccucaugcacgugcagaaggugcugagcgccuccaccgucugcaagcugcagagcugcacgcacggggugcccggcgaccuccagguguaccacaucgggaaccugcugaagggcgacaaggucaacggccaccucauccacaagaucgagccccacuucaacaccuccuggaugagcugggacgggugcgaccuggacuacuacugcaacaugggcgacuggcccuccugcaccuacaccggggugacgcagcacaaccacgccagcuucaucaaccugcucaacaucgagaccgacuacaccaaguccuuccacuuccacagcaagcgcgugaccgcccacggcgacacgccgcagcuggaccugaaggcccggcccaacuacggggcgggcgagaucaccguccucguggagguggccgacauggagcugcacaccaagaagaucgagaucagcggccugaaguucgccucccucaccugcacggggugcuacgccugcagcuccggcaucagcugcaagguccgcauccacguggacgagcccgacgagcugaccgugcacgucaaguccgacgacccggacgugguggccgcgagcuccagccugauggcccggaagcucgaguucgggaccgacuccaccuucaaggccuucagcgccaugcccaagacgucccugugcuucuacaucgucgagcgcgaguacugcaagagcugcuccaaggaggacacccagaagugcgugaacaccaagcuggagcacccccagagcauccucaucgagcacaagggcaccaucaucgggaagcagaacaacacgugcaccgcgaagaccuccugcuggcuggagagcgugaaguccuucuucuacggccugaagaacaugcucagcggcaucuucgggaacgucuucgugggcaucuuccuguuccuggcccccuucauccuccugauccuguucuucauguucggguggcggauccucuucugcuucaagugcugccgccggacccgcggccuguuccgguacaagcaccuggaggacgacgaggagacgggguaccgccggaucaucgagcgccucaacaacaagaagggcaagaacaagcugcuggacggcgagcggcucgccgaccgccgcaucgccgagcuguucuccaccaagacccacaucggg

SEQ ID NO: 12280 - RNA, 2916 nt, Artificial Sequence
  derived and/or modified CDS sequence (opt1) from CCHFV(K229_194, Artificial)__KX013463.1__Gn-4aa-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaagggcaaccucaucgaccuggggugcccccacaucccgcugcucggcaagauggccaucuacaucugccgcaugagcaaccacccccggaccaccauggccuuccuguucugguucuccuucggcuacgucaucacgugcaucuucugcaaggcccuguucuacagccucaucaucaucgggacccugggcaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacgggcuggcccgccacgugacccagugccccaagcggaaggagaaggucgaggagaccgagcucuaccugaaccuggagcgcauccccuggaucgugcggaagcuccuccaggugagcgaguccaccggcgucgcgcugaagcgcagcagcuggcucaucgugcugcuggugcuccugacggucucccugagccccgugcaguccgccccgguggggcggaagccccucuuccuggacagcaucgucaagggcaagaagaaccugcucaacuccaccagccuggagaccucccugagcaucgaggcccccuggggcgccaucaacgugcaguccaccuucaagcccacggugagcaccgccaacaucgcgcucuccuggagcuccgucgagcaccgcgggaacaagauccuggugaccggccggagcgaguccaucaugaagcuggaggagcgcaccggggugagcugggaccucggcgucgaggacgccuccgagagcaagcugcugacgguguccaucauggaccucagccagauguacagcccggucuucgaguaccuguccggggaccgccagguggaggaguggcccaaggcgaccugcaccggcgacugccccgagcggugcggcugcaccagcuccacgugccugcacaaggaguggccccacagccggaacuggcgcugcaacccgaccuggugcuggggcguggggaccgggugcacgugcugcggcgucgacgugaaggaccucuucaccgaccacauguucaucaaguggaagguggaguacaucaagaccgaggccaucgucugcguggagcugaccucccaggagcgccagugcagccugaucgaggccgggacccgguucaaccugggccccgugaccaucacgcucuccgagccccgcaacauccagcagaagcugcccccggagaucaucacccugcaccccaagaucgaggagggcuucuucgaccucaugcacguccagaaggugcugagcgccuccaccgugugcaagcugcagagcugcacccacgggauccccggcgaccuccagaucuaccacaucgggaaccugcugaagggcgaccggcucaacggccaccugauccacaagaucgagccccacuucaacacguccuggaugagcugggacgggugcgaccuggacuacuacugcaacaugggcgacuggccguccugcaccuacaccggggucacccagcacaaccacgccgccuucgugaaccuccugaacaucgagacggacuacaccaagaccuuccacuuccacagcaagcgcgugaccgcccacggcgacacgccccagcuggaccucaaggcccggcccaccuacggggcgggcgagaucaccguccugguggagguggccgacauggagcugcacaccaagaaggucgagaucuccggccucaaguucgccagccuggccugcacggggugcuacuccugcagcagcggcaucuccugcaaggugcgcauccacguggacgagccggacgagcugaccguccacgucaagagcuccgaccccgacgugguggccgcgagcaccucccucauggcccggaagcuggaguucgggaccgacagcacguucaaggccuucuccgccaugcccaagaccagccugugcuucuacaucguggagcgcgaguacugcaaguccugcagcgaggacgacaccaagaagugcguggacaccaagcucgagcagccccaguccauccugaucgagcacaagggcacgaucaucgggaagcagaacgacacgugcaccgcgaaggccagcugcuggcuggaguccgucaagagcuucuucuacggccucaagaacaugcugggcuccguguucgggaacuucuucgugggcauccuccuguuccuggccccguucguccugcucgugcuguucuucauguucggguggaagauccuguucugcuucaagugcugccggcgcacccggggccucuucaaguaccgccaccugaaggacgacgaggagaccggguaccggaagaucaucgagcgccugaacagcaagaagggcaagaaccggcuccuggacggcgagcgccuggccgaccggaagaucgccgagcuguucuccaccaagacccacaucggg

SEQ ID NO: 12281 - RNA, 2916 nt, Artificial Sequence
  derived and/or modified CDS sequence (opt1) from CCHFV(K229_243, Artificial)__KX013466.1__Gn-4aa-Gc
agcgaggagcccggcgacgacugcaucucccgcacccagcuccuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugaccgugucccugagcccggugcaguccgcccccgucggccgcaagccccucuuccuggacagcaucgugaaggggaugaagaaccugcucaacuccacgagccuggagaccucccugagcaucgaggcccccuggggcgccaucaacgugcaguccaccuucaagccgaccgucagcacggccaacaucgcgcucuccuggagcuccguggagcaccggggcaacaagauccuggugaccgggcgcagcgaguccaucaugaagcuggaggagcggaccggcgucagcugggaccucgggguggaggacgccuccgagagcaagcugcugaccgucuccaucauggaccucagccagauguacagccccguguucgaguaccuguccggcgaccgccagguggaggaguggcccaaggccacgugcaccggggacugccccgagcggugcggcugcaccagcuccacgugccugcacaaggaguggccgcacagccgcaacuggcgcugcaaccccaccuggugcuggggcgucgggaccggcugcacgugcugcgggguggacgugaaggaccucuucaccgaccacauguucgucaaguggaagguggaguacaucaagaccgaggccaucgugugcgucgagcugaccucccaggagcggcagugcagccugaucgaggccggcacccgcuucaaccuggggcccgugaccaucacccucuccgagccccggaacauccagcagaagcugccgcccgagaucaucacgcugcaccccaagguggaggagggcuucuucgaccucaugcacguccagaaggugcugagcgcguccaccgugugcaagcugcagagcugcacccacggcauccccggggaccuccaggucuaccacaucggcaaccugcugaagggggaccgcgugaacggccaccucauccacaagaucgagccgcacuucaacaccuccuggaugagcugggacggcugcgaccuggacuacuacugcaacaugggggacuggcccuccugcacguacaccggcgugacccagcacaaccacgccgccuucgucaaccugcucaacaucgagaccgacuacacgaagaccuuccacuuccacagcaagcgggugaccgcccacggggacacgccccagcuggaccugaaggcccgcccgaccuacggcgcgggggagaucaccgugcucgucgagguggccgacauggagcugcacaccaagaagguggagaucuccggccugaaguucgccagccucgccugcaccggcugcuacgccugcuccagcgggaucagcugcaagguccggauccacguggacgagcccgacgagcugacggugcacgucaaguccagcgaccccgacgugguggcggccuccaccagccugauggcccgcaagcucgaguucggcaccgacuccaccuucaaggccuucagcgcgaugcccaagacgucccugugcuucuacaucgucgagaaggaguacugcaagagcugcuccgaggaggacacccagaagugcguggacaccaagcuggagcagccgcagagcauccucaucgagcacaaggggaccaucaucggcaagcagaacgacacgugcaccgccaaggccuccugcuggcuggagagcgugaaguccuucuucuacgggcugaagaacaugcucggcagcgucuucggcaacuucuucaucgggauccugcuguuccucacccccuucgugcugcuggugcuguucuucauguucggcuggaagauccucuucugcuucaagugcugccggcgcacccgggggcugcucaaguaccgccaccugaaggacgacgaggagacgggcuaccggcgcaucaucgagcggcugaacaacaagaaggggaagaaccgccuccuggacggcgagcggcuggccgaccgcaagaucgccgagcuguucuccaccaagacccacaucggc

SEQ ID NO: 12282 - RNA, 2916 nt, Artificial Sequence
  derived and/or modified CDS sequence (opt1) from CCHFV(K315_14, Artificial)__KX013469.1__Gn-4aa-Gc
agcgaggagcccggcgacgacugcaucucccgcacccagcugcucaagaccgagacggccgagauccacgacgacaacuacgggggcccgggggacaagaucaccaucugcaacggcagcaccguggucgaccagcggcugggguccgagcugggcugcuacaccaucaaccgcgucaagagcuucaagcucugcaagaacuccgccacgggcaagaccugcgagaucgacagcacccccgugaagugccggcagggguucugccugaagaucacccaggagggccgcgggcacgugaagcugucccggggcagcgagguggugcucgacgucugcgacuccagcugcgagaucaugauccccaaggggacgggcgacauccugguggacugcuccggcgggcagcagcacuuccugaaggacaaccucaucgaccugggcugcccccacaucccgcugcucgggaagauggcgaucuacaucugccgcaugagcaaccacccccggaccaccauggccuuccuguucugguucuccuucggcuacgugaucacgugcaucuucugcaaggcccuguucuacagccucaucaucaucggcacccuggggaagaagaucaagcaguaccgcgagcugaagccccagaccugcaccaucugcgagaccgcccccgucaacgccaucgacgcggagaugcacgaccucaacugcuccuacaacaucugcccguacugcgccagccggcugacguccgagggccuggcccgccacgugacccagugccccaagcggaaggagaagguggaggagaccgagcucuaccugaaccuggagcgcauccccuggaucguccggaagcuccuccaggugagcgaguccaccgggguggcccugaagcgcagcagcuggcucaucguccugcuggugcuccugacggugucccugagccccguccaguccgcgccggugggccggaagccccucuuccuggacagcaucgugaaggggaugaagaagcugcucaacuccaccagccuggagaccucccugagcaucgaggcccccuggggcgccaucaacguccaguccaccuucaagcccacggugagcaccgccaacaucgcccucuccuggagcuccguggagcaccgcggcaacaagauccuggucaccgggcggagcgaguccaucaugaagcuggaggagcgcaccggcgugagcugggaccucggggucgaggacgcguccgagagcaagcugcugacgguguccaucauggaccucagccagauguacagcccgguguucgaguaccuguccggcgaccggcaggucgaggaguggcccaaggcgaccugcaccggggacugccccgagcgcugcggcugcaccagcuccacgugccugcacaaggaguggccccacagccggaacuggcgcugcaacccgaccuggugcuggggcguggggaccggcugcacgugcugcgggguggacgucaaggaccucuucaccgaccacauguucaucaaguggaagguggaguacaucaagaccgaggccaucgugugcgucgagcugaccucccaggagcgccagugcagccugaucgaggccggcacccgguucaaccuggggcccgugaccaucacgcucuccgagccccgcaacauccagcagaagcugcccccggagaucaucacccugcaccccaagaucgaggagggcuucuucgaccucaugcacgugcagaagguccugagcgccuccaccgugugcaagcugcagagcugcacccacggcauccccggggaccuccagaucuaccacaucggcaaccugcugaagggggaccgggugaacggccaccucauccacaagaucgagccccacuucaacacguccuggaugagcugggacggcugcgaccuggacuacuacugcaacaugggggacuggccguccugcaccuacaccggcgucacccagcacaaccacgccgccuucgugaaccugcucaacaucgagacggacuacaccaagaccuuccacuuccacagcaagcgcgugaccgcccacggggacacgccccagcuggaccugaaggcccggcccaccuacggcgccggggagaucaccguccucguggagguggcggacauggagcugcacaccaagaaggucgagaucuccggccugaaguucgccagccucacgugcaccggcugcuacgccugcuccagcgggaucagcugcaaggugcgcauccacguggacgagccggacgagcugaccguccacgugaaguccagcgaccccgacguggucgccgccuccaccagccugauggcgcggaagcucgaguucggcacggacuccaccuucaaggccuucagcgccaugcccaagaccucccugugcuucuacaucguggagcgcgaguacugcaagagcugcuccgaggacgacaccaagaagugcguggacacgaagcuggagcagccccagagcauccucaucgagcacaaggggaccaucaucggcaagcagaacgacacgugcaccgccaaggcguccugcuggcuggagagcgucaaguccuucuucuacgggcugaagaacaugcucggcagcguguucggcuccuucuucguggggauccugcuguuccucgccccguucguccugcuggugcuguucuucauguucggcuggaagauccuguucugcuucaagugcugccggcgcacccgggggcuguucaaguaccgccaccucaaggacgacgaggagaccggcuaccggcgcaucaucgagcggcugaacagcaagaaggggaagaaccgccugcucgacggcgagcggcuggccgaccgcaagaucgccgagcuguucuccaccaagacccacaucggc

SEQ ID NO: 12283 - RNA, 2916 nt, Artificial Sequence
  derived and/or modified CDS sequence (opt1) from CCHFV(K323_27, Artificial)__KX013472.1__Gn-4aa-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucaccugcaucuucugcaaggcccuguucuaccuccugaucaucaucggcacgcuggggaagaagaucaagcaguaccgcgagcucaagccccagaccugcaccaucugcgagaccgcccccgugaacgcgaucgacgccgagaugcacgaccugaacugcagcuacaacaucugcccguacugcgccucccggcugacgagcgacggccucgcccgccacgugacccagugccccaagcggaaggagaaggucgaggagaccgagcuguaccugaaccucgagcgcauccccuggaucgugcggaagcugcugcagguguccgagagcaccggggucgcgcucaagcgcuccagcuggcugacggugcugcucgugcugcugaccgucagccucucccccgugcagagcgccccggugggccggaagccccuguuccuggacuccaucgccaaggggaugaagaaccuccugaacagcaccucccuggagaccagccucuccaucgaggcccccuggggcgccaucaacguccagagcacguucaagcccaccguguccaccgcgaacaucgcccugagcugguccagcguggagcaccgcggcaacaagauccuggucaccgggcgguccgagagcaucaugaagcucgaggagcgcacgggcguguccugggaccuggggguggaggacgccagcgaguccaagcugcucaccgucagcaucauggaccugucccagauguacagcccgguguucgaguaccugagcggcgaccggcaggucgaggaguggcccaaggccaccugcaccggggacugccccgagcgcugcggcugcacguccagcaccugccuccacaaggaguggccccacucccggaacuggcgcugcaacccgaccuggugcuggggcguggggaccggcugcacgugcugcgggguggacgucaaggaccuguucaccgaccacauguucaucaaguggaagguggaguacaucaagaccgaggccaucgugugcgucgagcugaccggccaggagcgccagugcagccugaucgaggcggggacccgguucaaccucggccccgugacgaucacccuguccgagccccgcaacauccagcagaagcugcccccggagaucaucacccuccaccccaagaucgaggagggcuucuucgaccugaugcacgugcagaagguccugagcgccuccaccgugugcaagcuccagagcugcacgcacgggauccccggcgaccugcagaucuaccacaucgggaaccugcucaagggcgaccgggugaacggccaccugauccacaagaucgagccccacuucaacaccuccuggaugagcugggacgggugcgaccuggacuacuacugcaacaugggcgacuggccguccugcaccuacaccggggucacgcagcacaaccacgccgccuucgugaaccuccugaacaucgagaccgacuacaccaagaccuuccacuuccacagcaagcgcgugacggcccacggcgacaccccccagcuggaccucaaggcgcggcccaccuacggggccggcgagaucaccguccugguggagguggccgacauggagcugcacacgaagaaggucgagaucuccggccucaaguucgccagccugaccugcaccgggugcuacgccugcuccagcggcaucuccugcaaggugcgcauccacguggacgagccggacgagcugaccguccacgugaagagcagcgaccccgacguggucgcggccuccacgagccucauggcccggaagcuggaguucgggaccgacuccaccuucaaggccuucagcgcgaugcccaagaccucccugugcuucuacaucguggagcgcgaguacugcaagagcugcuccgaggacgacacgaagaagugcguggacaccaagcucgagcagccccagagcauccugaucgagcacaagggcaccaucaucgggaagcagaacgacaccugcacggccaaggccuccugcuggcuggagagcgucaaguccuucuucuacggccucaagaacaugcugggcagcguguucggguccuucuucgugggcauccugcucuuccuggccccguucguccugcucgugcuguucuucauguucggguggaagauccuguucugcuucaagugcugccggcgcacccggggccucuucaaguaccgccaccugaacgacgacgaggagaccggguaccggcgcaucaucgagcggcugaacagcaagaagggcaagaaccgccuccuggacggcgagcggcuggccgaccgcaagaucgcggagcucuucuccaccaagacgcacaucggg

SEQ ID NO: 12284 - RNA, 2916 nt, Artificial Sequence
  derived and/or modified CDS sequence (opt1) from CCHFV(K340_6, Artificial)__KX013475.1__Gn-4aa-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccacgaccggcaagaccugcgagaucgacagcacccccgugaagugccggcagggguucugccugaagaucacgcaggagggccgcgggcacgugaagcugucccggggcagcgaggucgugcucgacgccugcgacuccagcugcgagaucaugauccccaaggggaccggcgacauccugguggacugcuccggcgggcagcagcacuuccugaaggacaaccucaucgaccugggcugcccccacaucccgccccuggggaagauggcgaucuacaucugccgcaugagcaaccacccccggaccaccauggccuuccucuucugguucuccuucggcuacgucaucacgugcaucuucugcaaggcccuguucuacagccugaucaucaucggcacccucgggaagaagaucaagcaguaccgcgagcugaagccccagaccugcaccaucugcgagacggccccggugaacgccaucgacgcggagaugcacgaccugaacugcuccuacaacaucugccccuacugcgccagccggcucaccuccgacggccuggcccgccacgugacccagugccccaagcggaaggagaaggucgaggagaccgagcuguaccucaaccuggagcgcauccccuggaucgugcggaagcugcuccaggugagcgaguccacgggggucgcccugaagcgcagcagcuggcugaucgugcuccuggugcugcucaccgucucccugagcccggugcaguccgcgcccgugggccggaagccccugagccucgacuccaucgucaaggggaugaagaaccugcugaacagcaccucccucgagaccagccuguccaucgaggcccccuggggcgccaucaacgugcagagcacguucaagccgaccguguccaccgccaacaucgcccugagcugguccagcgucgagcaccgcggcaacaagauccucgugaccgggcgguccgagagcaucaugaagcuggaggagcgcacgggcguguccugggaccugggggucgaggacgcgagcgaguccaagcuccugaccgugagcaucauggaccugagccagauguacucccccgucuucgaguaccucagcggcgaccggcagguggaggaguggcccaaggccaccugcaccggggacugccccgagcgcugcggcugcacguccagcaccugccugcacaaggaguggccgcacucccggaacuggcgcugcaaccccaccuggugcuggggcguggggaccggcugcacgugcugcggggucgacgugaaggaccuguucaccgaccacauguucaucaaguggaagguggaguacaucaagaccgaggccaucgucugcguggagcucaccagccaggagcgccagugcucccugaucgaggccggcacccgguucaaccuggggcccgugacgaucacccugagcgagccccgcaacauccagcagaagcucccgcccgagaucaucacccugcaccccaagaucgaggagggcuucuucgaccugaugcacguccagaaggugcucuccgccagcaccgugugcaagcugcaguccugcacgcacggcauccccggggaccugcagaucuaccacaucggcaaccuccugaagggggaccgggucaacggccaccugauccacaagaucgagccgcacuucaacaccagcuggauguccugggacggcugcgaccucgacuacuacugcaacaugggggacuggcccagcugcaccuacaccggcgugacgcagcacaaccacgcggccuucgugaaccugcugaacaucgagaccgacuacaccaagaccuuccacuuccacuccaagcgcgucacggcccacggggacaccccccagcucgaccugaaggcccggccgaccuacggcgccggggagaucaccgugcugguggaggucacggacauggagcuccacaccaagaagguggagaucagcggccugaaguucgcgucccugaccugcaccggcugcuacgccugcagcagcgggaucuccugcaaggugcgcauccacgucgacgagcccgacgagcucacggugcacgugaagagcuccgaccccgacgucguggccgccagcaccucccugauggcccggaagcuggaguucggcaccgacagcaccuucaaggcguucuccgccaugcccaagacgagccucugcuucuacaucguggagcgcgaguacugcaaguccugcagcgaggacgacaccaagaagugcgucgacaccaagcuggagcagccgcaguccauccugaucgagcacaaggggaccaucaucggcaagcagaacgacacgugcaccgccaaggccagcugcuggcucgaguccgugaagagcuucuucuacgggcugaagaacaugcugggcuccguguucggcagcuucuucgucgggauccuccuguuccuggcgcccuucgugcuccuggugcuguucuucauguucggcuggaagauccucuucugcuucaagugcugccggcgcacccgggggcuguucaaguaccgccacuucaaggacgacgaggagaccggcuaccggcgcaucaucgagcggcugaacuccaagaaggggaagaaccgccuccuggacggcgagcggcuggccgaccgcaagaucgccgagcucuucagcacgaagacccacaucggc

SEQ ID NO: 12285 - RNA, 2916 nt, Artificial Sequence
  derived and/or modified CDS sequence (opt1) from CCHFV(Mamon, Artificial)__KX013478.1__Gn-4aa-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucguguccgacgcgugcgacagcuccugcgaggugaugauccccaaggggacgggcgacauccucgucgacugcagcggcgggcagcagcacuuccugaaggacaaccugaucgaccucggcugcccccacaucccgcugcuggggaagauggccaucuacaucugccggauguccaaccacccccgcaccaccguggccuuccucuucugguucagcuucggcuacgugaucacgugcaucuucugcaaggcccuguucuacucccugaucaucaucggcacccucgggaagaagaucaagcaguaccgggagcugaagccccagaccugcaccaucugcgagaccgcccccgucaacgcgaucgacgccgagaugcacgaccugaacugcagcuacaacaucugcccguacugcgccucccgccucacgagcgacggccuggcccggcacgugccccagugccccaagcgcaaggagaagguggaggagaccgagcuguaccucaaccuggagcggauccccuggaucguccgcaagcugcuccagguguccgagagcaccgggguggcgcugaagcggagcuccuggcugaucguccuccuggugcugcucaccgugagccuguccccgguccagagcgcccccgugggccgcaagccccuguuccucgacuccaucgugaaggggaugaagaaccugcugaacagcacgucccucgagaccagccuguccaucgaggcccccuggggcgccaucaacguccagagcaccuucaagccgaccguguccacggccaacaucgcgcugagcugguccagcguggagcaccggggcaacaagauccucgucaccgggcgcuccgagagcaucaugaagcuggaggagcggaccggcguguccugggaccugggggucgaggacgccagcgaguccaagcuccugaccgugagcaucauggaccugagccagauguacucccccguguucgaguaccucagcggcgaccgccaggucgaggaguggcccaaggccacgugcaccggggacugccccgagcggugcggcugcaccuccagcacgugccugcacaaggaguggccgcacucccgcaacuggcgcugcaaccccaccuggugcuggggcguggggaccggcugcacgugcugcgggguggacgucaaggaccuguucaccgaccacauguucgugaaguggaagguggaguacaucaagaccgaggccaucgucugcguggagcucaccagccaggagcggcagugcucccugaucgaggccggcacccgcuucaaccuggggcccgugaccaucacccugagcgagccccggaacauccagcagaagcucccgcccgagaucaucacgcugcaccccaaggucgaggagggcuucuucgaccugaugcacgugcagaaggugcucuccgcgagcaccgucugcaagcugcaguccugcacccacggcauccccggggaccuccagguguaccacaucggcaaccugcugaagggggaccgcgugaacggccaccugauccacaagaucgagccgcacuucaacaccagcuggauguccugggacggcugcgaccucgacuacuacugcaacaugggggacuggcccagcugcacguacaccggcgucacccagcacaaccacgccgccuucgugaaccugcugaacaucgagaccgacuacacgaagaccuuccacuuccacuccaagcgggugaccgcccacggggacacgccccagcucgaccugaaggcccgcccgaccuacggcgcgggggagaucaccguccugguggagguggccgacauggagcuccacaccaagaaggucgagaucagcggccugaaguucgccucccuggccugcaccggcugcuacgccugcagcagcgggaucuccugcaaggugcggauccacguggacgagcccgacgagcucacgguccacgucaagagcuccgaccccgacgugguggcggccagcaccucccugauggcccgcaagcuggaguucggcaccgacagcaccuucaaggccuucuccgcgaugcccaagacgagccucugcuucuacaucguggagcgggaguacugcaaguccugcagcgaggaggacacccagaagugcguggacaccaagcuggagcagccgcaguccauccugaucgagcacaaggggaccaucaucggcaagcagaacgacacgugcaccgccaagaccagcugcuggcucgaguccgucaagagcuucuucuacgggcugaagaacaugcugggcuccguguucggcaacuucuucaucgggauccuccuguuccuggcccccuucgugcuccugguccuguucuucauguucggcuggaagauccucuucugcuucaagugcugccgccggacccgcgggcugcugaaguaccggcaccucaaggacgacgaggagacgggcuaccgccggaucaucgagcgccugaacaacaagaaggggaagaaccggcugcucgacggcgagcgccuggccgaccggaagaucgccgagcuguucagcaccaagacccacaucggc

SEQ ID NO: 12286 - RNA, 2916 nt, Artificial Sequence
  derived and/or modified CDS sequence (opt1) from CCHFV(Min, Artificial)__KX013481.1__Gn-4aa-Gc
agcgaggagcccggcgacgacugcaucucccgcacccagcuccuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugaccgugucccugagcccggugcaguccgcccccgucggccgcaagccccucuuccuggacagcaucgugaaggggacgaagaaccugcucaacuccaccagccuggagaccucccugagcaucgaggcccccuggggcgccaucaacgugcaguccaccuucaagccgacggucagcaccgccaacaucgcgcucuccuggagcuccguggagcaccggggcaacaagauccuggugaccgggcgcagcgaguccaucaugaagcuggaggagcggaccggcgucagcugggaccucgggguggaggacgccuccgagagcaagcugcugacggucuccaucauggaccucagccagauguacagccccguguucgaguaccuguccggcgaccgccagguggaggaguggcccaaggcgaccugcaccggggacugccccgagcggugcggcugcaccagcuccacgugccugcacaaggaguggccgcacagccgcaacuggcgcugcaaccccaccuggugcuggggcgucgggaccggcugcacgugcugcgggguggacgugaaggaccucuucaccgaccacauguucgucaaguggaagguggaguacaucaagaccgaggccaucgugugcgucgagcugaccucccaggagcggcagugcagccugaucgaggccggcacccgcuucaaccuggggcccgugaccaucacgcucuccgagccccggaacauccagcagaagcugccgcccgagaucaucacccugcaccccaagguggaggagggcuucuucgaccucaugcacguccagaaggugcugagcgccuccaccgugugcaagcugcagagcugcacccacggcauccccggggaccuccaggucuaccacaucggcaaccugcugaagggggaccgcaucaacggccaccucauccacaagaucgagccgcacuucaacacguccuggaugagcugggacggcugcgaccuggacuacuacugcaacaugggggacuggcccuccugcaccuacaccggcgugacccagcacaaccacgccgccuucgugaaccugcucaacaucgagacggacuacaccaagaccuuccacuuccacagcaagcgggucaccgcccacggggacacgccccagcuggaccugaaggcccgcccgaccuacggcgcgggggagaucaccgugcucguggaggucgccgacauggagcugcacaccaagaagguggagaucuccggccugaaguucgccagccucgccugcacgggcugcuacgccugcuccagcgggaucagcugcaaggugcggauccacgucgacgagcccgacgagcugaccgugcacgugaaguccagcgaccccgacgucguggcggccuccaccagccugauggcccgcaagcucgaguucggcaccgacuccacguucaaggccuucagcgcgaugcccaagaccucccugugcuucuacaucguggagcgggaguacugcaagagcugcuccgaggaggacacccagaagugcgucgacaccaagcuggagcagccgcagagcauccucaucgagcacaaggggacgaucaucggcaagcagaacgacacgugcaccgccaaggccuccugcuggcuggagagcgugaaguccuucuucuacgggcugaagaacaugcucggcagcguguucggcaacuucuucaucgggauccugcuguuccucgcccccuucguccugcuggugcuguucuucauguucggcuggaagauccucuucugcuucaagugcugccgccggacccgcgggcugcucaaguaccggcaccugaaggacgacgaggagaccggcuaccgccggaucaucgagcgccugaacaacaagaaggggaagaaccggcuccuggacggcgagcgccuggccgaccggaagaucgcggagcuguucuccaccaagacccacaucggc

SEQ ID NO: 12287 - RNA, 2916 nt, Artificial Sequence
  derived and/or modified CDS sequence (opt1) from CCHFV(Nakiwogo, Artificial)__KX013484.1__Gn-4aa-Gc
gccgagggcgugagcaacgacugcgugucccgcacccagcugaucaagaccgagguggccgagauccacgaggacagcuacgggggccccggggagaagaucacgaucugcaacggcuccaccaucguggaccagcggcucgggagcgagcugggcugcuacaccaucaaccgcgucaagaccuacaagcugugcgagaacuccgcgacggagaagggcugcgagaucgacagcgugccggugaagugcaagcagggguucugccucaaggucacccaggagggccgggggcacgugaagcugucccgcggcaccgagaucgugcuggacgucugcgacaccagcugcgagcucaugauccccaaggggacgggcgacauccugguggacugcuccggcgggcagcagcacuuccugcaggacaaccucaucgaccugggcugccccaacgugccccugcucgggaagauggccaucuacaucugccggaugagcaaccacccgaagaccaccauggccuuccuguucugguucuccuucggcuacgucaucacgugcguggugugcaagguccuguucuaccuccugaucgugaucggcacccuggggaagaagcucaagcaguaccgcgagcugaagccccagaccugcaucgugugcgagagcauccccgucaacgugaucgacgccgagaugcacgagcugaacugcaacuacaacaucugccccuacugcgccucccggcucaccagcgacggccuggugcgccacgucacccagugcccgaagcggaaggagaagguggaggagacggagcuguaccucaaccuggagcgcauccccuggcuggugcggcgccuccugcaggucuccgagagcaccgggauggcgcugaagcgguccugcuggaugaccacccuccugauccugcucguggucagccugucccccgugcagagcgcccccgugggccgcaagccgcuguaccucgacagcaucgccaaggggaugaagucccugcugaacagcacgaaccucgagaccucccugagcaucgaggcccccuggggcgcgaucaacguccaguccaccuucaagcccaccgugagcgccgccaacaucgcccuguccuggagcuccguggagcaccggggcaacaagauccucgucagcgggcgcuccgagagcaucaugaagcuggaggagcggacgggcaucuccuggagccuggggguggaggacgccuccgagagcaagacccucaccguguccgucauggaccugagccagauguacucccccguguucgaguaccugagcggcgaccgccagguggaggaguggccgaaggcgaccugcacgggggacugccccgagcggugcggcugcaccagcuccacgugccuccacaaggaguggccccacagccgcaacuggcggugcaaccccaccuggugcuggggcgucgggaccggcugcacgugcugcgggcuggacgugcgcgaccuguucaccgacuacaugauggugaaguggaaggucgaguacgugaagaccgaggccaucaugugcguggagcugaccucccaggagcgccagugcagccucaucgaggccggcacccgguucaaccuggggccggucaccaucacccuguccgagccccgcaacgugcagcagcggcuccccagcgagaucgugacccugcaccccaagaucgaggagggcuucuucgaccugaugcacguccagaaggugcuguucugcaagcacucccuccaggccacgagcugcacccacggcgugccgggggaccugcaggucuaccacgugggcaaccuccugaagggggacaaggugaacggccacuccauccacaagaucgagagccacuucaacaccuccuggaugagcugggacggcugcgaccuggacuacuucugcaacaugggggacuggcccuccugcaccuacacgggcgucacccagcacaaccgcgccgcguucgugaacaugcucaacaucgagaccgacuacaccaagacguuccacuuccacagcaagcgggugaccgcccacggggacacgccccagcuggaccugaaggcccgccccaccuacggcgccggggaggucaccgugcucguggaggucgccgaccuggagcugcacaccaagaagaucgagguguccggccucaaguucgcgagccugaccugcuccggcugcuacgccugcagcagcgggaucuccugcaaggugcggauccacgucaacgagccggacgaguucaccgugcacgucaagagcaacgaccccgacgugguggccgccggcuccagccugauggcccgcaagaucgagcucggggcggacuccacguucaaggccuucagcuccaugcccaagaacagccugugcuucuacaucguggagcgggacuacugcuccagcugcaccgacgacgacacccagaagugcgucaacaccaagcuggagcacccgcaguccauccucaucgagcacaagggcacgaucaucgggaagcagaacgacacgugccccaccaagaccagcugcuggcuggaguccgucaagagcuucuucuacggccugaagaacaugcucggcgggaucuucggcaacguguuccuggggaucuuccuguuccucgcccccuucgcccugcugauccucuucuucuucuucggcuggcgccugcuguucugccucaagugcugccggcgcacccgggggcugcugaaguacaagcagcucaaggacgaggaggaggcgggcuacaagaagaucaucgagcgccugaacgacaagaagggcaagucccggcuguucgacggggagcgccucgccgaccggaagaucgccgagcuguucagcaccaagacccacaucggc

SEQ ID NO: 12288 - RNA, 2916 nt, Artificial Sequence
  derived and/or modified CDS sequence (opt1) from CCHFV(Saf, Artificial)__KX013487.1__Gn-4aa-Gc
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuaccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugaccgugucccugagcccggugcaguccgcccccgucggccgcaagccccucuucagcgacuccaucgugaaggggaugaagaaccugcugaacagcacgucccucgagaccagccuguccaucgaggcccccuggggcgccaucaacgugcagagcaccuucaagccgaccgucuccacggccaacaucgcgcugagcugguccagcguggagcaccggggcaacaagauccucgugaccgggcgcuccgagagcaucaugaagcuggaggagcggaccggcgucuccugggaccuggggguggaggacgccagcgaguccaagcuccugaccgucagcaucauggaccugagccagauguacucccccguguucgaguaccucagcggcgaccgccagguggaggaguggcccaaggccacgugcaccggggacugccccgagcggugcggcugcaccuccagcacgugccugcacaaggaguggccgcacucccgcaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcucaccagccaggagcggcagugcucccugaucgaggccggcacccgcuucaaccuggggcccgugaccaucacccugagcgagccccggaacauccagcagaagcucccgcccgagaucaucacgcugcaccccaagguggaggagggcuucuucgaccugaugcacguccagaaggugcucuccgcgagcaccgugugcaagcugcaguccugcacccacggcauccccggggaccugcaggucuaccacaucggcaaccuccugaagggggaccgcgugaacggccaccugauccacaagaucgagccgcacuucaacaccagcuggauguccugggacggcugcgaccucgacuacuacugcaacaugggggacuggcccagcugcacguacaccggcgugacccagcacaaccacgccgccuucgucaaccugcugaacaucgagaccgacuacaugaagacguuccacuuccacuccaagcgggugaccgcccacggggacacgccccagcucgaccugaaggcccgcccgaccuacggcgcgggggagaucaccgugcuggucgagguggccgacauggagcuccacaccaagaagguggagaucagcggccugaaguucgucucccuggccugcaccggcugcuacgccugcagcagcgggaucuccugcaaggugcggauccacguggacgagcccgacgagcucaccguccacgucaagagcuccgaccccgacgugguggccgcgagcacgucccugauggcccgcaagcuggaguucggcaccgacagcaccuucaaggccuucuccgccaugcccaagaccagccucugcuucuacaucguggagcgggaguacugcaaguccugcagcgaggaggacacgcagaagugcguggacaccaagcuggagcagccgcaguccauccugaucgagcacaaggggaccaucaucggcaagcagaacgacacgugcaccgcgaaggccagcugcuggcucgaguccgucaagagcuucuucuacgggcugaagaacaugcugggcuccguguucggcaacuucuucaucgggauccuccuguuccuggcccccuucgugcuccugguccuguucuucauguucggcuggaagauccucuucugcuucaagugcugccgccggacccgcgggcugcugaaguaccggcaccucaaggacgacgaggagaccggcuaccgccggaucaucgagcgccugaacaacaagaaggggaagaaccggcugcucgacggcgagcgccuggccgaccggaagaucgccgagcuguucagcaccaagacgcacaucggc

SEQ ID NO: 12289 - RNA, 2916 nt, Artificial Sequence
  derived and/or modified CDS sequence (opt1) from CCHFV(Ast199, Artificial)__KX056051.1__Gn-4aa-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccuccaggugagcgaguccaccggggucgcgcugaagcgcugcagcuggcucaucgugcugcuggugcuccugacggucagccugucccccgugcagagcgccccggugggccggaagccccucuuccuggacuccaucgucaaggggaugaagaaccugcucaacagcaccucccuggagaccagccuguccaucgaggcccccuggggcgccaucaacgugcagagcaccuucaagcccacgguguccaccgccaacaucgcgcucagcugguccagcgucgagcaccgcggcaacaagauccuggugaccgggcgguccgagagcaucaugaagcuggaggagcgcaccggcguguccugggaccucggggucgaggacgccagcgaguccaagcugcugacggugagcaucauggaccucucccagauguacagcccggucuucgaguaccugagcggcgaccgccagguggaggaguggcccaaggcgaccugcaccggggacugccccgagcggugcggcugcaccuccagcacgugccugcacaaggaguggccccacucccggaacuggcgcugcaacccgaccuggugcuggggcguggggaccggcugcacgugcugcggggucgacgugaaggaccucuucaccgaccacauguucaucaaguggaagguggaguacaucaagaccgaggccaucgucugcguggagcugaccagccaggagcgccagugcucccugaucgaggccggcacccgguucaaccuggggcccgugaccaucacgcucagcgagccccgcaacauccagcagaagcugcccccggagaucaucacccugcaccccaagaucgaggagggcuucuucgaccucaugcacguccagaaggugcuguccgccagcaccgugugcaagcugcaguccugcacccacggcauccccggggaccuccagaucuaccacaucggcaaccugcugaagggggaccggcucaacggccaccugauccacaagaucgagccccacuucaacacgagcuggauguccugggacggcugcgaccuggacuacuacugcaacaugggggacuggccgagcugcaccuacaccggcgucacccagcacaaccacgccgccuucgugaaccuccugaacaucgagacggacuacaccaagaccuuccacuuccacuccaagcgcgugaccgcccacggggacacgccccagcuggaccucaaggcccggcccaccuacggcgcgggggagaucaccguccugguggagguggccgacauggagcugcacaccaagaaggucgaggugagcggccucaaguucgccucccuggccugcacgggcugcuacgccugcagcuccgggaucagcugcaaggugcgcauccacgucgacgagccggacgagcugaccgugcacgucaagagcuccgaccccgacgugguggcggccagcaccucccucauggcccggaagcuggaguucggcaccgacagcacguucaaggccuucuccgcgaugcccaagaccagccugugcuucuacaucguggagcgcgaguacugcaaguccugcagcgaggacgacaccaagaagugcgucgacaccaagcucgagcagccccaguccauccugaucgagcacaaggggacgaucaucggcaagcagaacgacacgugcaccgccaaggccagcugcuggcuggaguccgucaagagcuucuucuacgggcucaagaacaugcugggcuccguguucggcaacuucuucguggggauccuccucuuccuggccccguucgugcugcucgugcuguucuucaucuucggcuggaagauccuguucugcuucaagugcugccggcgcacccgggggcuguucaaguaccgccaccugaaggacgacgaggagaccggcuaccggaagaucaucgagcgccugaacagcaagaaggggaagaaccggcuccuggacggcgagcgccuggccgaccggaagaucgcggagcuguucuccaccaagacccacaucggc

SEQ ID NO: 12290 - RNA, 2916 nt, Artificial Sequence
  derived and/or modified CDS sequence (opt1) from CCHFV(Ast149, Artificial)__KX056054.1__Gn-4aa-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccuccaggugagcgaguccaccggggucgcgcugaagcgcagcagcuggcucaucgugcugcuggugcuccugacggucucccugagccccgugcaguccgccccggugggccggaagccccucuuccuggacagcaucgucaaggggaugaagaaccugcucaacuccaccagccuggagaccucccugagcaucgaggcccccuggggcgccaucaacgugcaguccaccuucaagcccacggugagcaccgccaacaucgcgcucuccuggagcuccgucgagcaccgcggcaacaagauccuggugaccgggcggagcgaguccaucaugaagcuggaggagcgcaccggcgugagcugggaccucggggucgaggacgccuccgagagcaagcugcugacgguguccaucauggaccucagccagauguacagcccggucuucgaguaccuguccggcgaccgccagguggaggaguggcccaaggcgaccugcaccggggacugccccgagcggugcggcugcaccagcuccacgugccugcacaaggaguggccccacagccggaacuggcgcugcaacccgaccuggugcuggggcguggggaccggcugcacgugcugcggggucgacgugaaggaccucuucaccgaccacauguucaucaaguggaagguggaguacaucaagaccgaggccaucgucugcguggagcugaccucccaggagcgccagugcagccugaucgaggccggcacccgguucaaccuggggcccgugaccaucacgcucuccgagccccgcaacauccagcagaagcugcccccggagaucaucacccugcaccccaagaucgaggagggcuucuucgaccucaugcacguccagaaggugcugagcgccuccaccgugugcaagcugcagagcugcacccacggcauccccggggaccuccagaucuaccacaucggcaaccugcugaagggggaccggcucaacggccaccugauccacaagaucgagccccacuucaacacguccuggaugagcugggacggcugcgaccuggacuacuacugcaacaugggggacuggccguccugcaccuacaccggcgucacccagcacaaccacgccgccuucgugaaccuccugaacaucgagacggacuacaccaagaccuuccacuuccacagcaagcgcgugaccgcccacggggacacgccccagcuggaccucaaggcccggcccaccuacggcgcgggggagaucaccguccugguggagguggccgacauggagcugcacaccaagaaggucgagguguccggccucaaguucgccagccuggccugcacgggcugcuacgccugcuccagcgggaucagcugcaaggugcgcauccacgucgacgagccggacgagcugaccgugcacgugaaguccagcgaccccgacgucguggcggccuccaccagccucauggcccggaagcuggaguucggcaccgacuccacguucaaggccuucagcgcgaugcccaagaccucccugugcuucuacaucguggagcgcgaguacugcaagagcugcuccgaggacgacaccaagaagugcgucgacaccaagcucgagcagccccagagcauccugaucgagcacaaggggacgaucaucggcaagcagaacgacacgugcaccgccaaggccuccugcuggcuggagagcgugaaguccuucuucuacgggcucaagaacaugcugggcagcguguucggcaacuucuucgucgggauccuccucuuccuggccccguucgugcugcucgcccuguucuucaucuucggcuggaagauccuguucugcuucaagugcugccggcgcacccgggggcuguucaaguaccgccaccugaaggacgacgaggagaccggcuaccggaagaucaucgagcgccugaacuccaagaaggggaagaaccggcuccuggacggcgagcgccuggcggaccggaagaucgccgagcuguucagcaccaagacccacaucggc

SEQ ID NO: 12291 - RNA, 2916 nt, Artificial Sequence
  derived and/or modified CDS sequence (opt1) from CCHFV(Ast137, Artificial)__KX056057.1__Gn-4aa-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccauccacaucugccgcaugagcaaccacccccggaccaccauggccuuccuguucugguucuccuucggcuacgucaucaccugcaucuucugcaaggcccuguucuacagccucaucaucaucggcacgcuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccugcaggugagcgaguccaccggggucgcgcugaagcgcagcagcuggcucaucgugcugcuggugcuccugacggucucccugagccccgugcaguccgccccggugggccggaagccccucuuccuggacagcaucgucaaggggaccaagaaccugcucaacuccaccagccuggagaccucccugagcaucgaggcccccuggggcgccaucaacgugcaguccacguucaagcccaccgugagcaccgccaacaucgcgcucuccuggagcuccgucgagcaccgcggcaacaagauccuggugaccgggcggagcgaguccaucaugaagcuggaggagcgcacgggcgugagcugggaccucggggucgaggacgccuccgagagcaagcugcugaccguguccaucauggaccucagccagauguacagcccggucuucgaguaccuguccggcgaccggcagguggaggaguggcccaaggccaccugcaccggggacugccccgagcgcugcggcugcacgagcuccaccugccugcacaaggaguggccccacagccggaacuggcgcugcaacccgaccuggugcuggggcguggggaccggcugcacgugcugcggggucgacgugaaggaccucuucaccgaccacauguucaucaaguggaagguggaguacaucaagaccgaggccaucgucugcguggagcugaccucccaggagcgccagugcagccugaucgaggccggcacccgguucaaccuggggcccgugacgaucacccucuccgagccccgcaacauccagcagaagcugcccccggagaucaucacccugcaccccaagaucgaggagggcuucuucgaccucaugcacguccagaaggugcugagcgcguccaccgugugcaagcugcagagcugcacgcacggcauccccggggaccuccagaucuaccacaucggcaaccugcugaagggggaccggcucaacggccaccugauccacaagaucgagccccacuucaacaccuccuggaugagcugggacggcugcgaccuggacuacuacugcaacaugggggacuggccguccugcaccuacaccggcgucacgcagcacaaccacgccgccuucgugaaccuccugaacaucgagaccgacuacaccaagaccuuccacuuccacagcaagcgcgugacggcccacggggacaccccccagcuggaccucaaggcccggcccaccuacggcgcgggggagaucaccguccugguggagguggccgacauggagcugcacacgaagaaggucgagguguccggccucaaguucgccagccuggccugcaccggcugcuacgccugcuccagcgggaucagcugcaaggugcgcauccacgucgacgagccggacgagcugaccgugcacgugaaguccagcgaccccgacgucguggcggccuccaccagccucauggcccggaagcuggaguucggcacggacuccaccuucaaggccuucagcgcgaugcccaagaccucccugugcuucuacaucguggagcgcgaguacugcaagagcugcuccgaggacgacaccaagaagugcgucgacacgaagcucgagcagccccagagcauccugaucgagcacaaggggaccaucaucggcaagcagaacgacaccugcaccgccaaggccuccugcuggcuggagagcgugaaguccuucuucuacgggcucaagaacaugcugggcagcguguucggcaacuucuucgucgggauccugcucuuccuggccccguucgugcugcucgugcuguucuucaucuucggcuggaagauccuguucugcuucaagugcugccggcgcacgcgggggcucuucaaguaccgccaccugaaggacgacgaggagaccggcuaccggaagaucaucgagcgccugaacuccaagaaggggaagaaccggcuccuggacggcgagcgccuggccgaccggaagaucgcggagcucuucagcaccaagacccacaucggc

SEQ ID NO: 12292 - RNA, 2916 nt, Artificial Sequence
  derived and/or modified CDS sequence (opt1) from CCHFV(Ast133, Artificial)__KX056060.1__Gn-4aa-Gc
agcgaggagcccgacgacgacugcaucucccgcacccagcugcucaagaccgagacggccgagauccacgacgacaacuacggcgggccgggcgacaagaucaccaucugcaacgggagcaccaucguggaccagcggcugggcuccgagcuggggugcuacaccaucaaccgcgucaagagcuucaagcucugcgagaacuccgccacgggcaagaccugcgagaucgacagcacccccgugaagugccggcagggcuucugccugaagaucacccaggaggggcgcggccacgugaagcugucccgggggagcgaggucgugcucgacgcgugcgacuccagcugcgagaucaugauccccaagggcacgggggacauccugguggacugcuccggcggccagcagcacuuccugaaggacaaccucaucgaccuggggugcccccacaucccgcugcucggcaagauggccaucuacaucugccgcaugagcaaccacccccggaccaccauggccuuccuguucugguucuccuucggguacgucaucacgugcaucuucugcaaggcccuguucuaccuccugaucaucaucggcacccugggcaagaagaucaagcaguaccgcgagcucaagccccagaccugcaccaucugcgagaccgcccccgugaacgcgaucgacgccgagaugcacgaccugaacugcagcuacaacaucugcccguacugcgccucccggcugacgagcgacgggcucgcccgccacgugacccagugccccaagcggaaggagaaggucgaggagaccgagcuguaccugaaccucgagcgcauccccuggaucgugcggaagcugcuccagguguccgagagcaccggcgucgcgcucaagcgcuccagcuggcugaucgugcugcucgugcugcugacggucagccucucccccgugcagagcgccccgguggggcggaagccccuguucuccgacagcaucgucaagggcaugaagaaccugcucaacuccaccagccuggagaccucccugagcaucgaggcccccuggggcgccaucaacgugcaguccaccuucaagcccacggugagcaccgccaacaucgcgcucuccuggagcuccgucgagcaccgcgggaacaagauccuggugaccggccggagcgaguccaucaugaagcuggaggagcgcaccggggugagcugggaccucggcgucgaggacgccuccgagagcaagcugcugacgguguccaucauggaccucagccagauguacagcccggucuucgaguaccuguccggggaccgccagguggaggaguggcccaaggcgaccugcaccggcgacugccccgagcggugcgggugcaccagcuccacgugccugcacaaggaguggccccacagccggaacuggcgcugcaacccgaccuggugcuggggcgugggcaccgggugcacgugcugcggcgucgacgugaaggaccucuucaccgaccacauguucaucaaguggaagguggaguacaucaagaccgaggccaucgucugcguggagcugaccucccaggagcgccagugcagccugaucgaggccgggacccgguucaaccugggccccgugaccaucacgcucuccgagccccgcaacauccagcagaagcugcccccggagaucaucacccugcaccccaagaucgaggagggguucuucgaccucaugcacguccagaaggugcugagcgccuccaccgugugcaagcugcagagcugcacccacggcauccccggcgaccuccagaucuaccacaucgggaaccugcugaagggcgaccgggucaacgggcaccucauccacaagaucgagccccacuucaacacguccuggaugagcugggacggcugcgaccuggacuacuacugcaacaugggcgacuggccguccugcaccuacaccggggugacccagcacaaccacgccgccuucgugaaccugcucaacaucgagacggacuacaccaagaccuuccacuuccacagcaagcgcgucaccgcccacggcgacacgccccagcuggaccugaaggcccggcccaccuacggggcgggcgagaucaccgugcucguggaggucgccgacauggagcugcacaccaagaagguggagaucuccgggcugaaguucgccagccucacgugcaccggcugcuacgccugcuccagcggcaucagcugcaaggugcgcauccacgucgacgagccggacgagcugaccgugcacgugaaguccagcgaccccgacgucguggccgcguccaccagccugauggcccggaagcucgaguucgggacggacuccaccuucaaggccuucagcgccaugcccaagaccucccugugcuucuacaucguggagcgcgaguacugcaagagcugcuccgaggacgacaccaagaagugcgucgacacgaagcuggagcagccccagagcauccucaucgagcacaagggcaccaucaucgggaagcagaacgacacgugcaccgcgaaggccuccugcuggcuggagagcgugaaguccuucuucuacggccugaagaacaugcucgggagcguguucggcuccuucuucgucggcauccugcuguuccucgccccguucgugcugcuggugcuguucuucauguucggguggaagauccuguucugcuucaagugcugccggcgcacccggggccuguucaaguaccgccaccucaaggacgacgaggagaccggguaccggcgcaucaucgagcggcugaacagcaagaagggcaagaaccgccugcucgacggggagcggcuggccgaccgcaagaucgccgagcuguucuccagcaagacccacaucggc

SEQ ID NO: 12293 - RNA, 2916 nt, Artificial Sequence
  derived and/or modified CDS sequence (opt1) from CCHFV(SK/2015/human, Artificial)__KX458183.1__Gn-4aa-Gc
agcgaggaguccggcgacgacugcaucagccgcacccggcuccuccgcaccgagacggccgagauccacggggacuccuacggcgggcccggcgacaagaucaccaucugcaacgggagcaccaucguggaccagcggcugggcuccgagaugggcugcuacaccaucaaccgcgucaagagcuucaagcugugcgagaacuccgccacgggcaagagcugcgagaucgacuccaucccggugcggugccgccagggguacugccucaagaucacccaggaggggcggggccacgugaagcugagccgcggguccgaggucgugcuggacgcgugcgacagcuccugcgaggugaugauccccaagggcaccggcgacauccucgucgacugcagcgggggccagcagcacuuccugaaggacaaccugaucgaccucgggugccccaacaucccccugcugggcaagauggccaucuacaucugccggauguccaaccacccgaagaccacgauggccuuccucuucugguucagcuucggcuacgugaucacgugcauccugugcaaggccaucuucuaccugcucaucaucguggggacccugggcaagcgcuucaagcaguaccgggagcugaagccccagaccugcaccaucugcgagaccacccccgccaacgcgaucgacgccgagaugcacgaccucaacugcuccuacaccaucugccccuacugcgccagccgccugacguccgacgggcuggcccggcacgucacccagugcccgaagcgcaaggagaagguggaggagaccgagcucuaccugaaccuggagcggauccccugggugguccgcaagcuccuccaggugagcgagagcaccggcguggcgcugaagcgguccagcuggcucaucguccugcugguccucuucacggugucccugagccccgugcaguccgcccccaucgggcgccggccgcuguuccucgacagcaucgugcgcggcaugaagaaccugcugaacuccaccagccucgagaccucccugagcaucgaggcccccuggggcgccaucaacgugcaguccaccuacaagcccacggucagcaccgccaacaucgcgcuguccuggagcuccguggagcaccgggggaacaagauccucgugagcggccgcuccgagagcaucaugaagcuggaggagcgcaccggggucuccugggaccugggcguggaggacgccagcgagagcaagcuccugaccgucuccgugauggaccugagccagauguacucccccguguucgaguaccucagcggggaccggcaggucgaggaguggccgaaggccacgugcaccggcgacugccccgagcgcugcggcugcaccaccuccacgugccugcacaaggaguggccccacagccggaacuggcgcugcaaccccaccuggugcuggggcguggggaccgggugcacgugcugcggccuggacgugaaggaccucuucaccgacuacauguucgucaaguggaagguggaguacaucaagaccgaggccaucgugugcgucgagcugaccucccaggggcggcagugcagccugaucgaggccggcacccgcuucaaccugggcuccgugaccaucacgcucagcgagccgcggaacauccagcacaagcugccgcccgagaucaucacccugcacccccgcaucgaggagggguucuucgaccucaugcacgugcagaagguccuguccgcgagcaccgugugcaagcugcaguccugcacccacggcgugcccggggaccuccaggucuaccacaucggcaaccugcugaagggcgacaaggugaacgggcaccucauccacaagaucgagccccacuucaacacgagcuggauguccugggacggcugcgaccuggacuacuacugcaacaugggggacuggcccagcugcaccuacaccggcgugacccagcacaaccacgccuccuucgucaaccugcucaacaucgagacggacuacaccaagaacuuccacuuccacagcaagcgggugaccgcccacggggacacgccccagcuggaccugaaggcccgcccgaccuacggcgccggcgagaucaccgugcucgucgagguggcggacauggagcugcacaccaagaagaucgagaucagcgggcugaaguucgccucccugaccugcacgggcugcuacgccugcagcuccgggaucagcugcaaggugcggauccacgucgacgagcccgacgagcugaccgugcacgugaaguccgacgaccccgacgucguggccgccagcuccagccugauggcgcgcaagcucgaguucggcaccgacuccaccuucaaggccuucagcgccaugccgaagacgucccugugcuucuacaucguggagcgggaguacugcaagagcugcuccaaggaggacacccagaagugcgucaacaccaagcuggagcagccccagagcauccucaucgagcaccgcgggaccaucaucggcaagcagaacaacacgugcaucgccaaggcguccugcuggcuggagagcgugaaguccuucuucuacggccugaagaacaugcucagcgggaucuucggcaaccuguuccuggggaucuuccucuuccuggcccccuucauccugcucauccuguucuucauguucggcuggcggauccuguucugcuucaagugcugccgccggacccgcggccucuucaaguaccggcaccugaaggacgacgaggagaccggguaccgccgcaucaucgagcggcugaacaacaagaagggcaagaacaagcuccuggacggggagcgccuggccgaccggcgcaucgccgagcuguucuccaccaagacgcacaucggc

SEQ ID NO: 12294 - RNA, 2916 nt, Artificial Sequence
  derived and/or modified CDS sequence (opt1) from CCHFV(YL16070, Artificial)__KY354081.1__Gn-4aa-Gc
gccgagggcgggagcuccgacugcaucagccgcacccagcuggugaagaccgaggucgccgagauccacgaggacuccuacggcgggcccggcgagaagaucacgaucugcaacgggagcaccaucguggaccagcggcucggcuccgagcugggcugcuacaccaucaaccgcgucaagagcuacaagcugugcgagaacuccgcgagcgggaaguccugcgagaucgacagcaucccggugaagugcaagcagggcuucugccucaagaucacccaggaggggcggggccacgugaagcugucccgcgggacggagaucgugcuggacgucugcgacagcuccugcgagcucaugauccccaagggcaccggcgacauccugguggacugcagcgggggccagcagcacuuccugcagaacaaccucaucgaccuggggugccccaacgugccccugcucggcaagauggccaucuacgucugccggauguccaaccacccgaagaccaccauggccuuccuguucugguucagcuucggcuacgugaucacgugcaucgugugccgcguccuguucuaccuccugaucgccaucgggaccgugggcaagaagcugaagcaguaccgggagcucaagccccagaccugcaucgugugcgaguccguccccgugaacgccaucgacgcggagaugcacgagcugaacugcagcuacaacaucugccccuacugcgccucccgccugagcaccgacgggcucauccggcacgugacgcagugcccgaagcgccgggagaaggucgaggagaccgagcuguuccugaaccucgagcgcauccccuggcuggugcggaagcugcuccaggugagcgaguccaccggcauggcccugaagcgcagcugcuggaugaucacccugcucauccugcugcucgucuccaugagccccgugcaguccgcccccguggggcggaagccgcuguuccuggacagcaucgcgaagggcaugaagucccuccugaacagcacgucccuggagaccagccucuccaucgaggcccccuggggcgccaucaacguccagagcaccuucaagcccaccguguccgccgccaacaucgcgcugagcugguccagcgucgagcaccgcgggaacaagauccugguguccggccggagcgaguccaucaugaagcucgaggagcgcacgggggugagcuggaaccugggcgucgaggacgccagcgaguccaagacccugaccgugagcgugauggaccucucccagauguacagccccgucuucgaguaccuguccggggaccgccagguggaggaguggccgaaggcgaccugcacgggcgacugccccgagcggugcggcugcaccagcuccacgugccugcacaaggaguggccccacagccggaacuggcgcugcaaccccaccuggugcuggggcguggggaccgggugcacgugcugcggccucgacgucaaggacuucuucaccgacuacaugcuggugaaguggaagguggaguacaucaagaccgaggccaucgucugcguggagcugaccucccaggagcgccagugcagccugaucgaggccgggacccgguucaaccucggcccggugaccaucacccuguccgagccccgcaacguccagcagcggcugccgcccgagaucgugacgcuccaccccaagaucgaggagggcuucuucgaccugaugcacgugcagaagauccugagcgccuccaccgucugcaagcuccagagcugcacccacggggugcccggcgacuuccagguguaccacgucgggaaccugcugcgcggcgacaaggugaacggccacuccauccacaagaucgagccccacuucaacaccagcuggauguccugggacgggugcgaccucgacuacuucugcaacaugggcgacuggcccagcugcaccuacacgggggugacccagcacaaccgggccgccuucaucaacaugcugaacaucgagaccgacuacaccaagacguuccacuuccacagcaagcgcgucaccgcccacggcgacaccccgcagcuggaccucaaggcccggcccgcguacggggccggcgaggugaccgugcuggucgagguggccgaccuggagcuccacacgaagaagcuggagguguccggccugaagaucgccagccugaccugcuccgggugcuacgccugcagcuccggcaucagcugcaagguccgcauccacgugaacgagcccgacgaguucaccgugcacguccgguccagcgacccggacgugguggcggccggguccagccugauggcccgcaagaucgaguucggcgccgacuccaccuucaaggcguucagcuccaugcccaaggacagccugugcuucuacaucgucgagaaggacuacugcuccagcugcacggacgacgacacccagaagugcgugaacaccaagcucgaccacccccaguccauccugaucgagcacaaggggaccaucaucggcaagcagaacgacacgugcagcaccaagaccuccugcuggcucaagagcuucaagggcuucuucuacgggcucaagaacaugcugagcggcaucuucgggaacguguuccugggcauccuccuguuccuggcccccuucguccuccugaucuucuucuucuucuucggguggcggcuccucuucugccugaagugcugcaagaagaccaagggccugcucaaguacaagcaccugaaggacaaggaggaggccggcuacaagaagaucaucgagcgccugaacgggaagaagggcaagucccagcuguucgacggggagcggcuggccaaccgcaagaucgccgagcuguucagcacgaagauccacaucggc

SEQ ID NO: 12295 - RNA, 2916 nt, Artificial Sequence
  derived and/or modified CDS sequence (opt1) from CCHFV(Oman_812956, Artificial)__KY362518.1__Gn-4aa-Gc
agcgaggaguccggcgaggacugcaucagccgcacccagcugcuccggaccgagacggccgagauccacggggacaacuacggcgggcccggcgacaagaucaccaucugcaacggguccaccaucguggaccagcgccugggcagcgagcugggcugcuacaccaucaaccgggugaaguccuucaagcucugcgagaacagcgccacggggaaguccugcgagaucgacaacaccccggugaagugcaagcagggcuucugccugaagaucacccaggaggggcgcggccacgugaagcugagccgggacuccgaggucgugcucgacgcgugcgacagcuccugcgagaucaugauccccaaggggaccggcgacauccugguggacugcagcggcgggcagcagcacuuccugaaggacaaccucaucgaccugggcugccccaacaucccccugcucgggaagauggccaucuacaucugccgcauguccaaccacccgaagacgaccauggccuuccuguucugguucagcuucggcuacgucaucacgugcauccugugcaaggugaucuucuaccuccugaucguggucggcacccuggggaagaaguucaagcaguaccgggagcucaagccccagaccugcaccaucugcgagaccacccccgugaacgccaucgacgccgagaugcacgaccugaacugcuccuacaacaucugccccuacugcgcgagccgccugacguccgacggccucgcccggcacgugaugcagugcccgaagcgcaaggagaagaucgaggagaccgagcuguaccugaaccucgagcggauccccugggucgugcgcaagcugcuccaggugagcgaguccaccggggucgcccugaagcggagcagcuggcugaucgugcugcucgugcugcugaccgucucccucagccccgugcaguccgcccccaucggccgcaagccgcuguucuucgacagcaucgcgaaggggaugaagaaccugcucaacuccacgagccuggagaccucccugagcaucgaggcccccuggggcgccaucaacgugcaguccaccuucaagcccaccgucagcacggccaacaucgcccucuccuggagcuccguggagcaccggggcaacaagauccuggugagcgggcgcuccgagagcaucaugaagcuggaggagcggaccggcaucuccugggaccucggggucgaggacgcgagcgaguccaagcugcugaccgugagcgucauggaccucagccagauguacucccccguguucgaguaccugagcggcgaccgccagguggaggaguggccgaaggcgaccugcacgggggacugccccgagcggugcggcugcaccuccagcacgugccugcacaaggaguggccccacucccgcaacuggcggugcaaccccaccuggugcuggggcgucgggaccggcugcacgugcugcgggcucgacgugaaggaccuguucaccgacuacauguucgugaaguggaaggucgaguacaucaagaccgaggccaucgugugcguggagcugaccagccaggagcgccagugcucccugaucgaggccggcacccgcuucaaccucgggccggucaccaucacccugagcgagccccggaacauccagcagaagcugccgcccgagaucgugacccuccacccccgcaucgaggagggcuucuucgaccugaugcacgugcagaagguccuguccgccagcacggugugcaagcuccaguccugcacccacggcgugcccggggaccugcaggucuaccacaucggcaaccugcucaagggggacaaggugaacggccaccugauccacaagguggagccccacuucaacaccagcuggauguccugggacggcugcgaccuggacuacuacugcaacaugggggacuggcccagcugcaccuacacgggcgucacccagcacaaccacgccgccuucgugaaccuccugaacaucgagaccgacuacaccaagaacuuccacuuccacuccaagcgggugacggcccacggggacaccccgcagcuggaccucaaggcccgccccaacuacggcgccggggagaucaccguccugguggagguggcggacauggagcugcacaccaagaagaucgagaucagcggccucaaguucgccucccugacgugcaccggcugcuacgccugcagcagcgggaucuccugcaagguccggauccacguggacgagcccgacgagcugaccgugcacgucaagagcgaggacccggacaucguggccgccuccagcucccucauggcgcgcaagcuggaguucggcaccgacagcacguucaaggccuucuccgccaugcccaagaccagccugugcuucuacaucguggagcgggaguacugcaaguccugcagcaaggaggacacccagaagugcgucaacgccaagcucgagcgcccccaguccauccugaucgagcacaaggggaccaucaucggcaagcagaacgacacgugcaccgcgaaggccagcugcuggcuggaguccgucaagagcuucuucuacgggcucaagaacaugcuguccggcaucuucggcaacguguucaucgggaucuuccuguuccucgcccccuucauccugcugauccucuucuucauguucggcuggcggauccuguucugcuucaagugcugccgccggacccgcgggcuguucaaguaccggcaccucaaggacgacgaggagaccggcuaccgcaagaucaucgagcggcugaacaacaagaaggggaagaacaagcugcucgacggcgagcgccuggccgaccggaagaucgccgagcuguucagcacgaagacccacaucggc

SEQ ID NO: 12296 - RNA, 2916 nt, Artificial Sequence
  derived and/or modified CDS sequence (opt1) from CCHFV(UCCR4405, Artificial)__KY484029.1__Gn-4aa-Gc
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgugaucaccugcaucuucugcaaggcccuguucuacagccucaucaucaucggcacgcuggggaagaagaucaagcaguaccgcgagcugaagccccagaccugcaccaucugcgagaccgcccccgugaacgcgaucgacgccgagaugcacgaccucaagugcuccuacaacaucugcccguacugcgccagccggcugacguccgacggccuggcccgccacgucacccagugccccaagcggaaggagaagguggaggagaccgagcucuaccugaaccuggagcgcauccccuggaucgugcggaagcuccugcaggucagcgaguccaccgggguggcgcugaagcgcagcagcuggcucaucgugcugcugguccuccugacggugucccugagccccgugcaguccgccccggucggccggaagccccucuuccuggacagcaccgugaaggggaugaagaaccugcucaacuccaccagccuggagaccucccugagcaucgaggcccccuggggcgccaucaacgugcaguccacguucaagcccaccgucagcaccgccaacaucgcgcucuccuggagcuccguggagcaccgcggcaacaagauccuggugaccgggcggagcgaguccaucaugaagcuggaggagcgcacgggcgucagcugggaccucgggguggaggacgccuccgagagcaagcugcugaccgucuccaucauggaccucagccagauguacagcccgguguucgaguaccuguccggcgaccggcagguggaggaguggcccaaggccaccugcaccggggacugccccgagcgcugcggcugcacgagcuccaccugccugcacaaggaguggccccacagccggaacuggcgcugcaacccgaccuggugcuggggcgucgggaccggcugcacgugcugcgggguggacgugaaggaccucuucaccgaccacauguucgucaaguggaagguggaguacaucaagaccgaggccaucgugugcgucgagcugaccucccaggagcgccagugcagccugaucgaggccggcacccgguucaaccuggggcccgugacgaucacccucuccgagccccgcaacauccagcagaagcugcccccggagaucaucacccugcaccccaagaucgaggagggcuucuucgaccucaugcacgugcagaagguccugagcgcguccaccgugugcaagcugcagagcugcacgcacggcauccccggggaccuccagaucuaccacaucggcaaccugcugaagggggaccgggugaacggccaccucauccacaagaucgagccccacuucaacaccuccuggaugagcugggacggcugcgaccuggacuacuacugcaacauggggaacuggccguccugcaccuacaccggcgucacgcagcacaaccacgccgccuucgugaaccugcucaacaucgagaccgacuacaccaagaccuuccacuuccacagcaagcgcgugacggcccacggggacaccccccagcuggaccugaaggcccggcccaccuacggcgcgggggagaucaccguccucguggagguggccgacauggagcugcacacgaagaaggucgagaucuccggccugaaguucgccagccucgugugcaccggcugcuacgccugcuccagcgggaucagcugcaaggugcgcauccacgucgacgagccggacgagcugaccgugcacgugaaguccagcgaccccgacgucguggccgcguccaccagccugauggcccggaagcucgaguucggcacggacuccaucuucaaggccuucagcgccaugcccaagaccucccugugcuucuacaucguggagcgcgaguacugcaagagcugcuccgaggacgacaccaagaagugcgucgacaccaagcuggagcagccccagagcauccucaucgagcacaaggggacgaucaucggcaagcagaacgacaccugcaccgcgaaggccuccugcuggcuggagagcgugaaguccuucuucuacgggcugaagaacaugcucggcagcguguucggcaacuucuucgucgggauccugcuguuccucgccccguucgugcugcuggugcucuucuucauguucggcuggaagauccuguucugcuucaagugcugccggcgcacccgggggcuguucaaguaccgccaccucaaggacgacgaggagacgggcuaccggcgcaucaucgagcggcugaacuccaagaaggggaagaaccgccugcucgacggcgagcggcuggccgaccgcaagaucgccgagcuguucagcaccaagacccacaucggc

SEQ ID NO: 12297 - RNA, 2916 nt, Artificial Sequence
  derived and/or modified CDS sequence (opt1) from CCHFV(UCCR4401, Artificial)__KY484035.1__Gn-4aa-Gc
agcgaggagcccuccgacgacugcaucagccgcacccagcuccuccggaccgagacggccgagauccacggcgacaacuacgggggcccgggggacaagaucaccaucugcaacggcuccaccaucguggaccagcgccuggggagcgagcugggcugcuacaccaucaaccggguccgcuccuucaagcucugcgagaacagcgccacgggcaagaacugcgagaucgacuccgugcccgugaagugccggcagggguacugccugcgcaucacccaggagggccgggggcacgucaagcugagccgcggcuccgagguggugcucgacgcgugcgacaccagcugcgagaucaugauccccaaggggaccggcgacauccuggucgacugcuccggcgggcagcagcacuuccugaaggacaaccucaucgaccugggcugccccaagaucccgcugcucgggaagauggccaucuacaucugccggaugagcaaccaccccaagacgaccauggccuuccuguucugguucuccuucggcuacgugaucacgugcauccugugcaaggccaucuucuaccuccugaucaucgugggcacccuggggaagcgccucaagcaguaccgggagcugaagccccagaccugcaccaucugcgagaccacccccgucaacgccaucgacgcggagaugcacgaccugaacugcagcuacaacaucugcccguacugcgccucccgccucacgagcgacggccuggcccggcacgugauccagugccccaagcgcaaggagaagguggaggagaccgagcuguaccucaaccuggagcggauccccugggucgugcgcaagcugcuccagguguccgagagcaccggggucgcccugaagcgguccagcuggcugaucgugcuccuggugcuguucaccgucagccucucccccgugcagagcgcgccgaucggccgcaagccccuguuccuggacuccacggccaaggggaugaagaaccuccugaacagcaccucccuggagaccagccucuccaucgaggcccccuggggcgccaucaacgugcagagcaccuacaagcccacggucuccaccgccaacaucgcgcugagcugguccagcguggagcaccggggcaacaagauccugguguccgggcgcagcgaguccaucaugaagcucgaggagcggaccggcaucagcugggaccugggggucgaggacgccuccgagagcaagcugcucaccguguccgucauggaccugagccagauguacagcccgguguucgaguaccuguccggcgaccgccagguggaggaguggcccaaggccacgugcaccggggacugccccgagcgcugcggcugcaccagcuccacgugccuccacaaggaguggccccacagccggaacuggcgcugcaacccgaccuggugcuggggcgucgggaccggcugcacgugcugcgggcuggacgugaaggaccuguucaccgacuacauguucgugaaguggaaggucgaguacaucaagaccgaggccaucgugugcguggagcugaccucccaggagcggcagugcagccucaucgaggccggcacccgcuucaaccuggggcccgucaccaucacccuguccgagccccggaacauccagcagaagcugcccccggagaucaucacgcugcacccccgcaucgaggagggcuucuucgaccugaugcacgugcagaaggugcucagcgcguccaccgucugcaagcugcagagcugcacccacggcgugcccggggaccuccagguguaccacaucggcaaccuccugaagggggacaaggucaacggccaccugauccacaagaucgagccccacuucaacaccuccuggaugagcugggacggcugcgaccucgacuacuacugcaacaugggggacuggccguccugcacguacaccggcgugacccagcacaaccacgccagcuucgugaaccugcugaacaucgagaccgacuacacgaagaacuuccacuuccacuccaagcgggucaccgcccacggggacacgccccagcucgaccugaaggcccgccccaccuacggcgccggggagaucaccgugcugguggaggucgcggacauggagcuccacaccaagaagaucgagaucagcggccugaaguucgccucccuggccugcaccggcugcuacgccugcagcagcgggaucuccugcaaggugcggauccacguggacgagccggacgagcucaccguccacgucaagagcgacgaccccgacgugguggccgcguccagcucccugauggcccgcaagcuggaguucggcacggacagcaccuucaaggccuucuccgccaugcccaagaccagccucugcuucuacaucguggagcgggagcacugcaaguccugcagcgaggaggacaccaagaagugcgugaacacgaagcuggagcagccccaguccauccugaucgagcacaaggggaccaucaucggcaagcagaacagcacgugcaccgcgaaggccuccugcuggcucgagagcgucaaguccuucuucuacgggcugaagaacaugcugagcggcaucuucggcaacguguucauggggaucuuccucuuccuggccccguucauccugcucauccuguucuucauguucggcuggcgcauccuguucugcuucaagugcugccggcgcacccggggccucuucaaguaccgccaccugaaggacgacgaggagaccggguaccggcgcaucaucgagaagcugaacaacaagaaggggaagaacaagcuccuggacggcgagcggcuggccgaccgccgcaucgccgagcuguucuccaccaagacccacaucggc

SEQ ID NO: 12298 - RNA, 2916 nt, Artificial Sequence
  derived and/or modified CDS sequence (opt1) from CCHFV(UCCR4448, Artificial)__KY484042.1__Gn-4aa-Gc
agcgaggagaccuccgacgacugcaucagccgcacccagcugcuccggacggagaccgccgagauccacggcgacaacuacgggggccccggggacaagaucaccaucugcaacggcuccaccaucguggaccagcgccuggggagcgagcugggcugcuacacgaucaaccgggucaaguccuucaagcucugcgagaacagcgccaccggcaaguccugcgagaucgacagcgugccggugaagugccgccagggguacugccugcggaucacccaggagggccgcgggcacgucaagcugucccggggcagcgagguggugcucgacgcgugcgacaccuccugcgagaucaugauccccaaggggacgggcgacauccuggucgacugcagcggcgggcagcagcacuuccugaaggacaaccucaucgaccugggcugccccaagaucccccugcucgggaagauggccaucuacaucugccgcauguccaaccacccgaagaccaccauggccuuccuguucugguucagcuucggcuacgugaucacgugcauccugugcaaggccaucuucuaccuccugaucaucaucggcacccuggggaagcgguucaagcaguaccgcgagcucaagccccagaccugcaccaucugcgagaccacgcccgugaacgccaucgacgcggagaugcacgaccugaacugcuccuacaacaucugccccuacugcgccagccggcugaccuccgacggccucgcccgccacgucacccagugcccgaagcggaaggagaagguggaggagaccgagcuguaccugaaccucgagcgcauccccugggugguccggaagcugcuccaggugagcgaguccacggggguggcccugaagcgcagcagcuggcugaucguccugcucgugcuguucaccaucucccugagccccgugcaguccgcgcccaucagccggaagccccucuuccuggacuccaucgucaagggcaugaagaaccugcucaacagcaccucccuggagaccagccuguccaucgaggcccccuggggcgccaucaacgugcagagcacguacaagcccaccguguccaccgccaacaucgcccucagcugguccagcgucgagcaccgcgggaacaagauccugguguccggccggagcgaguccaucaugaagcuggaggagaagaccgggaucagcugggaccucggcguggaggacgcguccgagagcaagcugcugacggucagcgugauggaccucucccagauguacagccccgucuucgaguaccuguccggggaccgccagguggaggaguggccgaaggcgaccugcaccggcgacugccccgagcggugcgggugcaccagcuccacgugccugcacaaggaguggccccacagccgcaacuggcgcugcaaccccaccuggugcuggggcgugggcaccgggugcacgugcugcggccucgacgucaaggaccuguucaccgacuacauguucgugaaguggaagguggaguacaucaagaccgaggccaucgucugcguggagcugaccucccaggagcggcagugcagccugaucgaggccgggacccgcuucaaccucggcccggugaccaucacgcuguccgagccccggaacauccagcagaagcugccgcccgagaucaucacccuccacccgcgcaucgaggagggguucuucgaccugaugcacguccagaaggugcugagcgccuccaccgugugcaagcuccagagcugcacccacggcguccccggcgaccuccagguguaccacaucgggaaccugcugaagggcgacaaggugaacgggcaccugauccacaagaucgagccccacuucaacacguccuggaugagcugggacggcugcgaccuggacuacuacugcaacaugggcgacuggcccuccugcaccuacaccggggucacccagcacaaccacgccagcuucgugaaccuccugaacaucgagacggacuacaccaagaacuuccacuuccacuccaagcgggugaccgcccacggcgacaccccgcagcuggaccucaaggcccgccccacguacggggccggcgagaucaccguccugguggagguggccgacauggagcugcacaccaagaagaucgagaucagcgggcucaaguucgcgagccugaccugcacgggcugcuacgccugcuccagcggcaucuccugcaagguccggauccacguggacgagcccgacgagcugaccgugcacgucaagagcgacgacccggacgugguggccgccuccagcucccucauggcccgcaagcuggaguucgggaccgacagcaccuucaaggcguucuccgccaugcccaagacgagccugugcuucuacaucgucgagcgggagcacugcaaguccugcagcgaggaggacaccaagaagugcgugaacaccaagcucgagcagccccaguccauccugaucgagcacaagggcaccaucaucgggaagcagaacagcacgugcaccgccaaggccuccugcuggcuggagagcgugaaguccuucuucuacggccucaagaacaugcugagcgggaucuucggcaacgucuucaucggcaucuuccuguuccucgcgcccuucauccugcugauccucuucuucauguucggguggaagauccuguucugcuucaagugcugccgccggacccgcggccuguucaaguaccggcaccucaaggacgacgaggagaccggguaccgccggaucaucgagcgccugaacaacaagaagggcaagaacaagcugcucgacggggagauccuggccgaccggcgcaucgccgagcuguucuccacgaagacccacaucggc

SEQ ID NO: 12299 - RNA, 2916 nt, Artificial Sequence
  derived and/or modified CDS sequence (opt1) from CCHFV(SPU 45/88, Artificial)__KJ682809.1__Gn-4aa-Gc
agcgaggaguccagcgacgacugccugucccgcacccagcuccugcggaccgagaacacggagauccacagcgacaacuacggcgggcccggcgacaagaucaccaucugcaacggguccaccaucguggaccagcgccugggcagcgagcucgggugcuacaccaucaaccgggucaaguccuucaagcugugcgagaacagcgccacgggcaaguccugcgagaucgacagcaccccggugcgcugccggcagggcuucugccugaagaucacccaggaggggcgcggccacgugaagcucucccgggggagcgaggucgugcuggacgccugcgacuccagcugcgagaucaugauccccaagggcaccggggacauccugguggacugcuccggcggccagcagcacuuccucaaggacaaccuggucgaccuggggugccccaacaucccccuccugggcaagauggcgaucuacaucugccgcaugagcaaccacccgaagacgaccaugggguuccuguucugguucuccuucggcuacgugaucaccugcauccucugcaaggugaucuucuaccugcugaucgucgugggcacccucgggaagaaguucaagcaguaccgggagcugaagccccagacgugcaccaucugcgagaccacccccgugaacgccaucgacgccgagaugcacgaccugaacugcagcuacaacaucugccccuacugcgccucccgccucacgagcgacggccuggcccggcacgucaugcagugcccgaagcgcaaggagaagaucgaggagaccgagcuguaccucaaccuggagcggauccccuggaucgugcgcaagcugcuccaggugagcgaguccaccggggucgcgcugaagcggagcuccuggcugguggugcuccugguccugcucaccgugagccugucccccgugcagagcgcccccaucggccgcaagccgcuguuccucgacuccaucgucaaggggaagaagaaccugcugaacagcacgucccucgagaccagccuguccaucgaggcccccuggggcgccaucaacgugcagagcaccuucaagcccaccguguccgcggccaacaucgcccugagcugguccagcgucgagcaccggggcaacaagauccucguguccgggcgcagcgaguccaucaugaagcuggaggagcggacgggcaucagcugggaccugggggucgaggacgccagcgaguccaagcuccugaccgugagcgugauggaccugucccagauguacagccccgucuucgaguaccucuccggcgaccgccagguggaggaguggccgaaggccaccugcaccggggacugccccgagcggugcggcugcacgagcuccaccugccugcacaaggaguggccccacagccgcaacuggcgcugcaaccccaccuggugcuggggcguggggaccggcugcacgugcugcgggcuggacgucaaggaccuguucaccgacuacauguucgugaaguggaagguggacuacaucaagaccgaggcgaucgucugcguggagcucaccucccaggagcggcagugcagccugaucgaggccggcacgcgcuucaaccuggggccggugaccaucacccucuccgagccccggaacauccagcagaagcugccccccgagaucgucacccugcacccgcgcaucgaggagggcuucuucgaccucaugcacgugcagaacgugcugagcgccuccaccgucugcaagcugcagagcugcacgcacggcgugcccggggaccuccagaucuaccacaucggcaaccugcugaagggggacaaggugaacggccaccucauccacaagaucgagccccacuucaacaccuccuggaugagcugggacggcugcgaccuggacuacuacugcaacaugggggacuggcccuccugcagcuacaccggcgucacccagcacaaccacgccgccuucgugaacaugcugaacaucgagacggacuacaccaagaacuuccacuuccacagcaagcgggugaccgcgcacggggacaccccgcagcucgaccugaaggcccgccccacguacggcgccggggagaucaccguccugguggagguggccgacauggagcuccacaccaagaagaucgagaucuccggccugaaguucgccagccugaccugcacgggcugcuacgcgugcuccagcgggaucuccugcaagguccggauccacguggacgagcccgacgagcucaccgugcacgucaagagcgaggacccggacaucguggccgccuccagcucccugauggcccgcaagcuggaguucggcaccgacagcaccuucaaggccuucuccgcgaugcccaagacgagccucugcuucuacaucguggagcgggaguacugcaaguccugcagcaaggaggacacccagaagugcgucaacaccaagcuggagcagccccaguccauccugaucgagcacaaggggaccaucaucggcaagcagaacgacacgugcaccgccaaggccagcugcuggcucgaguccgugaagagcuucuucuacgggcugaagaacaugcuguccggcaucuucggcaacguguucaucgggauccuccuguuccuggcccccuucaucaugcucauccuguucuucauguucggcuggcgcauccuguucugcuucaagugcugccggcgcacccgggggcucuucaaguaccgccaccugaaggacgacgaggagaucggcuaccggaagaucaucgagcgccugaacaacaagaaggggaagaacaagcuccuggacggcgagcggcuggcggaccgcaagaucgccgagcucuucagcaccaagacgcacaucggc

SEQ ID NO: 12300 - RNA, 2916 nt, Artificial Sequence
  derived and/or modified CDS sequence (opt1) from CCHFV(3010, Artificial)__DQ019222.1__Gn-4aa-Gc
gccgagggcgugagcaacgacugcgugucccgcacccagcucaucaagaccgagguggccgagauccacgaggacagcuacgggggccccggggagaagaucacgaucugcaacggcuccaccaucguggaccagcggcucgggagcgagcugggcugcuacaccaucaaccgcgucaagaccuacaagcugugcgagaacuccgcgacggagaagggcugcgagaucgacagcgugccggugaagugcaagcagggguucugccucaaggucacccaggagggccgggggcacgugaagcugucccgcggcaccgagaucgugcuggacgucugcgacaccagcugcgagcucaugauccccaaggggacgggcgacauccugguggacugcuccggcgggcagcagcacuuccugcaggacaaccucaucgaccugggcugccccaacgugccccugcucgggaagauggccaucuacaucugccggaugagcaaccacccgaagaccaccauggccuuccuguucugguucuccuucggcuacgucaucacgugcaucgugugcaaggugcuguucuaccuccugaucgucaucggcacccugagcaagaagcucaagcaguaccgcgagcugaagccccagaccugcaucgugugcgaguccacccccgugaacgccaucgacgccgagaugcacgagcugaacugcaacuacaacaucugccccuacugcgcgagccggcucaccuccgacgggcugguccgccacgugaaccagugcccgaagcggaaggagaagguggaggagacggagcuguaccucaaccuggagcgcauccccuggcugguccggcgccuccuccaggugagcgaguccaccggcauggcccugaagcggagcugcuggaugaccacccuccugauccugcucguggucucccugagccccgugcagagcgcccccgucgggcgccggccgcuguuccucgacuccaucgugaagggcaugaagaaccugcugaacagcacgucccucgagaccagccuguccaucgaggcccccuggggcgcgaucaacgugcagagcaccuacaagcccaccgucuccacggccaacaucgcccugagcugguccagcguggagcaccgcgggaacaaggugcucgucuccggccggagcgaguccaucaugaagcuggaggagcgcaccgggaucagcugggaccugggcguggaggacgccuccgagagcaagcuccugaccguguccgucauggaccugagccagauguacucccccguguucgaguaccucagcggggaccgccagguggaggaguggccgaaggcgaccugcacgggcgacugccccgagcggugcgggugcaccagcuccacgugccugcacaaggaguggccccacagccggaacuggcgcugcaaccccaccuggugcuggggcgucggcaccgggugcacgugcugcggccuggacgugaaggaccuguucaccgacuacauguucgugaaguggaaggucgaguacaucaagaccgaggccaucgugugcguggagcucaccucccaggagcgccagugcagccugaucgaggccgggacccgguucaaccugggcuccgucaccaucacccucagcgagccgcgcaacauccagcagaagcugccgcccgagaucaucacccugcaccccaagaucgaggagggguucuucgaccucaugcacgugcagaaggugcuguccgccagcacggucugcaagcugcaguccugcacccacggcgugcccggcgaccuccagguguaccacaucgggaaccugcugaagggcgaccgggucaacgggcaccucauccacaagaucgagcagcacuucaacaccagcuggauguccugggacggcugcgaccuggacuacuacugcaacaugggcgacuggcccagcugcaccuacacgggggugacccagcacaaccacgccuccuucgugaaccugcucaacaucgagaccgacuacaccaagacguuccacuuccacagcaagcgcgucaccgcccacggcgacacgccccagcuggaccugaaggcgcggcccaccuacggggccggcgaggugaccgugcucgucgagguggccgacauggagcugcacaccaagaagaucgagaucuccgggcugaaguucgccggccugaccugcaccggcugcuacgccugcagcuccgggaucagcugcaaggugcgcauccacgucgacgagccggacgagcugacggugcacgucaagagcgacgaccccgacgugguggcggccuccagcucccugauggcccggaagcucgaguucggcaccgacagcaccuucaaggccuucuccgccaugcccaagaccagccugugcuucuacaucguggagcgcgaguacugcaaguccugcagcaaggaggacacgcagaagugcgucaacaccaagcuggagcagccgcaguccauccucaucgagcacaaggggaccaucaucggcaagcagaacaacacgugcaccgcgaaggccagcugcuggcuggaguccgucaagagcuucuucuacgggcugaagaacaugcucggcggcaucuucgggaacguguucaucggcaucuucaccuuccugacccccuucauccugcucauccuguucuucauguucggguggcggauccuguucugcuucaagugcugccgccggacccgcggccucuucaaguaccggcaccugaaggacgacgaggagacgggguaccgcaagaucaucgagcggcugaacaacaagaagggcaagaaccgccuccuggacggcgagcggcuggccgaccgcaagaucgccgagcuguucuccaccaagacccacaucggg

SEQ ID NO: 12301 - RNA, 972 nt, Artificial Sequence
  derived and/or modified CDS sequence (opt1) from CCHFV(10200)__U39455.2__Gn
agcgaggagcccuccgacgacugcgugagccgcacccagcugcuccggaccgagacggccgagauccacggcgacaacuacgggggcccgggggacaagaucaccaucugcaacggcuccaccaucgucgaccagcgccuggggagcgagcugggcugcuacaccaucaaccgggugcgcuccuucaagcucugcgagaacagcgccacgggcaagaacugcgagaucgacuccgugcccgucaagugccggcagggguacugccugcgcaucacccaggagggccgggggcacgugaagcugagccgcggcuccgaggugguccucgacgcgugcgacaccagcugcgagaucaugauccccaaggggaccggcgacauccugguggacugcuccggcgggcagcagcacuuccugaaggacaaccucaucgaccugggcugccccaagaucccgcugcucgggaagauggccaucuacaucugccggaugagcaaccaccccaagacgaccauggccuuccuguucugguucuccuucggcuacgugaucacgugcauccugugcaaggccaucuucuaccuccugaucaucgucggcacccuggggcgccggcucaagcaguaccgcgagcugaagccccagaccugcaccaucugcgagaccacccccgugaacgccaucgacgcggagaugcacgaccugaacugcagcuacaacaucugcccguacugcgccucccggcucacgagcgacggccuggcccgccacgugauccagugccccaagcggaaggagaaggucgaggagaccgagcuguaccucaaccuggagcgcauccccuggguggugcggaagcugcuccaggucuccgagagcaccgggguggcccugaagcgcuccagcuggcugaucgugcuccugguccuguucaccgugagccucucccccgugcagagcgcgccgaucggc

SEQ ID NO: 12302 - RNA, 972 nt, Artificial Sequence
  derived and/or modified CDS sequence (opt1) from CCHFV(IbAr10200)__AF467768.2__Gn
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccggguccgcuccuucaagcucugcgagaacagcgccacgggcaagaacugcgagaucgacuccgugcccgugaagugccggcagggguacugccugcgcaucacccaggagggccgggggcacgucaagcugagccgcggcuccgagguggugcucgacgcgugcgacaccagcugcgagaucaugauccccaaggggaccggcgacauccuggucgacugcuccggcgggcagcagcacuuccugaaggacaaccucaucgaccugggcugccccaagaucccgcugcucgggaagauggccaucuacaucugccggaugagcaaccaccccaagacgaccauggccuuccuguucugguucuccuucggcuacgugaucacgugcauccugugcaaggccaucuucuaccuccugaucaucgugggcacccuggggaagcgccucaagcaguaccgggagcugaagccccagaccugcaccaucugcgagaccacccccgucaacgccaucgacgcggagaugcacgaccugaacugcagcuacaacaucugcccguacugcgccucccgccucacgagcgacggccuggcccggcacgugauccagugccccaagcgcaaggagaagguggaggagaccgagcuguaccucaaccuggagcggauccccugggucgugcgcaagcugcuccagguguccgagagcaccggggucgcccugaagcgguccagcuggcugaucgugcuccuggugcuguucaccgucagccucucccccgugcagagcgcgccgaucggc

SEQ ID NO: 12303 - RNA, 972 nt, Artificial Sequence
  derived and/or modified CDS sequence (opt1) from CCHFV(Turkey-Kelkit06)__GQ337054.1__Gn
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcaagaacuccgccacgggcaagaccugcgagguggacagcacccccgugaagugccgccagggguucugccugaagaucacccaggagggccgggggcacgucaagcugucccgcggcagcgagguggugcucgacgcgugcgacuccagcugcgaggucaugauccccaaggggacgggcgacauccugguggacugcuccggcgggcagcagcacuuccugaaggacaaccucaucgaccugggcugcccccacaucccgcugcucgggcggauggccaucuacaucugccgcaugagcaaccacccccggaccaccauggccuuccuguucugguucuccuucggcuacgugaucacgugcaucuucugcaaggcccuguucuacagccucaucaucaucggcacccuggggaagaagaucaagcaguaccgcgagcugaagccccagaccugcaccaucugcgagaccgcccccgucaacgcgaucgacgccgagaugcacgaccucaacugcuccuacaacaucugcccguacugcgccagccggcugacguccgacggccuggcccgccacgugacccagugccccaagcggaaggagaagguggaggagaccgagcucuaccugaaccuggagcgcauccccuggaucguccggaagcuccuccaggugagcgaguccaccgggguggcgcugaagcgcagcagcuggcugaucguccugcuggugcuccugacggugucccugagccccguccaguccgccccggugggc

SEQ ID NO: 12304 - RNA, 972 nt, Artificial Sequence
  derived and/or modified CDS sequence (opt1) from CCHFV(SR3)__AJ538199.1__Gn
agcgaggaguccggcgacgacugcaucagccgcacccagcugcuccggaccgagacggccgaggugcacggggacaacuacggcgggcccggcgacaagaucaccaucugcaacggguccaccgucguggaccagcgccugggcagcgagcugggcugcuacaccaucaaccgggugcgcuccuucaagcucugcgagaacagcgccacggggaaguccugcgagaucgacagcaucccggucaagugcaagcagggcuacugccugaagaucacccaggaggggcggggccacgugaagcugucccgcgggagcgaggugguccucgacgugugcgacuccagcugcgaggugaugauccccaagggcaccggcgacauccuggucgacugcuccgggggccagcagcacuuccugaaggacaaccucguggaccuggggugccccaagaucccccugcucggcaagauggcgaucuacaucugccggaugagcaaccacccgaagaccacgauggccuuccuguucugguucuccuucggcuacgugaucacgugcauccugugcaaggccaucuucuuccuccugaucaucuucgggacccugggcaagcgcuucaagcaguaccgggagcucaagccccagaccugcaccaucugcgagaccacccccgucaacgccaucgacgccgagaugcacgaccugaacugcagcuacaacaucugccccuacugcgcgucccgccugaccagcgacgggcucgcccggcacgugacgcagugcccgcgccggaaggagaagguggaggagaccgagcuguaccugaaccucgagcgcauccccugggucgugcggaagcugcuccagguguccgagagcaccggcaccguccugaagcgcagcuccuggcugaucgugcugcucgugcuguucacggucagccugucccccgugcagagcgcccccaucggg

SEQ ID NO: 12305 - RNA, 972 nt, Artificial Sequence
  derived and/or modified CDS sequence (opt1) from CCHFV(UCCR4413)__KY484038.1__Gn
agcgaguccagcgccuccggcugcaucagccgcacccagaugaucaaguccgagaccgccgagauccacgacgacaucuacgggggccccggggagaagcugacgaucugcaacggcaccaccguggucgaccagcggcucgggagcgagcugggcugcuacaccaucaaccgcaucaagacguacaagcugugcgagaacuccgugaaggagaagaccugcgagaucgacagcgugccggucaagugccggcagggccucugccugaagaucacccaggaggggcgcggccacgugaagcugucccgggggagcgagaucgugcucgacaucugcgacuccagcugcgagcugaugauccccaagggcaccggggacauccuggucgacugcuccggcggccagcagcacuuccuccaggacaaccugguggaccuggggugccccaacaucccccuccugggcaagguggcgaucuacaucugccgcaugagcaaccacccgaagacgaccauggccuuccuguucugguucuccuucggguacgucaucacgugcauccucugcaagauccuguucuaccugcucaucaucaccggcacccugggcaagaagcugaagcaguaccgggagcucaagccccagaccugcaccaucugcgagagcacccccgugaacgccaucgacgccgagaugcacgaccugaacugcuccuacaacaucugccccuacugcgccagccgccugacguccgacgggcucauccggcacgugaaccugugcccgaagcgcaaggagaaggucgaggagaccgagcuguaccucaaccuggagcggauccccugguucgugcgcaagcugcuccaggugagcgagagcaccggcgucgcgcugaagcgguccagcuggcugcucauccuggugauccugcucaccguguccaugagccccguccaguccgcccccaucaac

SEQ ID NO: 12306 - RNA, 972 nt, Artificial Sequence
  derived and/or modified CDS sequence (opt1) from CCHFV(66019)__AB069669.1__Gn
agcgaggaguccggcgacgacugcaucagccgcacccagcugcuccggaccgagacggccgaggugcacggggacaacuacggcgggcccggcgacaagaucaccaucugcaacggguccaccaucgucgaccagcgccugggcagcgagcugggcugcuacaccaucaaccgggugaaguccuucaagcucugcgagaacagcgggacgggcaaguccugcaagaucgacaacaccccggugaagugccgccagggguucugccugaagaucacccaggagggccgggggcacgucaagcugagccgcggcuccgagguggugcucgacgccugcgacagcuccugcgagaucaugauccccaagggcaccggggacauccuggucgacugcagcggcgggcagcagcacuuccugaaggacaaccucguggaccugggcugccccaacaucccccugcucggcaagauggcgaucuacaucugccggauguccaaccacccgaagacgaccauggccuuccuguucugguucagcuucggguacgugaucacgugcaucuucugcaagaucaucuucuaccugcucaucgucgugggcacccuggggaagaaguucaagcaguaccgcgagcugaagccccagaccugcaccaucugcgagaccacccccacgaacgccaucgacgccgagaugcacgaccucaagugcuccuacaacaucugccccuacugcgccagccggcugaccuccgacggccuggcgcgccacgugacccagugcccgaagcggaaggagaaggucgaggagaccgagcucuaccugaaccuggagcgcauccccuggaucgugcggaagcuccuccaggugagcgaguccacgggggucgcccugaagcgcagcagcuggcugaucgugcugcuggugcuccugaccgucucccugagccccgugcaguccgcccccaucggc

SEQ ID NO: 12307 - RNA, 972 nt, Artificial Sequence
  derived and/or modified CDS sequence (opt1) from CCHFV(7001)__AB069670.1__Gn
gccgagggcgggagcuccgacugcaucagccgcacccagcuggugaagaccgaggucgccgagauccacgaggacuccuacggcgggcccggcgagaagaucacgaucugcaacgggagcaccaucguggaccagcggcucggcuccgagcugggcugcuacaccaucaaccgcgugcggagcuacaagcugugcgagaacuccgcgagcgggaaguccugcgagaucgacagcaucccggucaagugcaagcagggcuucugccucaagaucacccaggaggggcgcggccacgugaagcugucccgggggacggagaucgugcuggacgucugcgacagcuccugcgagcucaugauccccaagggcaccggcgacauccugguggacugcagcgggggccagcagcacuuccugcagaacaaccucaucgaccuggggugccccaacgugccccugcucggcaagauggccaucuacgucugccgcauguccaaccacccgaagaccaccauggccuuccuguucugguucagcuucggcuacgugaucacgugcaucgccugccgggugcuguucuaccuccugaucgccaucgggaccgucggcaagaagcugaagcaguaccgcgagcucaagccccagaccugcaucgugugcgaguccgugcccgucaacgcgaucgacgccgagaugcacgagcugaacugcagcuacaacaucugccccuacugcgccucccggcugagcaccgacgggcucauccgccacgugacgcagugcccgaagcggcgcgagaagguggaggagaccgagcuguuccugaaccucgagcggauccccuggcugguccgcaagcugcuccaggugagcgaguccaccggcauggcccugaagcggagcugcuggaugaucacccugcucauccugcugcucguguccaucagccccguccaguccgcgcccgugggg

SEQ ID NO: 12308 - RNA, 972 nt, Artificial Sequence
  derived and/or modified CDS sequence (opt1) from CCHFV(75024)__AB069671.1__Gn
agcgaggaguccggcgacgacugcaucagccgcacccagcugcuccggaccgagacggccgagauccacggggacaacuacggcgggcccggcgacaagaucaccaucugcaacggguccaccaucguggaccagcgccugggcagcgagaugggcugcuacaccaucaaccgggucaaguccuucaagcugugcgagaacagcgccacggggaaguccugcgagaucgacagcaucccggugaagugccgccagggcuacugccucaagaucacccaggaggggcggggccacgugaagcugucccgcgggagcgaggucgugcuggacgcgugcgacuccagcugcgaggugaugauccccaagggcaccggcgacauccucgucgacugcuccgggggccagcagcacuuccugaaggacaaccugaucgaccucgggugccccagcaucccccugcugggcaagauggccaucuacaucugccggauguccaaccacccgaagaccacgauggccuuccucuucugguucagcuucggcuacgugaucacgugcauccugugcaaggccaucuucuaccugcucaucaucguggggacccugggcaagcgcuucaagcaguaccgggagcugaagccccagaccugcaccaucugcgagaccacccccgccaacgcgaucgacgccgagaugcacgaccucaacugcuccuacaacaucugccccuacugcgccagccgccugaccuccgacgggcuggcccggcacgucacgcagugcccgaagcgcaaggagaagguggaggagaccgagcucuaccugaaccuggagcggauccccugggugguccgcaagcuccuccaggugagcgagagcaccggcguggcgcugaagcgguccagcuggcucaucguccugcuggugcuguucgccaucucccugagccccgugcaguccgcccccaucggg

SEQ ID NO: 12309 - RNA, 972 nt, Artificial Sequence
  derived and/or modified CDS sequence (opt1) from CCHFV(7803)__AB069672.1__Gn
agcgaggaguccggcgacgacugcaucagccgcacccagcugcuccggaccgagacggccgagauccacggggacaacuacggcgggcccggcgacaagaucaccaucugcaacggguccaccaucguggaccagcgccugggcagcgagaugggcugcuacaccaucaaccgggucaaguccuucaagcugugcgagaacagcgccacggggaaguccugcgagaucgacagcaucccggugaagugccgccagggcuacugccucaagaucacccaggaggggcggggccacgugaagcugucccgcgggagcgaggucauccuggacgcgugcgacuccagcugcgaggugaugauccccaagggcaccggcgacauccucguggacugcuccgggggccagcagcacuuccugaaggacaaccugaucgaccucgggugccccagcaucccccugcugggcaagauggccaucuacaucugccggauguccaaccacccgaagaccacgauggccuuccucuucugguucagcuucggcuacgucaucacgugcauccugugcaaggccaucuucuaccugcucaucaucguggggacccugggcaagcgcuucaagcaguaccgggagcugaagccccagaccugcaccaucugcgagaccacccccgccaacgcgaucgacgccgagaugcacgaccucaacugcuccuacaacaucugccccuacugcgccagccgccugaccuccgacgggcuggcccggcacgugacgcagugcccgaagcgcaaggagaaggucgaggagaccgagcucuaccugaaccuggagcggauccccuggguggugcgcaagcuccugcaggucagcgagagcaccggcguggcgcugaagcgguccagcuggcucaucgugcugcugguccucuucgccaucucccugagccccgugcaguccgcccccaucagc

SEQ ID NO: 12310 - RNA, 972 nt, Artificial Sequence
  derived and/or modified CDS sequence (opt1) from CCHFV(79121)__AB069673.1__Gn
gccgagggcgggagcuccgacugcaucagccgcacccagcuggugaagaccgaggucgccgagauccacgaggacuccuacggcgggcccggcgagaagaucacgaucugcaacgggagcaccaucguggaccagggccucggcuccgagcuggggugcuacaccaucaaccgggugcgcagcuacaagcugugcgagaacuccgcgagcggcaaguccugcgagaucgacagcaucccggucaagugcaagcagggguucugccucaagaucacccaggagggccgggggcacgugaagcugucccgcggcacggagaucgugcuggacgucugcgacagcuccugcgagcucaugauccccaagggcaccggggacauccugguggacugcagcggcgggcagcagcacuuccugcagaacaaccucaucgaccugggcugccccaacgugccccugcucggcaagauggccaucuacgucugccggauguccaaccacccgaagaccaccauggccuuccuguucugguucagcuucggguacgugaucacgugcaucgccugccgcgugcuguucuaccuccugaucgccaucggcaccgucgggaagaagcugaagcaguaccgggagcucaagccccagaccugcaucgugugcgaguccgugcccgucaacgcgaucgacgccgagaugcacgagcugaacugcagcuacaacaucugccccuacugcgccucccgccugagcaccgacggccucauccggcacgugacgcagugcccgaagcgccgggagaagguggaggagaccgagcuguuccugaaccucgagcgcauccccuggcugguccggaagcugcuccaggugagcgaguccaccgggauggcccugaagcgcagcugcuggaugaucacccugcucauccugcugcucguguccaucagccccguccaguccgcgcccgugggc

SEQ ID NO: 12311 - RNA, 972 nt, Artificial Sequence
  derived and/or modified CDS sequence (opt1) from CCHFV(8402)__AB069674.1__Gn
agcgaggaguccggcgacgacugcaucagccgcacccagcugcuccggaccgagacggccgagauccacaacgacaacuacgggggccccggggacaagaucaccaucugcaacggcuccaccguggucgaccagcgccuggggagcgagcugggcugcuacaccaucaaccgggugaaguccuucaagcucugcgagaacagcgccacgggcaaguccugcgagaucgacagcaccccggugaagugccgccagggguucugccugaagaucacccaggagggccgggggcacgucaagcugucccgcggcagcgagguggugcucgacgcgugcgacuccagcugcgagaucaugauccccaaggggaccggcgacauccuggucgacugcuccggcgggcagcagcacuuccugaaggacaaccucaucgaccugggcugccccaacaucccccugcucgggaagauggccaucuacaucugccggaugagcaaccacccgaagacgaccauggccuuccuguucugguucuccuucggcuacguggugaccugcauccugugcaaggucaucuucuaccuccugaucguggugggcacccuggggaagaaguucaagcaguaccgcgagcucaagccccagacgugcaccaucugcgagaccacccccgucaacgccaucgacgccgagaugcacgaccugaacugcagcuacaacaucugccccuacugcgcgucccggcugacgagcgacggccucgcccgccacgugaugcagugcccgaagcggaaggagaagaucgaggagaccgagcuguaccugaaccucgagcgcauccccugggugguccggaagcugcuccagguguccgagagcaccgggguggcccugaagcgcagcuccuggcuggucgugcugcucgugcugcugaccgucagccucucccccgugcagagcgcccccaucggc

SEQ ID NO: 12312 - RNA, 972 nt, Artificial Sequence
  derived and/or modified CDS sequence (opt1) from CCHFV(88166)__AB069675.1__Gn
agcgaggaguccggcgacgacugcaucagccgcacccagcugcuccggaccgagacggccgagauccacuccgacaacuacgggggccccggggacaagaucaccaucugcaacggcagcaccguggucgaccagcgccugggguccgagcugggcugcuacaccaucaaccgggucaagagcuucaagcucugcgagaacuccgccacgggcaagagcugcgagaucgacuccaccccggugaagugccgccagggguucugccugaagaucacccaggagggccgggggcacgugaagcugagccgcggcuccgagguggugcucgacgcgugcgacagcuccugcgagaucaugauccccaaggggaccggcgacauccuggucgacugcagcggcgggcagcagcacuuccugaaggacaaccucaucgaccugggcugccccaacaucccccugcucgggaagauggccaucuacaucugccggauguccaaccacccgaagacgaccaugggcuuccuguucugguucagcuucggcuacguggugaccugcauccugugcaaggucaucuucuaccuccugaucgugguggggacccugggcaagaaguucaagcaguaccgcgagcucaagccccagacgugcaccaucugcgagaccacccccgucaacgccaucgacgccgagaugcacgaccugaacugcuccuacaacaucugccccuacugcgccagccggcugacguccgacgggcucgcgcgccacgugaugcagugcccgaagcggaaggagaagaucgaggagaccgagcuguaccugaaccucgagcgcauccccugggugguccggaagcugcuccaggugagcgagagcaccggcguggcccugaagcgcuccagcuggcuggucgugcugcucgugcugcugaccgucucccucagccccgugcaguccgcccccaucggg

SEQ ID NO: 12313 - RNA, 972 nt, Artificial Sequence
  derived and/or modified CDS sequence (opt1) from CCHFV(BA88166)__AF338470.1__Gn
agcgaggaguccggcgacgacugcaucagccgcacccagcugcuccggaccgagacggccgagauccacuccgacaacuacgggggccccggggacaagaucaccaucugcaacggcagcaccguggucgaccagcgccugggguccgagcugggcugcuacaccaucaaccgggucaagagcuucaagcucugcgagaacuccgccacgggcaagagcugcgagaucgacuccaccccggugaagugccgccagggguucugccugaagaucacccaggagggccgggggcacgugaagcugagccgcggcuccgagguggugcucgacgcgugcgacagcuccugcgagaucaugauccccaaggggaccggcgacauccuggucgacugcagcggcgggcagcagcacuuccugaaggacaaccucaucgaccugggcugccccaacaucccccugcucgggaagauggccaucuacaucugccggauguccaaccacccgaagacgaccaugggcuuccuguucugguucagcuucggcuacguggugaccugcauccugugcaaggggaucuucuaccuccugaucgucgugggcacccuggggaagaaguucaagcaguaccgcgagcucaagccccagacgugcaccaucugcgagaccacccccgugaacgccaucgacgccgagaugcacgaccugaacugcuccuacaacaucugccccuacugcgccagccggcugacguccgacggccucgcgcgccacgucaugcagugcccgaagcggaaggagaagaucgaggagaccgagcuguaccugaaccucgagcgcauccccuggguggugcggaagcugcugcaggucagcgagagcaccgggguggcccucaagcgcuccagcuggcuggugguccugcucgugcugcugaccgugucccucagccccguccaguccgcccccaucggc

SEQ ID NO: 12314 - RNA, 972 nt, Artificial Sequence
  derived and/or modified CDS sequence (opt1) from CCHFV(BA66019)__AF350448.1__Gn
agcgaggaguccggcgacgacugcaucagccgcacccagcugcuccggaccgagacggccgaggugcacggggacaacuacggcgggcccggcgacaagaucaccaucugcaacggguccaccaucgucgaccagcgccugggcagcgagcugggcugcuacaccaucaaccgggugaaguccuucaagcucugcgagaacagcgggacgggcaaguccugcaagaucgacaagcacccggugaagugccgccagggguucugccugaagaucacccaggagggccgggggcacgucaagcugagccgcggcuccgagguggugcucgacgccugcgacagcuccugcgagaucaugauccccaagggcaccggggacauccuggucgacugcagcggcgggcagcagcacuuccugaaggacaaccucguggaccugggcugccccaacaucccccugcucggcaagauggcgaucuacaucugccggauguccaaccacccgaagaccacgauggccuuccuguucugguucagcuucggguacgugaucacgugcaucuucugcaagaucaucuucuaccugcucaucgucgugggcacccuggggaagaaguucaagcaguaccgcgagcugaagccccagaccugcaccaucugcgagaccacccccaccaacgccaucgacgccgagaugcacgaccucaagugcuccuacaacaucugccccuacugcgccagccggcugacguccgacggccuggcgcgccacgugacccagugcccgaagcggaaggagaaggucgaggagaccgagcucuaccugaaccuggagcgcauccccuggaucgugcggaagcuccuccaggugagcgaguccaccggggucgcccugaagcgcagcagcuggcugaucgugcugcuggugcuccugacggucucccugagccccgugcaguccgcccccaucggc

SEQ ID NO: 12315 - RNA, 972 nt, Artificial Sequence
  derived and/or modified CDS sequence (opt1) from CCHFV(BA8402)__AF350449.1__Gn
agcgaggaguccggcgacgacugcaucagccgcacccagcugcuccggaccgagacggccgagauccacaacgacaacuacgggggccccggggacaagaucaccaucugcaacggcuccaccguggucgaccagcgccuggggagcgagcugggcugcuacaccaucaaccgggugaacuccuucaaccucugcgagaacacggccaccggcaagagcugcgagaucgacuccaccccggugaagugccgccagggguucugccugaagaucacccaggagggccgggggcacgucaagcugagccgcggcuccgagguggugcucgacgcgugcgagagcuccugcgagaucaugauccccaaggggacgggcgacauccuggucgacugcagcggcgggcagcagcacuuccugaaggacaaccucaucgaccugggcugccccaacaucccccugcucgggaagauggccaucuacaucugccggauguccaaccacccgaagaccaccauggccuuccuguucugguucagcuucggcuacguggugaccugcauccugugcaaggucaucuucuaccuccugaucguggugggcacgcuggggaagaaguucaagcaguaccgcgagcucaagccccagaccugcaccaucugcgagaccacgcccgucaacgccaucgacgccgagaugcacgaccugaacugcuccuacaacaucugccccuacugcgcgagccggccgaccuccgacggccuggcccgccacgugaugcagugccccaagcggaaggagaagaucgaggagaccgcccucuaccugaaccuggagcgcauccccugggugguccggaagcuccuccaggugagcgaguccaccgggguggcccugaagcgcagcagcuggcuggucgugcugcuggugcuccugacggucucccugagccccgugcaguccgcgccgaucggc

SEQ ID NO: 12316 - RNA, 972 nt, Artificial Sequence
  derived and/or modified CDS sequence (opt1) from CCHFV(Matin)__AF467769.2__Gn
agcgaggaguccggcgacgacugcaucagccgcacccagcugcuccggaccgagacggccgagauccacuccgacagcuacgggggccccggggacaagaucaccaucugcaacggcuccaccguggucgaccagcgccuggggagcgagcugggcugcuacaccaucaaccgggugaaguccuucaagcucugcgagaacagcgccacgggcaaguccugcgagaucgacagcaccccggugaagugccgccagggguucugccugaagaucacccaggagggccgggggcacgucaagcugucccgcggcagcgagguggugcucgacgcgugcgacuccagcugcgagaucaugauccccaaggggaccggcgacauccuggucgacugcuccggcgggcagcagcacuuccugaaggacaaccucaucgaccugggcugccccaacaucccccugcucgggaagauggccaucuacaucugccggaugagcaaccacccgaagacgaccaugguguuccuguucugguucuccuucggcuacgugaucacgugcauccugugcaaggucaucuucuaccuccugaucguggugggcacccuggggaagaaguucaagcaguaccgcgagcucaagccccagaccugcaccaucugcgagaccacccccgucaacgccaucgacgccgagaugcacgaccugaacugcagcuacaacaucugccccuacugcgccucccggcugacgagcgacggccucgcgcgccacgugaugcagugcccgaagcggaaggagaagaucgaggagaccgagcuguaccugaaccucgagcgcauccccugggugguccggaagcugcuccaggugagcgaguccaccgggguggcccugaagcgcagcuccuggcuggucgugcugcucgugcugcugaccgucagccucucccccgugcagagcgcccccaucggc

SEQ ID NO: 12317 - RNA, 972 nt, Artificial Sequence
  derived and/or modified CDS sequence (opt1) from CCHFV(Baghdad 12)__AJ538197.2__Gn
agcgaggaguccggcgacgacugcaucagccgcacccggcugcuccgcaccgagacggccgagauccacggggacuccuacggcgggcccggcgacaagaucaccaucugcaacgggagcaccaucguggaccagcggcugggcuccgagaugggcugcuacaccaucaaccgcgucaagagcuucaagcugugcgagaacuccgccacgggcaagagcugcaagaucgacuccaucccggugaagugccggcagggguacugccucaagaucacccaggaggggcgcggccacgugaagcugagccggggguccgaggucgugcuggacgcgugcgacagcuccugcgaggugaugauccccaagggcaccggcgacauccucgucgacugcagcgggggccagcagcacuuccugaaggacaaccugaucgaccucgggugccccaacaucccccugcugggcaagauggccaucuacaucugccgcauguccaaccacccgaagaccacgauggccuuccucuucugguucagcuucggcuacgugaucacgugcauccugugcaaggccaucuucuaccugcucaucaucguggggacccugggcaagcgguucaagcaguaccgcgagcugaagccccagaccugcaccaucugcgagaccacccccgucaacgccaucgacgcggagaugcacgaccucaacugcuccuacaacaucugccccuacugcgccagccggcugaccuccgacgggcuggcccgccacgugacgcagugcccgaagcggaaggagaagguggaggagaccgagcucuaccugaaccuggagcgcauccccugggucgugcggaagcuccuccaggugagcgagagcaccggcgucgcccugaagcgcuccagcuggcugaucgugcugcuggugcuccuggcggucuccagcucccccgugcagagcgcccccaucggg

SEQ ID NO: 12318 - RNA, 972 nt, Artificial Sequence
  derived and/or modified CDS sequence (opt1) from CCHFV(VLG/TI29414)__AY179961.1__Gn
agcgaggagcccggcgacgacugcaucucccgcacccagcugcuccgggccgagccggccgagauccacgacgacaacuacgggggccccggggacaagaucaccaucugcaacggcagcacgaucguggaccagcgccugggguccgagcugggcugcuacaccaucaaccgggucaagagcuucaagcucugcgagaacuccgcgaccggcaagaccugcgagaucgacagcacgcccgugaagugccgccagggguucugccugaagaucacccaggagggccgggggcacgugaagcugucccgcggcagcgaggucgugcucgacgccugcgacuccagcugcgaggugaugauccccaaggggaccggcgacauccuggucgacugcuccggcgggcagcagcacuuccugaaggacaaccucaucgaccugggcugcccgcacaucccccugcucgggaagauggccaucuacaucugccggaugagcaaccacccccgcaccacgauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcgccggugaacgccaucgacgccgagaugcacgaccucaacugcuccuacaacaucugccccuacugcgccagccgccugaccuccgacggccuggcgcggcacgucccccagugccccaagcgcaaggagaagguggaggagaccgagcucuaccugaaccuggagcggaucccguggaacgugcgcaagcuccugcaggucagcgaguccacggggguggcccugaagcggagcagcuggcucaucgugcugcugguccuccugaccgugucccugagccccgugcaguccgcccccgucggc

SEQ ID NO: 12319 - RNA, 972 nt, Artificial Sequence
  derived and/or modified CDS sequence (opt1) from CCHFV(TADJ/HU8966)__AY179962.1__Gn
agcgaggaguccggcgacgacugcaucagccgcacccagcugcuccggaccgagacggccgagauccacggggacgacuacggcgggcccggcgacaagaucaccaucugcaacggguccaccaucguggaccagcgccugggcagcgagcugggcugcuacaccaucaaccgggucaaguccuucaagcucugcgagaacagcgccacggggaagaacugcgagaucgacuccgugccggugaagugccgccagggcuacugccugaagaucacccaggaggggcggggccacgucaagcugagccgcggguccgagguggugcucgacgcgugcgacagcuccugcgaggucaugauccccaagggcaccggcgacaucagcguggacugcuccgggggccagcagcacuuccugaaggacaaccugaucgaccucgggugccccaagaucccccugcugggcaagauggccaucuacaucugccggaugagcaaccacccgaagaccacgauggccuuccucuucugguucuccuucggcuacgugaucacccgcauccugugcaaggccaucuucuaccugcucaucaucgucgggacccugggcaagcgguucaagcaguaccgcgagcugaagccccagaccugcacgaucugcgagaccacccccgccaacgcgaucgacgccgagaugcacgaccucaacugcagcuacaacaucugccccuacugcgccucccggcugaccagcgacgggcuggcccgccacgugacgcagugcccgaagcggaaggagcgcguggaggagaccgagcucuaccugaaccuggagcggauccccuggaucguccgcaagcuccuccagguguccgagagcaccggcguggcgcugaagcggagcuccuggcucaucguccugcuggugcuguucaccgugagccugucccccguccagagcgcccccaucggg

SEQ ID NO: 12320 - RNA, 972 nt, Artificial Sequence
  derived and/or modified CDS sequence (opt1) from CCHFV(Hodzha)__AY223476.1__Gn
agcgaggaguccggcgacgacugcaucagccgcacccagcugcuccggaccgagacggccgagauccacggggacgacuacggcgggcccggcgacaagaucaccaucugcaacggguccaccaucguggaccagcgccugggcagcgagcugggcugcuacaccaucaaccgggucaaguccuucaagcucugcaagaacagcgccacggggaaguccugcgagaucgacagcaccccggugaagugccgccagggcuacugccugaagaucacccaggaggggcggggccacgugaagcugucccgcgggagcgaggucgugcucgacgcgugcgacuccagcugcgaggugaugauccccaagggcaccggcgacauccuggucgacugcuccgggggccagcagcacuuccugaaggacaaccucaucgaccuggggugcccccggaucccccugcucggcaagauggccaucuacaucugccgcaugagcaaccacccgaagacgaccauggccuuccuguucugguucuccuucggcuacgugaucacgugcauccugugcaaggccaucuucuaccuccugaucaucguggggacccugggcaagcgguucaagcaguaccgcgagcucaagccccagaccugcaccaucugcgagaccacccccgccaacgcgaucgacgccgagaugcacgaccugaacugcagcuacaacaucugccccuacugcgccucccggcugacgagcgacgggcucgcccgccacgucacccagugcccgaagcggaaggagaagguggaggagaccgagcuguaccugaaccucgagcgcauccccuggaucgugcggaagcugcugcaggucuccgagagcaccggcguggcgcucaagcgcagcuccuggcugaucgugcugcucguccuguucgccgugagccugucccccgugcagagcgcccccaucggg

SEQ ID NO: 12321 - RNA, 972 nt, Artificial Sequence
  derived and/or modified CDS sequence (opt1) from CCHFV(Kosovo/9553/2001)__AY675511.1__Gn
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucgcccggaugagcaaccaccccaagaccaccauggccuuccuguucugguucucccugggcuacgugaucacgugcauccucugcaaggcccuguucuacagccugaucaucaucggcacccucgggaagaagaucaagcaguaccgcgagcugaagccccagaccugcaccaucugcgagaccgcgcccgugaacgccaucgacgccgagaugcacgaccugaacugcuccuacaacaucugcccguacugcgccagccggcucacguccgacggccuggcgcgccacgucaagcagugccccaagcggaaggagaagguggaggagaccgagcuguaccucaaccuggagcgcauccccugggugguccggaagcugcuccaggugagcgaguccaccgggguggcccugaagcgcagcagcuggcugaucguccuccuggugcugcucaccgugucccugagccccguccaguccgccccggugggc

SEQ ID NO: 12322 - RNA, 972 nt, Artificial Sequence
  derived and/or modified CDS sequence (opt1) from CCHFV(SPU41/84)__AY900142.1__Gn
agcgaggaguccagcgacgacugcaucucccgcacccagcugcuccggaccgagacggccgagauccacggcgacaacuacgggggccccggggacaagaucaccaucugcaacggcagcaccguggucgaccagcgccugggguccgagcugggcugcuacaccaucaaccgggugaagacguucaagcucugcgagaacagcgccaccggcaaguccugcgagaucgacagcgugccggucaagugccgccagggguacugccugaagaucacccaggagggccgggggcacgugaagcugucccgcggcagcgaggugguccucgacgcgugcgacaccuccugcgaggugaugauccccaaggggacgggcgacauccugguggacugcagcggcgggcagcagcacuuccugaaggacaaccucaucgaccugggcugccccaagaucccccugcucgggaagauggccaucuacaucugccggauguccaaccacccgaagaccaccauggccuuccuguucugguucagcuucggcuacgucaucacgugcaucaucugcaaggugaucuucuaccugcucaucaucgugggcacccuggggaagcgcuucaagcaguaccgggagcugaagccccagaccugcaccaucugcgagaccacgcccgucaacgccaucgacgccgagaugcacgaccucaacugcuccuacaacaucugccccuacugcgcgagccgccugaccuccgacggccuggcccggcacgugacccagugcccgaagcgcaaggagaagguggaggagaccgagcucuaccugaaccuggagcggauccccugggucgugcgcaagcuccuccaggugagcgaguccacgggggucgcccugaagcggagcagcuggcugguggugcugcugguccuccugaccgugucccugagccccgugcaguccgcccccaucagc

SEQ ID NO: 12323 - RNA, 972 nt, Artificial Sequence
  derived and/or modified CDS sequence (opt1) from CCHFV(UG3010)__AY900143.1__Gn
gccgagggcgugagcaacgacugcgucucccgcacccagcugaucaagaccgagguggccgagauccacgaggacagcuacgggggccccggggagaagaucacgaucugcaacggcuccaccaucguggaccagcggcucgggagcgagcugggcugcuacaccaucaaccgcgucaagaccuacaagcugugcgagaacuccgcgacggagaagggcugcgagaucgacagcgugccggugaagugcaagcagggguucugccucaaggucacccaggagggccgggggcacgugaagcugucccgcggcaccgagaucgugcuggacgucugcgacaccagcugcgagcucaugauccccaaggggacgggcgacauccugguggacugcuccggcgggcagcagcacuuccugcaggacaaccucaucgaccugggcugccccaacgugccccugcucgggaagauggccaucuacaucugccggaugagcaaccacccgaagaccaccauggccuuccuguucugguucuccuucggcuacgucaucacgugcaucgugugcaaggugcuguucuaccuccugaucgucaucggcacccugagcaagaagcucaagcaguaccgcgagcugaagccccagaccugcaucgugugcgaguccacccccgugaacgccaucgacgccgagaugcacgagcugaacugcaacuacaacaucugccccuacugcgcgagccggcucaccuccgacgggcugguccgccacgugaaccagugcccgaagcggaaggagaagguggaggagacggagcuguaccucaaccuggagcgcauccccuggcugguccggcgccuccuccaggugagcgaguccaccggcauggcccugaagcggagcugcuggaugaccacccugcugauccugcucguggucucccugagccccgugcagagcgcccccgucggg

SEQ ID NO: 12324 - RNA, 972 nt, Artificial Sequence
  derived and/or modified CDS sequence (opt1) from CCHFV(Hy13)__AY900145.1__Gn
agcgaggaguccggcgacgacugcaucagccgcacccagcugucccggaccgagacggccgagauccacagcgacaacuacgggggccccggggacaagaucaccaucugcaacggcuccaccaucguggaccagcgccucgggagcgagcugggcugcuacaccaucaaccgggucaaguccuucaagcugugcgagaacagcgccacgggcaaguccugcgagaucgacagcaccccgaucaagugccgccagggguucugccucaagaucacccaggagggccgggggcacgugaagcugucccgcggcagcgaggugguccuggacgcgugcgacuccagcugcgagaucaugauccccaaggggaccggcgacauccucguggacugcuccggcgggcagcagcacuuccugaaggacaaccugaucgaccucggcugccccaacaucccccugcuggggaagauggccaucuacaucugccggaugagcaaccacccgaagacgaccauggccuuccucuucugguucuccuucggcuacgugaucacgugcauccugugcaaggucaucuucuaccugcucaucguggugggcacccuggggaagaaguucaagcaguaccgcgagcugaagccccagaccugcaccaucugcgagaccacccccgucaacgccaucgacgccgagaugcacgaccucaacugcagcuacaacaucugccccuacugcgcgucccggcugacgagcgacggccuggcccgccacgugaugcagugcccgaagcggaaggagaagguggaggagaccgagcucuaccugaaccuggagcgcauccccugggucgugcggaagcuccuccaggugagcgaguccaccggggucgcccugaagcgcagcuccuggcugguggugcugcugguccuccugaccgugagccugucccccgugcagagcgcccccaucggc

SEQ ID NO: 12325 - RNA, 972 nt, Artificial Sequence
  derived and/or modified CDS sequence (opt1) from CCHFV(Semunya)__DQ094832.1__Gn
gccgagggcgugagcaacgacugcgucucccgcacccagcugaucaagaccgagguggccgagauccacgaggacagcuacgggggccccggggagaagaucacgaucugcaacggcuccaccaucguggaccagcggcucgggagcgagcugggcugcuacaccaucaaccgcgucaagaccuacaagcugugcgagaacuccgcgacggagaagggcugcgagaucgacagcgugccggugaagugcaagcagggguucugccucaaggucacccaggagggccgggggcacgugaagcugucccgcggcaccgagaucgugcuggacgucugcgacaccagcugcgagcucaugauccccaaggggacgggcgacauccugguggacugcuccggcgggcagcagcacuuccugcaggacaaccucaucgaccugggcugccccaacgugccccugcucgggaagauggccaucuacaucugccggaugagcaaccacccgaagaccaccauggccuuccuguucugguucuccuucggcuacgucaucacgugcguggugugcaagguccuguucuaccuccugaucgugaucggcacccuggggaagaagcucaagcaguaccgcgagcugaagccccagaccugcaucgugugcgagagcauccccgucaacgccaucgacgccgagaugcacgagcugaacugcaacuacaacaucugccccuacugcgcgucccggcucaccagcgacggccuggugcgccacgugacccagugcccgaagcggaaggagaaggucgaggagacggagcuguaccucaaccuggagcgcauccccuggcuggugcggcgccuccuccagguguccgagagcaccgggauggcccugaagcgguccugcuggaugaccacccugcugauccugcucgucgugagccugucccccguccagagcgcccccgugggc

SEQ ID NO: 12326 - RNA, 972 nt, Artificial Sequence
  derived and/or modified CDS sequence (opt1) from CCHFV(SPU128/81/7)__DQ157174.1__Gn
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggucaaguccuucaagcucugcgagaacagcgccacgggcaaguccugcgagaucgagagcgugcccgugaagugccgccagggguacugccugcggaucacccaggagggccgcgggcacgucaagcugucccggggcagcgagguggugcucgacgcgugcgacaccuccugcgagaucaugauccccaaggggaccggcgacauccuggucgacugcagcggcgggcagcagcacuuccugaaggacaaccucaucgaccugggcugccccaagaucccgcugcucgggaagauggccaucuacaucugccgcauguccaaccaccccaagacgaccauggccuuccuguucugguucagcuucggcuacgugaucacgugcauccugugcaaggccaucuucuaccuccugaucaucaucggcacccuggggaagcgguucaagcaguaccgcgagcucaagccccagaccugcaccaucugcgagaccacccccgugaacgccaucgacgcggagaugcacgaccugaacugcuccuacaacaucugcccguacugcgccagccggcugacguccgacggccucgcccgccacgucacccagugccccaagcggaaggagaagguggaggagaccgagcuguaccugaaccucgagcgcauccccugggugguccggaagcugcuccaggugagcgaguccaccgggguggcccugaagcgcagcagcuggcugaucguccugcucgugcuguucacggugucccugagccccguccaguccgcgccgaucggc

SEQ ID NO: 12327 - RNA, 972 nt, Artificial Sequence
  derived and/or modified CDS sequence (opt1) from CCHFV(ROS/HUVLV-100)__DQ206448.1__Gn
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugaccgugucccugagcccggugcaguccgcccccgucggc

SEQ ID NO: 12328 - RNA, 972 nt, Artificial Sequence
  derived and/or modified CDS sequence (opt1) from CCHFV(AP92)__DQ211625.1__Gn
agcgagggcggggacggcgggugcaucucccgcacccagcugaucaagaccgagacggccgaggugcacggcgacgacuacgggggccccggcgagaagaucaccaucugcaacgggagcaccaucgucgaccagcggcucggcuccgagcuggggugcuacaccaucaaccgcaucaagagcuucaagcugugcgagaacuccgcccagggcaagaacugcgagaucgacagcgcgccggugcagugccggcagggguacugccucaagaucucccaggagggccgcggccacgugaagcugagccggggguccgagaucguccuggacgugugcgacacgagcugcgagaucaugauccccaagggcaccggggacauccucguggacugcuccggcggccagcagcacuuccugcagagcaaccuggucgaccucgggugccccaacaucccccugcugggcaagauggccaucuacaucugccgcauguccaaccacccgaagaccaccauggccuuccucuucugguucagcuucggguacgugaucacgugcauccugugcaagacccuguucuacauccucaucaucaucggcacccuggggaagaagcugaagcaguaccgggagcucaagccccagaccugcacgaucugcgaguccgugcccgucaacgccaucgacgccgagaugcacgaccugaacugcagcuacaacaucugccccuacugcgcgucccgccugaccagcgagggccucacccggcacgugaaccagugcccgaagcgcaaggagaagguggaggagaccgagcuguaccugaaccucgagcggauccccuggaucguccgcaagcugcuccagguguccgagagcacgggcguggcccugaagcggagcuccuggaugaucguccugcugauccuccugaucgugagcaugucccccgugcagagcgcccccaucucc

SEQ ID NO: 12329 - RNA, 972 nt, Artificial Sequence
  derived and/or modified CDS sequence (opt1) from CCHFV(ArD8194)__DQ211626.1__Gn
gccgagggcgggagcaacgacugcgugucccgcacccagcuggucaagaccgagguggccgagauccacgaggacagcuacggcgggcccggcgagaagaucacgaucugcaacggguccaccaucguggaccagcggcucggcagcgagcugggcugcuacaccaucaaccgcguccggaccuacaagcugugcgagaacuccgcgacggagaaguccugcgagaucgacagcgugccggugaagugcaagcagggguucugccucaagaucacccaggagggccgcgggcacgucaagcugagccggggcaccgagaucgugcuggacgugugcgacaccuccugcgagcucaugauccccaaggggacgggcgacauccuggucgacugcagcggcgggcagcagcacuuccugcaggacaaccucaucgaccugggcugccccaacaucccccugcucgggcgcaccgccaucuacgugugccggauguccaaccacccgaagaccaccauggccuuccuguucugguucagcuucggcuacgugaucacgugcgucgugugcaaggugcuguucuaccuccugaucgucaucggcacccuggggaagcgccucaagcaguaccgggagcugaagccccagaccugcaucgugugcgaguccauccccgugaacgccaucgacgccgagaugcacgaccugaacugcaacuacaacaucugccccuacugcgcgagccgccucaccuccgacggccugguccggcacgugacgcagugcccgaagcgcaaggagaagguggaggagaccgagcuguaccucaaccuggagcggauccccuggcugguccgcaagcuccuccaggugagcgaguccaccgggguggcccugaagcggagcugcuggaugaucacccugcugauccugcucacggucuccaugagccccgugcagagcgcccccgucggc

SEQ ID NO: 12330 - RNA, 972 nt, Artificial Sequence
  derived and/or modified CDS sequence (opt1) from CCHFV(ArD15786)__DQ211627.1__Gn
gccgagggcgggagcaacgacugcgugucccgcacccagcuggucaagaccgaggugacggagauccacgaggacagcuacggcgggcccggcgagaagaucaccaucugcaacggguccaccaucguggaccagcggcucggcagcgagcugggcugcuacaccaucaaccgcguccggacguacaagcugugcgagaacuccgccaccgagaaguccugcgagaucgacagcgugccggugaagugcaagcagggguucugccucaagaucacccaggagggccgcgggcacgucaagcugagccggggcaccgagaucgugcuggacgugugcgacacguccugcgagcucaugauccccaaggggaccggcgacauccuggucgacugcagcggcgggcagcagcacuuccugcaggacaaccucaucgaccugggcugccccaacaucccccugcucgggcagaccgcgaucuacgugugccgcauguccaaccacccgaagaccacgauggccuuccuguucugguucagcuucggcuacgugaucacgugcgucgugugcaaggugcuguucuaccuccugaucgucaucggcacccuggggaagcggcucaagcaguaccgcgagcugaagccccagaccugcaucgugugcgaguccauccccgugaacgccaucgacgccgagaugcacgaccugaacugcaacuacaacaucugccccuacugcgccagccggcucaccuccgacggccugguccgccacgugacccagugcccgaagcggaaggagaagguggaggagaccgagcuguaccucaaccuggagcgcauccccuggcugguccggaagcuccuccaggugagcgaguccaccgggguggcgcugaagcgcagcugcuggaucaucacgcugcugauccugcucaccgucuccaugagccccgugcagagcgcccccgucggc

SEQ ID NO: 12331 - RNA, 972 nt, Artificial Sequence
  derived and/or modified CDS sequence (opt1) from CCHFV(ArD39554)__DQ211628.1__Gn
agcgaguccaacaacaacgacugcgugagccgcacccagcugaucaagaccgagaacgccgagauccacggcgacgacuacgggggccccggggagaagaucacgaucugcaacggcuccaccaucgucgagcagcggcucgggagcgagcugggcugcuacaccaucaaccgcaucaaguccuucaagcugugcgagaacagcgccuccggcaaggggugcgagaucgacagcaccccggugaagugcaagcagggcuucugccucaagaucacgcaggaggggcggggccacgugaagcugucccgcgggagcgagaucauccuggacgucugcgacuccagcugcgagaugaugauccccaagggcuccggcgacauccucguggacugcagcgggggccagcagcacuuccugcaggacaaccugguggaccucgggugccccaacgucccccugcugggcaagauggcgaucuacaucugccggauguccaaccacccgaagaccaccauggccuuccucuucugguucagcuucggcuacgugaucacgugcaucuucugcaaggugaucuucuacguccugaucaucaucgggacccugggcaagcgcaucaagcaguaccgggagcucaagccccagaccugcaccaucugcgaggccacccccgugaacgccaucgacgccgagaugcacgaccugaacugcuccuacaacaucugccccuacugcgcgagccgccugacguccgaggggcucgugcggcacgucacccagugcccgaagcgcaaggagaagaucgaggagaccgagcuguaccugaaccucgagcggauccccugguucgugcgcaagcugcuccaggugagcgagagcaccggcgucgcccugaagcgguccagcuggcuggugacgcugcucgugcugcugaccgucucccucagccccgugcaguccgcccccaucggg

SEQ ID NO: 12332 - RNA, 972 nt, Artificial Sequence
  derived and/or modified CDS sequence (opt1) from CCHFV(Drosdov)__DQ211630.1__Gn
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgugaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaagugcuccuacaacaucugcccguacugcgccagccggcugacguccgacggccuggcccgccacgucacccagugccccaagcggaaggagaagguggaggagaccgagcucuaccugaaccuggagcgcauccccuggaucgugcggaagcuccugcaggucagcgaguccaccgggguggcgcugaagcgcagcagcuggcucaucgugcugcugguccuccugacggugucccugagccccgugcaguccgccccggucggc

SEQ ID NO: 12333 - RNA, 972 nt, Artificial Sequence
  derived and/or modified CDS sequence (opt1) from CCHFV(Oman)__DQ211632.1__Gn
agcgaggaguccggcgaggacugcaucagccgcacccagcugcuccggaccgagacggccgagauccacggggacaacuacggcgggcccggcgacaagaucaccaucugcaacggguccaccaucguggaccagcgccugggcagcgagcugggcugcuacaccaucaaccgggucaaguccuucaagcucugcgagaacagcgccacggggaaguccugcgagaucgacaacaccccggugaagugcaagcagggcuucugccugaagaucacccaggaggggcgcggccacgugaagcugagccgggacuccgaggucgugcucgacgcgugcgacagcuccugcgagaucaugauccccaaggggaccggcgacauccugguggacugcagcggcgggcagcagcacuuccugaaggacaaccucaucgaccugggcugccccaacaucccccugcucgggaagauggccaucuacaucugccgcauguccaaccacccgaagacgaccauggccuuccuguucugguucagcuucggcuacgucaucacgugcauccugugcaaggugaucuucuaccuccugaucguggucggcacccuggggaagaaguucaagcaguaccgggagcucaagccccagaccugcaccaucugcgagaccacccccgugaacgccaucgacgccgagaugcacgaccugaacugcuccuacaacaucugccccuacugcgcgagccgccugacguccgacggccucgcccggcacgugaugcagugcccgaagcgcaaggagaagaucgaggagaccgagcuguaccugaaccucgagcggauccccugggucgugcgcaagcugcuccaggugagcgaguccaccggggucgcccugaagcggagcagcuggcugaucgugcugcucgugcugcugaccgucucccucagccccgugcaguccgcccccaucggc

SEQ ID NO: 12334 - RNA, 972 nt, Artificial Sequence
  derived and/or modified CDS sequence (opt1) from CCHFV(SPU97/85)__DQ211633.1__Gn
agcgaggaguccgacggcgacugcaucagccgcacccagcugcuccggaccgagacggccgagauccacuccgacaacuacgggggccccggggacaagaucaccaucugcaacggcagcaccaucguggaccagcgccugggguccgagcugggcugcuacaccaucaaccgggucaagagcuucaagcucugcgagaacuccgccacgggcaagagcugcgagaucgacuccaccccggugaagugccgccagggguucugccugaagaucacccaggagggccgggggcacgugaagcugagccgcggcuccgagaucguccucgacgcgugcgacagcuccugcgagaucaugauccccaaggggaccggcgacauccugguggacugcagcggcgggcagcagcacuuccugaaggacaaccucaucgaccugggcugccccaacaucccccugcucgggcggauggccaucuacaucugccgcauguccaaccacccgaagacgaccauggccuuccuguucugguucagcuucggcuacgugaucacgugcauccugugcaaggucaucuucuaccuccugaucguggccggcaccguggggaagaaguucaagcaguaccgggagcugcgcccccagaccugcaccaucugcgagaccacccccgucaacgccaucgacgcggagaugcacgaccucaacugcuccuacaacaucugccccuacugcgccagccggcugacguccgacggccuggcccgccacgugaugcagugcccgaagcggaaggagaagaucgaggagaccgagcucuaccugaaccuggagcgcauccccugggugguccggaagcuccuccaggugagcgagagcaccgggguggcccugaagcgcuccagcuggcugaccguccugcuggugcuccugaucgugucccugagccccguccaguccgcgcccaucggc

SEQ ID NO: 12335 - RNA, 972 nt, Artificial Sequence
  derived and/or modified CDS sequence (opt1) from CCHFV(SPU103/87)__DQ211634.1__Gn
agcgaggaguccagcgacgacugcaucucccgcacccagcugcuccggaccgagacggccgagauccacggcgacaacuacgggggccccggggacaagaucaccaucugcaacggcagcaccaucguggaccagcgccugggguccgagcugggcugcuacaccaucaaccgggucaagacguucaagcucugcgagaacagcgccaccggcaaguccugcgagaucgacagcgugccggugaagugccgccagggguacugccugaagaucacccaggagggccgggggcacgucaagcugucccgcggcagcgagguggugcucgacgcgugcgacaccuccugcgaggucaugauccccaaggggacgggcgacauccugguggacugcagcggcgggcagcagcacuuccugaaggacaaccucaucgaccugggcugccccaagaucccccugcucgggaagauggccaucuacaucugccggauguccaaccacccgaagaccaccauggccuuccuguucugguucagcuucggcuacgugaucacgugcguccugugcaaggccaucuucuaccuccugaucaucgugggcacccuggggaagcgccucaagcaguaccgggagcugaagccccagaccugcaccaucugcgagaccacgcccgugaacgccaucgacgcggagaugcacgaccugaacugcuccuacaacaucugccccuacugcgccagccgccucaccuccgacggccuggcccggcacgucacccagugcccgaagcgcaaggagaagguggaggagaccgagcuguaccucaaccuggagcggauccccugggugguccgccggcugcuccaggugagcgaguccacggggguggcccugaagcgcagcagcuggcugaucguccuccuggugcuguucaccgugucccucagccccguccaguccgcgcccaucagc

SEQ ID NO: 12336 - RNA, 972 nt, Artificial Sequence
  derived and/or modified CDS sequence (opt1) from CCHFV(SPU415/85)__DQ211635.1__Gn
agcgaggaguccgacggcgacugcaucagccgcacccagcugcuccggaccgagacgaccgagauccacuccgacaacuacgggggccccggggacaagaucaccaucugcaacggcagcaccaucguggaccagcgccugggguccgagcugggcugcuacacgaucaaccgggucaagagcuucaagcucugcgagaacuccgccaccggcaagagcugcgagaucgacuccaccccggugaagugccgccagggguucugccugaagaucacccaggagggccgggggcacgugaagcugagccgcggcuccgagaucguccucgacgccugcgacagcaacugcgagaucaugauccccaaggggacgggcgacauccugguggacugcuccggcgggcagcagcacuuccugaaggacaaccucaucgaccugggcugccccaacaucccccugcucgggaagauggcgaucuacaucugccggaugagcaaccacccgaagaccaccauggccuuccuguucugguucuccuucggcuacgugaucacgugcauccugugcaaggucaucuucuaccuccugaucguggccggcaccguggggaagaaguucaagcaguaccgcgagcugcggccccagaccugcaccaucugcgagaccauccccgucaacgccaucgacgccgagaugcacgaccucaacugcagcuacaacaucugccccuacugcgcgucccgccugacgagcgacggccuggcccggcacgugaugcagugcccgaagcgcaaggagaagguggaggagaccgagcucuaccugaaccuggagcggauccccugggucgugcgcaagcuccuccagguguccgagagcaccggggucgcccugaagcggagcuccuggcugaccgugcugcuggugcuccugaucgucagccugucccccgugcagagcgcccccaucggc

SEQ ID NO: 12337 - RNA, 972 nt, Artificial Sequence
  derived and/or modified CDS sequence (opt1) from CCHFV(Turkey200310849)__DQ211636.1__Gn
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagguggacagcacccccgugaagugccgccagggguucugccugaagaucacccaggagggccgggggcacgucaagcugucccgcggcagcgagguggugcucgacgcgugcgacuccagcugcgaggucaugauccccaaggggacgggcgacauccugguggacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucagcugcaaggcccuguucuacucccucaucaucaucggcacccuggggaagaagaucaagcaguaccgggagcugaagccccagaccugcaccaucugcgagaccgcccccgucaacgcgaucgacgccgagaugcacgaccucaacugcagcuacaacaucugcccguacugcgccucccgccugacgagcgacggccuggcccggcacgugacccagugccccaagcgcaaggagaagguggaggagaccgagcucuaccugaaccuggagcggauccccuggaucguccgcaagcuccuccagguguccgagagcaccgggguggcgcugaagcggagcuccuggcugaucguccugcuggugcuccugacggugagccugucccccguccagagcgccccggugggc

SEQ ID NO: 12338 - RNA, 972 nt, Artificial Sequence
  derived and/or modified CDS sequence (opt1) from CCHFV(Kosova Hoti)__EU037902.1__Gn
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccagaagggccgggggcacgugaagcugucccgcggcagcgaggucgugcucgacgcgugcgacuccaacugcgaggugaugauccccaaggggacgggcgacauccuggucgacugcagcggcgggcagcagcacuuccugaaggacaaccucaucgaccugggcugcccccacaucccgcugcucgggaagauggccaucuacaucugccggauguccaaccaccccaagaccaccauggccuuccuguucugguucagcuucggcuacgugaucacgugcaucuucugcaaggcccuguucuacucccucaucaucaucggcacccuggggaagaagaucaagcaguaccgcgagcugaagccccagaccugcaccaucugcgagaccgcccccgugaacgcgaucgacgccgagaugcacgaccucaacugcagcuacaacaucugcccguacugcgccucccggcugacgagcgacggccuggcccgccacgucaagcagugccccaagcggaaggagaagguggaggagaccgagcucuaccugaaccuggagcgcauccccugggugguccggaagcuccuccagguguccgagagcaccgggguggcgcugaagcgcuccagcuggcugaucguccugcuggugcuccugaccgugagccugucccccguccagagcgccccggugggc

SEQ ID NO: 12339 - RNA, 972 nt, Artificial Sequence
  derived and/or modified CDS sequence (opt1) from CCHFV(YL04057)__FJ562094.1__Gn
gccgagggcgggagcuccgacugcaucagccgcacccagcuggugaagaccgaggucgccgagauccacgaggacuccuacggcgggcccggcgagaagaucacgaucugcaacgggagcaccaucguggaccagcggcucggccgcgagcugggcugcuacaccaucaaccgggugcgcuccuacaagcugugcgagaacagcgcguccggcaagagcugcgagaucgacuccaucccggucaagugcaagcagggguucugccucaagaucacccaggaggggcggggccacgugaagcugagccgcgggacggagaucgugcuggacgucugcgacuccagcugcgagcucaugauccccaagggcaccggcgacauccugguggacugcuccgggggccagcagcacuuccugcagaacaaccucaucgaccuggggugccccaacgugccccugcucggcaagauggccaucuacgucugccggaugagcaaccacccgaagaccaccauggccuuccuguucugguucuccuucggcuacgugaucacgugcaucgccugccgcgugcuguucuaccuccugaucgccaucgggaccgucggcaagaagcugaagcaguaccgggagcucaagccccagaccugcaucgugugcgagagcgugcccgucaacgcgaucgacgccgagaugcacgagcugaacugcuccuacaacaucugccccuacugcgccagccgccuguccaccgacgggcucauccggcacgugacgcagugcccgaagcgccgggagaagguggaggagaccgagcuguuccugaaccucgagcgcauccccuggcugguccggaagcugcuccaggugagcgagagcaccggcauggcccugaagcgcuccugcuggaugaucacccugcucauccugcugcucgugagcaucucccccguccagagcgcgcccgugggg

SEQ ID NO: 12340 - RNA, 972 nt, Artificial Sequence
  derived and/or modified CDS sequence (opt1) from CCHFV(V42/81)__GU477490.1__Gn
agcaaggagcccggcgacgacugcaucucccgcacccagcugaugcggaccgagacggccgagauccacgacgacaacuacgggggcccgggggacaagaucaccaucugcaacggcagcaccaucguggaccagcgccucggguccgagcugggcugcuacaccaucaaccgggucaagagcuucaagcugugcgagaacuccgccacgggcaaggcgugcgagguggacagcacccccgugaagugccgccagggguucugccucaagaucacccaggagggccgggggcacgucaagcugucccgcggcagcgagguggugcuggacgccugcgacuccagcugcgaggucaugauccccaaggggaccggcgacauccucguggacugcuccggcgggcagcagcacuuccugaaggacaaccugaucgaccucgagugcccccacaucccgcugcugggcaagcucgccaucuacaucugccggaugagcaaccacccccgcacgaccauggccuuccuguucugguucggguucggcuacgugaucacgugcauccugugcaaggcccucuucuacucccugaucaucaucggcacccuggggaagaagaucaagcaguaccgggagcucaagccccagaccugcaccaucugcgagaccgcgcccgucaacgccaucgacgccgagaugcacgaccugaacugcagcuacaacaucugcccguacugcgccucccgccugaccagcgacggccucgcgcggcacgugacgcagugccccaagcgcaaggagaagguggaggagaccgagcuguaccugaaccucgagcggauccccuggaucguccgcaagcugcuccagguguccgagagcaccggggugguccugaagcgguccagcuggcugaucgugcugcucgugcugcugaccgucagccucucccccgugcagagcgccccggugggc

SEQ ID NO: 12341 - RNA, 972 nt, Artificial Sequence
  derived and/or modified CDS sequence (opt1) from CCHFV(Afg09-2990)__HM452306.1__Gn
agcgaggaguccggcgacgacugcaucagccgcacccagcugcuccggaccgagacggccgaggugcacggggacaacuacggcgggcccggcgacaagaucaccaucugcaacggguccaccgucguggaccagcgccugggcagcgagcugggcugcuacaccaucaaccgggugcgcuccuucaagcucugcgagaacagcgccacggggaaguccugcgagaucgacagcaucccggucaagugcaagcagggcuacugccugaagaucacccaggaggggcggggccacgugaagcugucccgcgggagcgaggugguccucgacgugugcgacuccagcugcgaggugaugauccccaagggcaccggcgacauccuggucgacugcuccgggggccagcagcacuaccugaaggacaaccucguggaccuggggugccccaagaucccccugcucggcaagauggcgaucuacaucugccggaugagcaaccacccgaagaccacgauggccuuccuguucugguucuccuucggcuacgugaucacgugcauccugugcaaggccaucuucuuccuccugaucaucuucgggacccugggcaagcgcuucaagcaguaccgggagcucaagccccagaccugcaccaucugcgagaccacccccgucaacgccaucgacgccgagaugcacgaccugaacugcagcuacaacaucugccccuacugcgcgucccgccugaccagcgacgggcucgcccggcacgugacgcagugcccgcgccggaaggagaagguggaggagaccgagcuguaccugaaccucgagcgcauccccugggucgugcggaagcugcuccagguguccgagagcaccggcaccguccugaagcgcagcuccuggcugaucgugcugcucgugcuguucacggucagccugucccccgugcagagcgcccccaucggg

SEQ ID NO: 12342 - RNA, 972 nt, Artificial Sequence
  derived and/or modified CDS sequence (opt1) from CCHFV(Sudan Al-Fulah 3-2008)__HQ378184.1__Gn
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggucaaguccuucaagcucugcgagaacagcgccacgggcaaguccugcgugaucgacagcgugcccgucaagugccgccagggguacugccugcggaucacccaggagggccgcgggcacgugaagcugucccggggcagcgaggugguccucgacgcgugcgacaccuccugcgagaucaugauccccaaggggaccggcgacauccugguggacugcagcggcgggcagcagcacuuccugaaggacaaccucguggaccugggcugccccaagaucccgcugcucgggaagauggccaucuacaucugccgcauguccaaccaccccaagacgaccauggccuuccuguucugguucagcuucggcuacgucaucacgugcauccugugcaaggccaucuucuaccuccugaucaucaucggcacccuggggaagcgguuccgccaguaccgggagcucaagccccagaccugcaccaucugcgagaccacccccgugaacgccaucgacgcggagaugcacgaccugaacugcuccuacaacaucugcccguacugcgccagccgccugacguccgacggccucgcccggcacgugacccagugccccaagcgcaaggagaaggucgaggagaccgagcuguaccugaaccucgagcggauccccuggguggugcgcaagcugcugcaggucagcgaguccaccgggguggcccucaagcggagcagcuggcugaucgugcugcucguccuguucacggugucccugagccccgugcaguccgcgccgaucggc

SEQ ID NO: 12343 - RNA, 972 nt, Artificial Sequence
  derived and/or modified CDS sequence (opt1) from CCHFV(Sudan AB1-2009)__HQ378187.1__Gn
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggucaaguccuucaagcucugcgagaacagcgccacgggcaagaacugcgagaucgacuccgugcccgugaagugccgccagggguacugccugcggaucacccaggagggccgcgggcacgucaagcugagccggggcuccgagguggugcucgacgcgugcgacaccagcugcgagaucaugauccccaaggggaccggcgacauccuggucgacugcuccggcgggcagcagcacuuccugaaggacaaccucaucgaccugggcugccccaagaucccgcugcucgggaagauggccaucuacaucugccgcaugagcaaccaccccaagacgaccauggccuuccuguucugguucuccuucggcuaccugaucacgugcauccucugcaaggccaucuucuaccugcugaucaucaucggcacccucgggaagcggcugaagcaguaccgcgagcugaagccccagaccugcaccaucugcgagaccacccccgugaacgccaucgacgcggagaugcacgaccucaacugcagcuacaacaucugcccguacugcgccucccggcugacgagcgacggccuggcccgccacgugauccagugccccaagcggaaggagaaggucgaggagaccgagcucuaccugaaccuggagcgcauccccuggguggugcggaagcuccugcaggucuccgagagcaccgggguggcccugaagcgcuccagcuggcucaucgugcugcugguccucuucaccgugagccugucccccgugcagagcgcgccgaucggc

SEQ ID NO: 12344 - RNA, 972 nt, Artificial Sequence
  derived and/or modified CDS sequence (opt1) from CCHFV(NIVA 118595)__JN572083.1__Gn
agcgaggaguccggcgacgacugcaucagccgcacccagcugcuccggaccgagacggccgaggugcacggggacaacuacggcgggcccggcgacaagaucaccaucugcaacggguccaccgucguggaccagcgccugggcagcgagcugggcugcuacaccaucaaccgggugaaguccuucaagcucugcgagaacagcgccacggggaaguccugcgagaucgacagcaucccggucaagugccgccagggcuacugccugaagaucacccaggaggggcggggccacgugaagcugucccgcgggagcgaggugguccucgacgcgugcgacuccagcugcgaggugaugauccccaagggcaccggcgacauccugguggacugcuccgggggccagcagcacuuccugaaggacaaccucaucgaccuggggugccccaagaucccccugcucggcaagauggccaucuacaucugccggaugagcaaccacccgaagaccacgauggccuuccuguucugguucuccuucggcuacgucaucacgugcauccugugcaaggugaucuucuaccuccugaucaucuucgggacccugggcaagcgcuucaagcaguaccgggagcucaagccccagaccugcaccaucugcgagaccacccccgugaacgccaucgacgccgagaugcacgaccugaacugcagcuacaacaucugccccuacugcgcgucccgccugaccagcgacgggcucgcccggcacgucacgcagugcccgaagcgcaaggagaagguggaggagaccgagcuguaccugaaccucgagcggauccccugggugguccgcaagcugcuccagguguccgagagcaccggcaucgcccugaagcggagcuccuggcugaucgugcugcucguccuguucaccgugagcaucacgcccgugcaguccgcccccaucggg

SEQ ID NO: 12345 - RNA, 972 nt, Artificial Sequence
  derived and/or modified CDS sequence (opt1) from CCHFV(SCT ex Afghanistan)__KC344856.1__Gn
agcgaggaguccggcgacgacugcaucagccgcacccagcugcuccggaccgagacggccgaggugcacaacgacaacuacgggggccccggggacaagaucaccaucugcaacggcuccaccaucgucgaccagcgccuggggagcgagcugggcugcuacaccaucaaccgggugaaguccuucaagcucugcgagaacagcgccacgggcaaguccugcaagaucgacagcaccccggugaagugccgccagggguucugccugaagaucacccaggagggccgggggcacgucaagcugucccgcggcagcgagguggugcucgacgcgugcgacuccagcugcgagaucaugauccccaaggggaccggcgacauccuggucgacugcuccggcgggcagcagcacuuccugaaggacaaccucaucgaccugggcugccccaacaucccccugcucgggaagauggccaucuacaucugccggaugagcaaccacccgaagacgaccauggccuuccuguucugguucuccuucggcuacgugaucacgugcaucuucugcaaggugaucuucuaccugcucaucgucgugggcacccuggggaagaaguucaagcaguaccgcgagcugaagccccagaccugcaccaucugcgagaccacccccacgaacgccaucgacgccgagaugcacgaccucaacugcagcuacaacaucugccccuacugcgcgucccggcugaccagcgacggccuggcccgccacgugacccagugcccgaagcggaaggagaaggucgaggagaccgagcucuaccugaaccuggagcgcauccccuggaucgugcggaagcuccuccagguguccgagagcacgggggucgcccugaagcgcagcuccuggcugaucgugcugcuggugcuccugaccgucagccugucccccgugcagagcgcccccaucggc

SEQ ID NO: 12346 - RNA, 972 nt, Artificial Sequence
  derived and/or modified CDS sequence (opt1) from CCHFV(Zahedan 2007)__KC867273.1__Gn
agcgaggaguccggcgacgacugcaucagccgcacccagcugcuccggaccgagacggccgaggugcacggggacaacuacggcgggcccggcgacaagaucaccaucugcaacggguccaccgucguggaccagcgccugggcagcgagcugggcugcuacaccaucaaccgggugcgcuccuucaagcucugcgagaacagcgccacggggaaguccugcgagaucgacagcaucccggucaagugcaagcagggcuucugccugaagaucacccaggaggggcggggccacgugaagcugucccgcgggagcgaggugguccucgacgugugcgacuccagcugcgaggugaugauccccaagggcaccggcgacauccuggucgacugcuccgggggccagcagcacuuccugaaggacaaccucguggaccuggggugccccaagaucccccugcucggcaagauggcgaucuacaucugccggaugagcaaccacccgaagaccacgauggccuuccuguucugguucuccuucggcuacgugaucacgugcauccugugcaaggccaucuucuuccuccugaucaucuucgggacccugggcaagcgcuucaagcaguaccgggagcucaagccccagaccugcaccaucugcgagaccacccccgucaacgccaucgacgccgagaugcacgaccugaacugcagcuacaacaucugccccuacugcgcgucccgccugaccagcgacgggcucgcccggcacgugacgcagugcccgcgccggaaggagaagguggaggagaccgagcuguaccugaaccucgagcgcauccccugggucgugcggaagcugcuccagguguccgagagcaccggcaccguccugaagcgcagcuccuggcugaucgugcugcucgugcuguucacggucagccugucccccgugcagagcgcccccaucggg

SEQ ID NO: 12347 - RNA, 972 nt, Artificial Sequence
  derived and/or modified CDS sequence (opt1) from CCHFV(SPU 44/08)__KJ682805.1__Gn
agcgaggaguccaacgacgacugccugagccgcacccagcuccugcggaccgagaacgccgagauccacuccgacaacuacggcgggcccggcgacaagaucacgaucugcaacgggagcaccaucguggaccagcgccugggcuccgagcucgggugcuacaccaucaaccgggucaagagcuucaagcugugcgagaacuccgccaccggcaagagcugcgagaucgacuccacgccggugcgcugccggcagggcuucugccugaagaucacccaggaggggcgcggccacgugaagcucagccggggguccgaggucgugcuggacgcgugcgacagcuccugcgagaucaugauccccaagggcaccggggacauccugguggacugcagcggcggccagcagcacuuccucaaggacaaccuggucgaccuggggugccccaacaucccccuccugggcaagauggccaucuacaucugccgcauguccaaccacccgaagaccacgauggccuuccuguucugguucagcuucggguacgugaucacgugcauccucugcaaggccaucuucuaccugcugaucguggucggcacccucggcaagaaguucaagcaguaccgggagcugaagccccagaccugcaccaucugcgagaccaaccccgugaacgccaucgacgcggagaugcacgaccugaacugcuccuacaacaucugccccuacugcgccagccgccucaccuccgacgggcuggcccggcacgugaugcagugcccgaagcgcaaggagaagaucgaggagaccgagcuguaccucaaccuggagcggauccccugggucgugcgcaagcugcuccaggugagcgagagcacgggcgucgcccugaagcgguccagcuggcuggugauccuccuggugcugcucaccgucucccugagccccgugcaguccgcgcccaucagc

SEQ ID NO: 12348 - RNA, 972 nt, Artificial Sequence
  derived and/or modified CDS sequence (opt1) from CCHFV(SPU 383/87)__KJ682806.1__Gn
agcgaggaguccaacgacgacugccugagccgcacccagcuccugcggaccgagaacgccgagauccacuccgacaacuacggcgggcccggcgacaagaucacgaucugcaacgggagcaccaucguggaccagcgccugggcuccgagcucgggugcuacaccaucaaccgggucaagagcuucaagcugugcgagaacuccgccaccggcaagagcugcgagaucgacuccacgccggugcgcugccggcagggcuucugccugaagaucacccaggaggggcgcggccacgugaagcucagccggggguccgaggucgugcuggacgcgugcgacagcuccugcgagaucaugauccccaagggcaccggggacauccugguggacugcagcggcggccagcagcacuuccucaaggacaaccuggucgaccuggggugccccaacaucccccuccugggcaagauggccaucuacaucugccgcauguccaaccacccgaagaccacgauggccuuccuguucugguucagcuucggguacgugaucacgugcauccucugcaaggugaucuucuaccugcuggucguggugggcacccucggcaagaaguucaagcaguaccgggagcugaagccccagaccugcaccaucugcgagaccaaccccgucaacgccaucgacgccgagaugcacgaccugaacugcuccuacaacaucugccccuacugcgcgagccgccucaccuccgacgggcuggcccggcacgugauccagugcccgaagcgcaaggagaagaucgaggagaccgagcuguaccucaaccuggagcggauccccugggugguccgcaagcugcuccaggugagcgagagcacgggcguggcccugaagcgguccagcuggcuggucauccuccuggugcugcucaccgugucccugagccccguccaguccgcccccaucagc

SEQ ID NO: 12349 - RNA, 972 nt, Artificial Sequence
  derived and/or modified CDS sequence (opt1) from CCHFV(SPU 130/89)__KJ682807.1__Gn
agcgaggagcccaacuacgacugccugucccgcacccagcuccugcggaccgagaacgccgagauccacagcgacaacuacggcgggccgggcgacaagaucacgaucugcaacggguccaccaucguggaccagcgccugggcagcgagcucgggugcuacaccaucaaccgggucaaguccuucaagcugugcgagaacagcgccaccggcaaguccugcgagaucgacagcacgcccgugcgcugccggcagggcuucugccugaagaucacccaggaggggcgcggccacgugaagcucucccgggggagcgaggucgugcuggacgcgugcgacuccagcugcgagaucaugauccccaagggcaccggggacauccugguggacugcuccggcggccagcagcacuuccucaaggacaaccuggucgaccuggggugccccaacaucccgcuccugggcaagauggccaucuacaucugccgcaugagcaaccaccccaagaccacgauggccuuccuguucugguucuccuucggguacgugaucacgugcauccucugcaaggugaucuucuaccugcugaucgucgugggcacccucggcaagaaguucaagcaguaccgggagcugaagccccagaccugcaccaucugcgagaccaaccccgugaacgccaucgacgccgagaugcacgaccugaacugcagcuacaacaucugcccguacugcgcgucccgccucaccagcgacgggcuggcccggcacgucaugcagugccccaagcgcaaggagaagaucgaggagaccgagcuguaccucaaccuggagcggauccccuggguggugcgcaagcugcuccaggucuccgagagcacgggcguggcccugaagcggagcuccuggcuggugguccuccuggugcugcucaccgugagccugucccccguccagagcgccccgaucucc

SEQ ID NO: 12350 - RNA, 972 nt, Artificial Sequence
  derived and/or modified CDS sequence (opt1) from CCHFV(SPU 497/88)__KJ682808.1__Gn
agcgaggaguccaacgacgacugccugagccgcacccagcuccugcggaccgagaacgccgagauccacuccgacaacuacggcgggcccggcgacaagaucacgaucugcaacgggagcaccaucguggaccagcgccugggcuccgagcucgggugcuacaccaucaaccgggucaagagcuucaagcugugcgagaacuccgccaccggcaagagcugcgagaucgacuccacgccggugcgcugccggcagggcuucugccugaagaucacccaggaggggaagggccacgugaagcucagccgcggguccgaggucgugcuggacgcgugcgacagcuccugcgagaucaugauccccaagggcaccggggacauccugguggacugcagcggcggccagcagcacuuccucaaggacaaccuggucgaccuggggugccccaacaucccccuccugggcaagauggccaucuacaucugccggauguccaaccacccgaagaccacgaugguguuccuguucugguucagcuucggguacgugaucacgugcauccucugcaaggucaucuucuaccugcugaucguggugggcacccucggcaagaaguucaagcaguaccgcgagcugaagccccagaccugcaccaucugcgagaccaaccccgucaacgccaucgacgccgagaugcacgaccugaacugcuccuacaacaucugccccuacugcgccagccggcucaccuccgacgggcuggcgcgccacgugaugcagugcccgaagcggaaggagaagaucgaggagaccgagcuguaccucaaccuggagcgcauccccugggugguccggaagcugcuccaggugagcgagagcacgggcguggcccugaagcgcuccagcuggcuggucauccuccuggugcugcucaccgugucccugagccccguccaguccgcccccaucagc

SEQ ID NO: 12351 - RNA, 972 nt, Artificial Sequence
  derived and/or modified CDS sequence (opt1) from CCHFV(SPU 18/88)__KJ682810.1__Gn
agcgaggaguccaacgacgacugccugagccgcacccagcuccugcggaccgagaacgccgagauccacuccgacaacuacggcgggcccggcgacaagaucacgaucugcaacgggagcaccaucguggaccagcgccugggcuccgagcucgggugcuacaccaucaaccgggucaagagcuucaagcugugcgagaacuccgccaccggcaagagcugcgagaucgacuccacgccggugcgcugccggcagggcuucugccugaagaucacccaggaggggcgcggccacgugaagcucagccggggguccgaggucgugcuggacgcgugcgacagcuccugcgagaucaugauccccaagggcaccggggacauccugguggacugcagcggcggccagcagcacuuccucaaggacaaccuggucgaccuggggugccccaacaucccccuccugggcaagauggccaucuacaucugccgcauguccaaccacccgaagaccacgaugggguuccuguucugguucagcuucggcuacgugaucacgugcauccucugcaaggugaucuucuaccugcugaucgucgugggcacccucgggaagaaguucaagcaguaccgggagcugaagccccagaccugcaccaucugcgagaccaaccccgugaacgccaucgacgccgagaugcacgaccugaacugcuccuacaacaucugccccuacugcgccagccgccucaccuccgacggccuggcgcggcacgucaugcagugcccgaagcgcaaggagaagaucgaggagaccgagcuguaccucaaccuggagcggauccccuggguggugcgcaagcugcuccaggucagcgagagcacggggguggcccugaagcgguccagcuggcuggugauccuccugguccugcucaccgugucccugagccccgugcaguccgcccccaucagc

SEQ ID NO: 12352 - RNA, 972 nt, Artificial Sequence
  derived and/or modified CDS sequence (opt1) from CCHFV(SPU 48/90)__KJ682813.1__Gn
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggucaaguccuucaagcucugcgagaacagcgccacgggcaaguccugcgugaucgacagcgugcccgucaagugccgccagggguacugccugcggaucacccaggagggccgcgggcacgugaagcugucccggggcagcgaggugguccucgacgcgugcgacaccuccugcgagaucaugauccccaaggggaccggcgacauccugguggacugcagcggcgggcagcagcacuuccugaaggacaaccucaucgaccugggcugccccaagaucccgcugcucgggaagauggccaucuacaucugccgcauguccaaccaccccacgaccaccauggccuuccuguucugguucagcuucggcuacgugaucacgugcauccugugcaaggccaucuucuaccuccugaucaucaucggcacccuggggaagcgguuccgccaguaccgggagcucaagccccagaccugcaccaucugcgagaccacgcccgucaacgccaucgacgcggagaugcacgaccugaacugcuccuacaacaucugcccguacugcgccagccgccugaccuccgacggccucgcccggcacgugacccagugccccaagcgcaaggagaagguggaggagaccgagcuguaccugaaccucgagcggauccccugggucgugcgcaagcugcuccaggugagcgaguccacgggggucgcccugaagcggagcagcuggcugaucgugcugcucgugcuguucaccgucucccugagccccgugcaguccgcgccgaucggc

SEQ ID NO: 12353 - RNA, 972 nt, Artificial Sequence
  derived and/or modified CDS sequence (opt1) from CCHFV(SPU 187/90)__KJ682814.1__Gn
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggucaaguccuucaagcucugcgagaacagcgccacgggcaaguccugcgagaucgacagcgugcccgugaagugccgccagggguacugccugcggaucacccaggagggccgcgggcacgucaagcugucccggggcagcgagguggugcucgacgcgugcgacaccuccugcgagaucaugauccccaaggggaccggcgacauccuggucgacugcagcggcgggcagcagcacuuccugaaggacaaccucaucgaccugggcugccccaagaucccgcugcucgggaagauggccaucuacaucugccgcauguccaaccaccccaagacgaccauggccuuccuguucugguucagcuucggcuacgugaucacgugcauccugugcaaggccaucuucuaccuccugaucaucaucggcacccuggggaagcgguucaagcaguaccgcgagcucaagccccagaccugcaccaucugcgagaccacccccgugaacgccaucgacgcggagaugcacgaccugaacugcuccuacaacaucugcccguacugcgccagccggcugacguccgacggccucgcccgccacgucacccagugccccaagcggaaggagaagguggaggagaccgagcuguaccugaaccucgagcgcauccccugggugguccggaagcugcuccaggugagcgaguccaccgggguggcccugaagcgcagcagcuggcugaucguccugcucgugcuguucacggugucccugagccccguccaguccgcgccgaucggc

SEQ ID NO: 12354 - RNA, 972 nt, Artificial Sequence
  derived and/or modified CDS sequence (opt1) from CCHFV(Haskovo-V46/13)__KR092379.1__Gn
agcgaggagcugggcgacgacugcaucucccgcacccagcuccugcggaccgagacggccgagauccacgacgacaacuacgggggccccggggacaagaucaccaucugcaacggcagcaccaucguggaccagcgccugggguccgagcucggcugcuacaccaucaaccggggcaagagcuucaagcugugcgagaacuccgccacggggaagaccugcgagaucgacagcaccccggucaagugccgccagggcuucugccugaagaucacccaggaggggcggggccacgugaagcucucccgcgggagcgaggugguccuggacgcgugcgacuccagcugcgaggugaugauccccaagggcacgggcgacauccugguggacugcuccgggggccagcagcacuuccucaaggacaaccugaucgaccuggggugcccccacaucccccuccugggcaagauggccaucuacaucugccggaugagcaaccacccgcgcaccaccauggccuuccuguucugguucuccuucggcuacgucaucacgugcaucuucugcaaggcccucuucuacagccugaucaucaucgggacccugggcaagaagaucaagcaguaccgggagcucaagccccagaccugcaccaucugcgagaccacgcccgugaacgccaucgacgcggagaugcacgaccugaacugcuccuacaacaucugccccuacugcgccagccgccugaccuccgacgggcucgcccggcacgugacccagugcccgaagcgcaaggagaaggucgaggagaccgagcuguaccugaaccucgagcggauccccuggaucgugcgcaagcugcuccaggugagcgaguccacgggcgucgcccugaagcggagcagcuggcugaucgugcugcucgugcugcugcccgucucccucagccccgugcaguccgcgccggugggg

SEQ ID NO: 12355 - RNA, 972 nt, Artificial Sequence
  derived and/or modified CDS sequence (opt1) from CCHFV(24-R-2012)__KR814856.1__Gn
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacacguccugcgaggugaugauccccaaggggaccggcgacauccuggucgacugcagcggcgggcagcagcacuuccugaaggacaaccucaucgaccugggcugcccccacaucccgcugcucgggaagauggccaucuacaucugccggauguccaaccacccccgcaccaccauggccuuccuguucugguucagcuucggcuacgugaucacgugcaucuucugcaaggcccuguucuacucccucaucaucaucggcacccuggggaagaagaucaagcaguaccgggagcugaagccccagaccugcaccaucugcgagacggcccccgugaacgcgaucgacgccgagaugcacgaccucaacugcagcuacaacaucugcccguacugcgccucccgccugaccagcgacggccuggcccggcacgucccccagugccccaagcgcaaggagaagguggaggagaccgagcucuaccugaaccuggagcggauccccuggaucgugcgcaagcuccugcaggucuccgagagcaccgggguggcgcugaagcgguccagcuggcucaucgugcugcugguccuccugacggugagccuguccccggugcagagcgcccccgucggc

SEQ ID NO: 12356 - RNA, 972 nt, Artificial Sequence
  derived and/or modified CDS sequence (opt1) from CCHFV(36-ST-2014)__KR814857.1__Gn
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccuccaggugagcgaguccaccggggucgcgcugaagcgcagcagcuggcugaucgugcugcuggugcuccugacggucucccugagccccgugcaguccgccccggugggc

SEQ ID NO: 12357 - RNA, 972 nt, Artificial Sequence
  derived and/or modified CDS sequence (opt1) from CCHFV(44-ST-2010)__KR814859.1__Gn
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccugcugugguucuccuucggcuacgucaucacgugcaucuucugcaaggcccucuucuacagccugaucaucaucggcacccuggggaagaagaucaagcaguaccgcgagcucaagccccagaccugcaccaucugcgagaccgcccccgugaacgcgaucgacgccgagaugcacgaccugaacugcuccuacaacaucugcccguacugcgccagccggcugacguccgacggccucgcccgccacgugacccagugccccaagcggaaggagaaggucgaggagaccgagcuguaccugaaccucgagcgcauccccuggaucgugcggaagcugcuccaggugagcgaguccaccggggucgcgcugaagcgcagcagcuggcugaucgugcugcucgugcugcugacggucucccucagccccgugcaguccgccccggugggc

SEQ ID NO: 12358 - RNA, 972 nt, Artificial Sequence
  derived and/or modified CDS sequence (opt1) from CCHFV(47-ST-2013)__KR814861.1__Gn
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcaagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccuccaggugagcgaguccaccggggucgcgcugaagcgcagcagcuggcugaucgugcugcuggugcuccugacggucucccugagccccgugcaguccgccccggugggc

SEQ ID NO: 12359 - RNA, 972 nt, Artificial Sequence
  derived and/or modified CDS sequence (opt1) from CCHFV(52-R-2014)__KR814862.1__Gn
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacacguccugcgaggugaugauccccaaggggaccggcgacauccuggucgacugcagcggcgggcagcagcacuuccugaaggacaaccucaucgaccugggcugcccccacgugccgcugcucgggaagauggccaucuacaucugccggauguccaaccacccccgcaccaccauggccuuccuguucugguucagcuucggcuacgugaucacgugcaucuucugcaaggcccuguucuacucccucaucaucaucggcacccuggggaagaagaucaagcaguaccgggagcugaagccccagaccugcaccaucugcgagacggcccccgucaacgcgaucgacgccgagaugcacgaccucaacugcagcuacaacaucugcccguacugcgccucccgccugaccagcgacggccuggcccggcacgugccccagugccccaagcgcaaggagaagguggaggagaccgagcucuaccugaaccuggagcggauccccuggaucguccgcaagcuccuccagguguccgagagcaccgggguggcgcugaagcgguccagcuggcugaucguccugcuggugcuccugacggugagccuguccccgguccagagcgcccccgugggc

SEQ ID NO: 12360 - RNA, 972 nt, Artificial Sequence
  derived and/or modified CDS sequence (opt1) from CCHFV(75-R-2012)__KR814863.1__Gn
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcgcgcccgugaagugccgccagggguucugccugaagaucacccaggagggccgggggcacgugaagcugucccgcggcagcgaggucgugcucgacgccugcgacuccagcugcgaggugaugauccccaaggggaccggcgacauccuggucgacugcuccggcgggcagcagcacuuccugaaggacaaccucaucgaccugggcugcccccacaucccgcugcucgggaagauggccaucuacaucugccggaugagcaaccacccccgcacgaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcgcccgugaacgccaucgacgccgagaugcacgaccucaacugcuccuacaacaucugcccguacugcgccagccgccugaccuccgacggccuggcgcggcacgucccccagugccccaagcgcaaggagaagguggaggagacggagcucuaccugaaccuggagcggauccccuggaucgugcgcaagcuccugcaggucagcgaguccaccgggguggcccugaagcggagcagcuggcucaucgugcugcugguccuccugaccgugucccugagcccggugcaguccgcccccgucggc

SEQ ID NO: 12361 - RNA, 972 nt, Artificial Sequence
  derived and/or modified CDS sequence (opt1) from CCHFV(75-ST-2010)__KR814864.1__Gn
agcgaggaguccggcgacgacugcaucagccgcacccagcugcuccggaccgagacggccgagauccacgacgacaacuacgggggccccggggacaagaucaccaucugcaacggcuccaccaucguggaccagcgccuggggagcgagcugggcugcuacaccaucaaccgggucaaguccuucaagcucugcgagaacagcgccacgggcaagaccugcgagaucgacuccaccccggugaagugccgccagggguucugccugaagaucacccaggagggccgggggcacgugaagcugagccgcggcuccgaggucgugcucgacgcgugcgacagcuccugcgaggugaugauccccaaggggacgggcgacauccuggucgacugcagcggcgggcagcagcacuuccugaaggacaaccucaucgaccugggcugcccccacaucccccugcucgggaagauggccaucuacaucugccggauguccaaccacccgcgcaccaccauggccuuccuguucugguucagcuucggcuacgugaucacgugccuguucugcaaggcccucuucuacucccugaucaucaucggcacccuggggaagaagaucaagcaguaccgggagcuccgcccccagaccugcaccaucugcgagaccgcccccgugaacgcgaucgacgccgagaugcacgaccugaacugcagcuacaacaucugccccuacugcgccucccggcugacgagcgacggccucgcccgccacgucccgcagugccccaagcggaaggagaagguggaggagaccgagcuguaccugaaccucgagcgcauccccuggaucgugcggaagcugcugcaggucuccgagagcaccgggguggcgcucaagcgcagcuccuggcugaucgugcugcucguccugcugaccgugagccucucccccgugcagagcgccccggucggc

SEQ ID NO: 12362 - RNA, 972 nt, Artificial Sequence
  derived and/or modified CDS sequence (opt1) from CCHFV(3820-ST-2007)__KR814868.1__Gn
agcgaggagcccggcgacgacugcaucucccgcacccagcugcucaagaccgagacggccgagauccacgacgacaacuacgggagcccgggcgacaagaucaccaucugcaacggguccaccaucguggaccagcggcugggcagcgagcuggggugcuacaccaucaaccgcgucaaguccuucaagcucugcgagaacagcgccacgggcaagaccugcgagaucgacuccacccccgugaagugccggcagggcuucugccugaagaucacccaggaggggcgcggccacgugaagcugagccggggguccgaggucgugcucgacgcgugcgacagcuccugcgagaucaugauccccaagggcacgggggacauccugguggacugcagcggcggccagcagcacuuccugaaggacaaccucaucgaccuggggugcccccacaucccgcugcucggcaagauggccaucuacaucugccgcauguccaaccacccccggaccaccauggccuuccuguucugguucagcuucggguacgucaucacgugcaucuucugcaaggcccuguucuacucccucaucaucaucggcacccugggcaagaagaucaagcaguaccgcgagcugaagccccagaccugcaccaucugcgagaccgcccccgugaacgcgaucgacgccgagaugcacgaccucaacugcagcuacaacaucugcccguacugcgccucccggcugacgagcgacgggcuggcccgccacgugacccagugccccaagcggaaggagaaggucgaggagaccgagcucuaccugaaccuggagcgcauccccuggaucgugcggaagcuccuccagguguccgagagcaccggcgucgcgcugaagcgcagcuccuggcugaucgugcugcuggugcuccuggccgucagccugucccccgugcagagcgccccggugggg

SEQ ID NO: 12363 - RNA, 972 nt, Artificial Sequence
  derived and/or modified CDS sequence (opt1) from CCHFV(4701-ST-2009)__KR814872.1__Gn
agcgaggagcccggcgacgacugcaucucccgcacccagcugcucaagaccgagacggccgagauccacgacgacaacuacgggggcccgggggacaagaucaccaucugcaacggcagcaccguggucgaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgagguggugcucgacgcgugcgacuccagcugcgagaucaugauccccaaggggacgggcgacauccuggucgacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgugaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgucacccagugccccaagcggaaggagaagguggaggagaccgagcucuaccugaaccuggagcgcauccccuggaucgugcggaagcuccugcaggucagcgaguccaccgggguggcgcugaagcgcagcagcuggcucaucgugcugcugguccuccugacggugucccugagccccgugcaguccgccccggucggc

SEQ ID NO: 12364 - RNA, 972 nt, Artificial Sequence
  derived and/or modified CDS sequence (opt1) from CCHFV(5170-R-2011)__KR814873.1__Gn
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgugugcgacuccagcugcgagaucaugauccccaaggggacgggcgacauccuggucgacugcuccggcgggcagcagcacuuccugaaggacaaccucaucgaccugggcugcccccacaucccgcugcucgggaagauggcgaucuacaucugccgcaugagcaaccacccccggaccaccauggccuuccuguucugguucuccuucggcuacgugaucacgugcaucuucugcaaggcccuguucuacagccucaucaucaucggcacccuggggaagaagaucaagcaguaccgcgagcugaagccccagaccugcaccaucugcgagaccgcccccgugaacgccaucgacgcggagaugcacgaccucaacugcuccuacaacaucugcccguacugcgccagccggcugacguccgagggccuggcccgccacgucacccagugccccaagcggaaggagaagguggaggagaccgagcucuaccugaaccuggagcgcauccccuggaucgugcggaagcuccugcaggucagcgaguccaccgggguggcccugaagcgcagcagcuggcucaucgugcugcugguccuccugacggugucccugagccccgugcaguccgcgccggucggc

SEQ ID NO: 12365 - RNA, 972 nt, Artificial Sequence
  derived and/or modified CDS sequence (opt1) from CCHFV(200406546-Turkey)__KR864902.1__Gn
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgugugcgacuccagcugcgaggucaugauccccaaggggacgggcgacauccugguggacugcuccggcgggcagcagcacuuccugaaggacaaccucaucgaccugggcugcccccacgugccgcugcucgggcggauggcgaucuacaucugccgcaugagcaaccacccccggaccaccauggccuuccuguucugguucuccuucggcuacgucaucacgugcaucuucugcaaggcccuguucuacagccucaucaucaucggcacccuggggaagaaguucaagcaguaccgcgagcugaagccccagaccugcaccaucugcgagaccgcccccgugaacgccaucgacgcggagaugcacgaccucaacugcuccuacaacaucugcccguacugcgccagccggcugacguccgacggccuggcccgccacgugccccagugccccaagcggaaggagaaggucgaggagaccgagcucuaccugaaccuggagcgcauccccuggaucgugcggaagcuccuccaggugagcgaguccaccggggucgcccugaagcgcagcagcuggcugaucgugcugcuggugcuccugaccgucucccugagcccggugcaguccgcgcccgugggc

SEQ ID NO: 12366 - RNA, 972 nt, Artificial Sequence
  derived and/or modified CDS sequence (opt1) from CCHFV(1-CR/HU-2015)__KU161584.1__Gn
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuuccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucacccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugacggugucccugagccccgugcaguccgccccggucggc

SEQ ID NO: 12367 - RNA, 972 nt, Artificial Sequence
  derived and/or modified CDS sequence (opt1) from CCHFV(Gaib)__KX013445.1__Gn
agcgaggaguccagcgacgacugcaucucccgcacccagcugcuccggaccgagacggccgagauccacaacgacaacuacggcgggcccggcgacaagaucaccaucugcaacgggagcaccaucguggaccagcgccugggcuccgagcuggggugcuacaccaucaaccgggucaagagcuucaagcucugcgagaacuccgccacgggcaagagcugcgagaucgacuccaucccggugaagugccgccagggcuucugccugaagaucacccaggaggggcggggccacgugaagcugagccgcggguccgaggucgugcucgacgcgugcgacagcuccugcgagaucaugauccccaagggcaccggggacauccugguggacugcagcggcggccagcagcacuuccugaaggacaaccucaucgaccuggggugccccaacaucccccugcucggcaagauggccaucuacaucugccggauguccaaccacccgaagaccacgauggccuuccuguucugguucagcuucggguacgucaucacgugcaucuucugcaaggccaucuucuaccugcucaucaucgugggcacccugggcaagaaguucaagcaguaccgcgagcugaagccccagaccugcaccaucugcgagaccacccccgugaacgccaucgacgcggagaugcacgaccucaacugcuccuacaacaucugccccuacugcgccagccggcugaccuccgacgggcuggcccgccacgucgugcacugcccgaagcggaaggagaagaucgaggagacggagcucuaccugaaccuggagcgcgugcccugggucgugcggaagcuccuccaggugagcgagagcaccggcgucgcccugaagcgcuccagcuggcugaucgugcugcuggugcuccugaccgucucccugagccccgugcaguccgcgcccaucggg

SEQ ID NO: 12368 - RNA, 972 nt, Artificial Sequence
  derived and/or modified CDS sequence (opt1) from CCHFV(Hodzha)__KX013448.1__Gn
agcgaggaguccggcgacgacugcaucagccgcacccagcugcuccggaccgagacggccgagauccacggggacgacuacggcgggcccggcgacaagaucaccaucugcaacggguccaccaucguggaccagcgccugggcagcgagcugggcugcuacaccaucaaccgggucaaguccuucaagcucugcgagaacagcgccacggggaaguccugcgagaucgacagcaccccggugaagugccgccagggcuacugccugaagaucacccaggaggggcggggccacgugaagcugucccgcgggagcgaggucgugcucgacgcgugcgacuccagcugcgaggugaugauccccaagggcaccggcgacauccuggucgacugcuccgggggccagcagcacuuccugaaggacaaccucaucgaccuggggugcccccggaucccccugcucggcaagauggccaucuacaucugccgcaugagcaaccacccggagacgaccauggccuuccuguucugguucuccuucggcuacgugaucacgugcauccugugcaaggccaucuucuaccuccugaucaucguggggacccugggcaagcgguucaagcaguaccgcgagcucaagccccagaccugcaccaucugcgagaccacccccgccaacgcgaucgacgccgagaugcacgaccugaacugcagcuacaacaucugccccuacugcgccucccggcugacgagcgacgggcucgcccgccacgucacccagugcccgaagcggaaggagaagguggaggagaccgagcuguaccugaaccucgagcgcauccccuggaucgugcggaagcugcugcaggucuccgagagcaccggcguggcgcucaagcgcagcuccuggcugaucgugcugcucguccuguucgccgugagccugucccccgugcagagcgcccccaucggg

SEQ ID NO: 12369 - RNA, 972 nt, Artificial Sequence
  derived and/or modified CDS sequence (opt1) from CCHFV(IbAn7620)__KX013451.1__Gn
agcgaggagcccuccgacgacugcaucagccgcacccagcugcuccggaccgagacggccgagauccacggcgacaacuacgggggcccgggggacaagaucaccaucugcaacggcuccaccaucguggaccagcgccuggggagcgagcugggcugcuacaccaucaaccgggucaaguccuucaagcucugcgagaacagcgccacgggcaagaacugcgagaucgacuccgugcccgugaagugccgccagggguacugccugcggaucacccaggagggccgcgggcacgucaagcugagccggggcuccgagaucgugcucgacgcgugcgacaccagcugcgagaucaugauccccaaggggaccggcgacauccugguggacugcuccggcgggcagcagcacuuccugaaggacaaccucaucgaccugggcugccccaagaucccgcugcucgggaagauggccaucuacaucugccgcaugagcaaccaccccaagacgaccauggccuuccuguucugguucuccuucggcuacgucaucacgugcauccugugcaaggccaucuucuaccuccugaucaucaucggcacccuggggaagcggcucaagcaguaccgcgagcugaagccccagaccugcaccaucugcgagaccacccccgugaacgccaucgacgcggagaugcacgaccugaacugcagcuacaacaucugcccguacugcgccucccggcucacgagcgacggccuggcccgccacgugauccagugccccaagcggaaggagaaggucgaggagaccgagcuguaccucaaccuggagcgcauccccuggguggugcggaagcugcuccaggucuccgagagcaccgggguggcccugaagcgcuccagcuggcugaucgugcuccugguccuguucaccgugagccucucccccgugcagagcgcgccgaucggc

SEQ ID NO: 12370 - RNA, 972 nt, Artificial Sequence
  derived and/or modified CDS sequence (opt1) from CCHFV(K128_76)__KX013454.1__Gn
agcgacgaguccggcgacgacugcaucagccgcacccagcugcuccggaccgagacggccgagauccacggggacaacuacggcgggcccggcgacaagaucaccaucugcaacggguccaccaucguggaccagcgccugggcagcgagcugggcugcuacaccaucaaccgggucaaguccuucaagcucugcgagaacagcgccacggggaaguccugcgagaucgacagcaucccggugaagugccgccagggcuacugccugaagaucacccaggaggggcggggccacgugaagcugucccgcgggagcgaggucgugcucgacgcgugcgacuccagcugcgaggugaugauccccaagggcaccggcgacauccuggucgacugcuccgggggccagcagcacuuccugaaggacaaccucaucgaccuggggugccccaagaucccccugcucggcaagauggccaucuacaucugccggaugagcaaccacccgaagaccacgauggccuuccuguucugguucuccuucggcuacgugaucacgugcaucgugugcaaggccaucuucuaccugcucaucaucgucgggacccugggcaagcgcuucaagcaguaccgggagcugaagccccagaccugcaccaucugcgagaccacccccaccaacgccaucgacgcggagaugcacgaccucaacugcagcuacaacaucugccccuacugcgccucccgccugacgagcgacgggcuggcccggcacgugacccacugcccgaagcgcaaggagaagguggaggagaccgagcucuaccugaaccuggagcggauccccugggucgugcgcaagcuccuccagguguccgagagcaccggcgucgcccugaagcggagcuccuggcucaucgugcugcuggugcuguucgcggucagccugucccccgugcagagcgcccccaucucc

SEQ ID NO: 12371 - RNA, 972 nt, Artificial Sequence
  derived and/or modified CDS sequence (opt1) from CCHFV(K168_40)__KX013457.1__Gn
agcgacgaguccggcgacgacugcaucagccgcacccagcugcuccggaccgagacggccgagauccacggggacaacuacggcgggcccggcgacaagaucaccaucugcaacggguccaccaucguggaccagcgccugggcagcgagcugggcugcuacaccaucaaccgggucaaguccuucaagcucugcgagaacagcgccacggggaaguccugcgagguggacagcaucccggugaagugccgccagggcuacugccugaagaucacccaggaggggcggggccacgucaagcugucccgcgggagcgagguggugcucgacgcgugcgacuccagcugcgaggucaugauccccaagggcaccggcgacauccugguggacugcuccgggggccagcagcacuuccugaaggacaaccucaucgaccuggggugccccaagaucccccugcucggcaagauggccaucuacaucugccggaugagcaaccacccgaagaccacgauggccuuccuguucugguucuccuucggcuacgugaucacgugcaucgucugcaaggccaucuucuaccugcucaucaucguggggacccugggcaagcgcuucaagcaguaccgggagcugaagccccagaccugcaccaucugcgagaccacccccaccaacgccaucgacgcggagaugcacgaccucaacugcagcuacaacaucugccccuacugcgccucccgccugacgagcgacgggcuggcccggcacgugacccacugcccgaagcgcaaggagaaggucgaggagaccgagcucuaccugaaccuggagcggauccccuggguggugcgcaagcuccugcaggucuccgagagcaccggcguggcccugaagcggagcuccuggcucaucgugcugcugguccucuucgcggugagccugucccccgugcagagcgcccccaucggg

SEQ ID NO: 12372 - RNA, 972 nt, Artificial Sequence
  derived and/or modified CDS sequence (opt1) from CCHFV(K168_125)__KX013460.1__Gn
agcgacgaguccggcgacgacugcaucagccgcacccagcugcuccggaccgagacggccgagauccacggggacaacuacggcgggcccggcgacaagaucaccaucugcaacggguccaccaucguggaccagcgccugggcagcgagcugggcugcuacaccaucaaccgggucaaguccuucaagcucugcgagaacagcgccacggggaaguccugcgagguggacagcaucccggugaagugccgccagggcuacugccugaagaucacccaggaggggcggggccacgucaagcugucccgcgggagcgagguggugcucgacgcgugcgacuccagcugcgaggucaugauccccaagggcaccggcgacauccugguggacugcuccgggggccagcagcacuuccugaaggacaaccucaucgaccuggggugccccaaggugccccugcucggcaagauggccaucuacaucugccggaugagcaaccacccgaagaccacgauggccuuccuguucugguucuccuucggcuacgucaucacgugcaucgugugcaaggccaucuucuaccugcucaucaucguggggacccugggcaagcgcuucaagcaguaccgggagcugaagccccagaccugcaccaucugcgagaccacccccaccaacgccaucgacgcggagaugcacgaccucaacugcagcuacaacaucugccccuacugcgccucccgccugacgagcgacgggcuggcccggcacgucacccacugcccgaagcgcaaggagaagguggaggagaccgagcucuaccugaaccuggagcggauccccugggugguccgcaagcuccuccagguguccgagagcaccggcguggcccugaagcggagcuccuggcucaucguccugcuggugcuguucgcggugagccugucccccguccagagcgcccccaucggg

SEQ ID NO: 12373 - RNA, 972 nt, Artificial Sequence
  derived and/or modified CDS sequence (opt1) from CCHFV(K229_194)__KX013463.1__Gn
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaagggcaaccucaucgaccuggggugcccccacaucccgcugcucggcaagauggccaucuacaucugccgcaugagcaaccacccccggaccaccauggccuuccuguucugguucuccuucggcuacgucaucacgugcaucuucugcaaggcccuguucuacagccucaucaucaucgggacccugggcaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacgggcuggcccgccacgugacccagugccccaagcggaaggagaaggucgaggagaccgagcucuaccugaaccuggagcgcauccccuggaucgugcggaagcuccuccaggugagcgaguccaccggcgucgcgcugaagcgcagcagcuggcugaucgugcugcuggugcuccugacggucucccugagccccgugcaguccgccccggugggg

SEQ ID NO: 12374 - RNA, 972 nt, Artificial Sequence
  derived and/or modified CDS sequence (opt1) from CCHFV(K315_14)__KX013469.1__Gn
agcgaggagcccggcgacgacugcaucucccgcacccagcugcucaagaccgagacggccgagauccacgacgacaacuacgggggcccgggggacaagaucaccaucugcaacggcagcaccguggucgaccagcggcugggguccgagcugggcugcuacaccaucaaccgcgucaagagcuucaagcucugcaagaacuccgccacgggcaagaccugcgagaucgacagcacccccgugaagugccggcagggguucugccugaagaucacccaggagggccgcgggcacgugaagcugucccggggcagcgagguggugcucgacgucugcgacuccagcugcgagaucaugauccccaaggggacgggcgacauccugguggacugcuccggcgggcagcagcacuuccugaaggacaaccucaucgaccugggcugcccccacaucccgcugcucgggaagauggcgaucuacaucugccgcaugagcaaccacccccggaccaccauggccuuccuguucugguucuccuucggcuacgugaucacgugcaucuucugcaaggcccuguucuacagccucaucaucaucggcacccuggggaagaagaucaagcaguaccgcgagcugaagccccagaccugcaccaucugcgagaccgcccccgucaacgccaucgacgcggagaugcacgaccucaacugcuccuacaacaucugcccguacugcgccagccggcugacguccgagggccuggcccgccacgugacccagugccccaagcggaaggagaagguggaggagaccgagcucuaccugaaccuggagcgcauccccuggaucguccggaagcuccuccaggugagcgaguccaccgggguggcccugaagcgcagcagcuggcugaucguccugcuggugcuccugacggugucccugagccccguccaguccgcgccggugggc

SEQ ID NO: 12375 - RNA, 972 nt, Artificial Sequence
  derived and/or modified CDS sequence (opt1) from CCHFV(K323_27)__KX013472.1__Gn
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucacgugcaucuucugcaaggcccuguucuaccuccugaucaucaucggcacccuggggaagaagaucaagcaguaccgcgagcucaagccccagaccugcaccaucugcgagaccgcccccgugaacgcgaucgacgccgagaugcacgaccugaacugcagcuacaacaucugcccguacugcgccucccggcugacgagcgacggccucgcccgccacgugacccagugccccaagcggaaggagaaggucgaggagaccgagcuguaccugaaccucgagcgcauccccuggaucgugcggaagcugcuccagguguccgagagcaccggggucgcgcugaagcgcuccagcuggcugacggugcugcucgugcugcugaccgucagccucucccccgugcagagcgccccggugggc

SEQ ID NO: 12376 - RNA, 972 nt, Artificial Sequence
  derived and/or modified CDS sequence (opt1) from CCHFV(K340_6)__KX013475.1__Gn
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccacgaccggcaagaccugcgagaucgacagcacccccgugaagugccggcagggguucugccugaagaucacgcaggagggccgcgggcacgugaagcugucccggggcagcgaggucgugcucgacgccugcgacuccagcugcgagaucaugauccccaaggggaccggcgacauccugguggacugcuccggcgggcagcagcacuuccugaaggacaaccucaucgaccugggcugcccccacaucccgccccuggggaagauggcgaucuacaucugccgcaugagcaaccacccccggaccaccauggccuuccucuucugguucuccuucggcuacgucaucacgugcaucuucugcaaggcccuguucuacagccugaucaucaucggcacccucgggaagaagaucaagcaguaccgcgagcugaagccccagaccugcaccaucugcgagacggccccggugaacgccaucgacgcggagaugcacgaccugaacugcuccuacaacaucugccccuacugcgccagccggcucaccuccgacggccuggcccgccacgugacccagugccccaagcggaaggagaaggucgaggagaccgagcuguaccucaaccuggagcgcauccccuggaucgugcggaagcugcuccaggugagcgaguccacgggggucgcccugaagcgcagcagcuggcugaucgugcuccuggugcugcucaccgucucccugagcccggugcaguccgcgcccgugggc

SEQ ID NO: 12377 - RNA, 972 nt, Artificial Sequence
  derived and/or modified CDS sequence (opt1) from CCHFV(Mamon)__KX013478.1__Gn
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucguguccgacgcgugcgacagcuccugcgaggugaugauccccaaggggacgggcgacauccucgucgacugcagcggcgggcagcagcacuuccugaaggacaaccugaucgaccucggcugcccccacaucccgcugcuggggaagauggccaucuacaucugccggauguccaaccacccccgcaccaccguggccuuccucuucugguucagcuucggcuacgugaucacgugcaucuucugcaaggcccuguucuacucccugaucaucaucggcacccucgggaagaagaucaagcaguaccgggagcugaagccccagaccugcaccaucugcgagaccgcccccgucaacgcgaucgacgccgagaugcacgaccugaacugcagcuacaacaucugcccguacugcgccucccgccucacgagcgacggccuggcccggcacgugccccagugccccaagcgcaaggagaagguggaggagaccgagcuguaccucaaccuggagcggauccccuggaucguccgcaagcugcuccagguguccgagagcaccgggguggcgcugaagcggagcuccuggcugaucguccuccuggugcugcucaccgugagccuguccccgguccagagcgcccccgugggc

SEQ ID NO: 12378 - RNA, 972 nt, Artificial Sequence
  derived and/or modified CDS sequence (opt1) from CCHFV(Nakiwogo)__KX013484.1__Gn
gccgagggcgugagcaacgacugcgucucccgcacccagcugaucaagaccgagguggccgagauccacgaggacagcuacgggggccccggggagaagaucacgaucugcaacggcuccaccaucguggaccagcggcucgggagcgagcugggcugcuacaccaucaaccgcgucaagaccuacaagcugugcgagaacuccgcgacggagaagggcugcgagaucgacagcgugccggugaagugcaagcagggguucugccucaaggucacccaggagggccgggggcacgugaagcugucccgcggcaccgagaucgugcuggacgucugcgacaccagcugcgagcucaugauccccaaggggacgggcgacauccugguggacugcuccggcgggcagcagcacuuccugcaggacaaccucaucgaccugggcugccccaacgugccccugcucgggaagauggccaucuacaucugccggaugagcaaccacccgaagaccaccauggccuuccuguucugguucuccuucggcuacgucaucacgugcguggugugcaagguccuguucuaccuccugaucgugaucggcacccuggggaagaagcucaagcaguaccgcgagcugaagccccagaccugcaucgugugcgagagcauccccgucaacgugaucgacgccgagaugcacgagcugaacugcaacuacaacaucugccccuacugcgccucccggcucaccagcgacggccuggugcgccacgucacccagugcccgaagcggaaggagaagguggaggagacggagcuguaccucaaccuggagcgcauccccuggcuggugcggcgccuccugcaggucuccgagagcaccgggauggcgcugaagcgguccugcuggaugaccacccuccugauccugcucguggucagccugucccccgugcagagcgcccccgugggc

SEQ ID NO: 12379 - RNA, 972 nt, Artificial Sequence
  derived and/or modified CDS sequence (opt1) from CCHFV(Saf)__KX013487.1__Gn
agcgaggagcccggcgacgacugcaucucccgcacccagcugcuccggaccgagacggccgagauccacgacgacaacuacgggggcccgggggacaagaucaccaucugcaacggcagcaccaucguggaccagcgccugggguccgagcugggcugcuacaccaucaaccgggucaagagcuucaagcucugcgagaacuccgccacgggcaagaccugcgagaucgacagcacccccgugaagugccgccagggguucugccugaagaucacccaggagggccgggggcacgugaagcugucccgcggcagcgaggucgugcucgacgcgugcgacuccagcugcgaggugaugauccccaaggggacgggcgacauccuggucgacugcuccggcgggcagcagcacuaccugaaggacaaccucaucgaccugggcugcccccacaucccgcugcucgggaagauggccaucuacaucugccggaugagcaaccacccccgcaccaccauggccuuccuguucugguucuccuucggcuacgugaucacgugcaucuucugcaaggcccuguucuacagccucaucaucaucggcacccuggggaagaagaucaagcaguaccgggagcugaagccccagaccugcaccaucugcgagaccgcccccgugaacgcgaucgacgccgagaugcacgaccucaacugcuccuacaacaucugcccguacugcgccagccgccugacguccgacggccuggcccggcacgucccccagugccccaagcgcaaggagaagguggaggagaccgagcucuaccugaaccuggagcggauccccuggaucgugcgcaagcuccugcaggucagcgaguccaccgggguggcgcugaagcggagcagcuggcucaucgugcugcugguccuccugaccgugucccugagcccggugcaguccgcccccgucggc

SEQ ID NO: 12380 - RNA, 972 nt, Artificial Sequence
  derived and/or modified CDS sequence (opt1) from CCHFV(Ast199)__KX056051.1__Gn
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccaucuacaucugccgcaugagcaaccacccccggaccaccauggccuuccuguucugguucuccuucggcuacgucaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccuccaggugagcgaguccaccggggucgcgcugaagcgcugcagcuggcugaucgugcugcuggugcuccugacggucagccugucccccgugcagagcgccccggugggc

SEQ ID NO: 12381 - RNA, 972 nt, Artificial Sequence
  derived and/or modified CDS sequence (opt1) from CCHFV(Ast137)__KX056057.1__Gn
agcgaggagcccggcgacgacugcaucucccgcacccagcugcucaagaccgagacggccgagauccacgacgacaacuacgggggcccgggggacaagaucaccaucugcaacggcagcaccaucguggaccagcggcugggguccgagcugggcugcuacaccaucaaccgcgucaagagcuucaagcucugcgagaacuccgccacgggcaagaccugcgagaucgacagcacccccgugaagugccggcagggguucugccugaagaucacccaggagggccgcgggcacgugaagcugucccggggcagcgaggucgugcucgacgcgugcgacuccagcugcgagaucaugauccccaaggggacgggcgacauccugguggacugcuccggcgggcagcagcacuuccugaaggacaaccucaucgaccugggcugcccccacaucccgcugcucgggaagauggccauccacaucugccgcaugagcaaccacccccggaccaccauggccuuccuguucugguucuccuucggcuacgucaucacgugcaucuucugcaaggcccuguucuacagccucaucaucaucggcacccuggggaagaagaucaagcaguaccgcgagcugaagccccagaccugcaccaucugcgagaccgcccccgugaacgcgaucgacgccgagaugcacgaccucaacugcuccuacaacaucugcccguacugcgccagccggcugacguccgacggccuggcccgccacgugacccagugccccaagcggaaggagaaggucgaggagaccgagcucuaccugaaccuggagcgcauccccuggaucgugcggaagcuccuccaggugagcgaguccaccggggucgcgcugaagcgcagcagcuggcugaucgugcugcuggugcuccugacggucucccugagccccgugcaguccgccccggugggc

SEQ ID NO: 12382 - RNA, 972 nt, Artificial Sequence
  derived and/or modified CDS sequence (opt1) from CCHFV(Ast133)__KX056060.1__Gn
agcgaggagcccgacgacgacugcaucucccgcacccagcugcucaagaccgagacggccgagauccacgacgacaacuacggcgggccgggcgacaagaucaccaucugcaacgggagcaccaucguggaccagcggcugggcuccgagcuggggugcuacaccaucaaccgcgucaagagcuucaagcucugcgagaacuccgccacgggcaagaccugcgagaucgacagcacccccgugaagugccggcagggcuucugccugaagaucacccaggaggggcgcggccacgugaagcugucccgggggagcgaggucgugcucgacgcgugcgacuccagcugcgagaucaugauccccaagggcacgggggacauccugguggacugcuccggcggccagcagcacuuccugaaggacaaccucaucgaccuggggugcccccacaucccgcugcucggcaagauggccaucuacaucugccgcaugagcaaccacccccggaccaccauggccuuccuguucugguucuccuucggguacgucaucacgugcaucuucugcaaggcccuguucuaccuccugaucaucaucggcacccugggcaagaagaucaagcaguaccgcgagcucaagccccagaccugcaccaucugcgagaccgcccccgugaacgcgaucgacgccgagaugcacgaccugaacugcagcuacaacaucugcccguacugcgccucccggcugacgagcgacgggcucgcccgccacgugacccagugccccaagcggaaggagaaggucgaggagaccgagcuguaccugaaccucgagcgcauccccuggaucgugcggaagcugcuccagguguccgagagcaccggcgucgcgcugaagcgcuccagcuggcugaucgugcugcucgugcugcugacggucagccucucccccgugcagagcgccccggugggg

SEQ ID NO: 12383 - RNA, 972 nt, Artificial Sequence
  derived and/or modified CDS sequence (opt1) from CCHFV(SK/2015/human)__KX458183.1__Gn
agcgaggaguccggcgacgacugcaucagccgcacccggcugcuccgcaccgagacggccgagauccacggggacuccuacggcgggcccggcgacaagaucaccaucugcaacgggagcaccaucguggaccagcggcugggcuccgagaugggcugcuacaccaucaaccgcgucaagagcuucaagcugugcgagaacuccgccacgggcaagagcugcgagaucgacuccaucccggugcggugccgccagggguacugccucaagaucacccaggaggggcggggccacgugaagcugagccgcggguccgaggucgugcuggacgcgugcgacagcuccugcgaggugaugauccccaagggcaccggcgacauccucgucgacugcagcgggggccagcagcacuuccugaaggacaaccugaucgaccucgggugccccaacaucccccugcugggcaagauggccaucuacaucugccggauguccaaccacccgaagaccacgauggccuuccucuucugguucagcuucggcuacgugaucacgugcauccugugcaaggccaucuucuaccugcucaucaucguggggacccugggcaagcgcuucaagcaguaccgggagcugaagccccagaccugcaccaucugcgagaccacccccgccaacgcgaucgacgccgagaugcacgaccucaacugcuccuacaccaucugccccuacugcgccagccgccugacguccgacgggcuggcccggcacgucacccagugcccgaagcgcaaggagaagguggaggagaccgagcucuaccugaaccuggagcggauccccugggugguccgcaagcuccuccaggugagcgagagcaccggcguggcgcugaagcgguccagcuggcucaucguccugcuggugcuguucacggugucccugagccccguccaguccgcccccaucggg

SEQ ID NO: 12384 - RNA, 972 nt, Artificial Sequence
  derived and/or modified CDS sequence (opt1) from CCHFV(YL16070)__KY354081.1__Gn
gccgagggcgggagcuccgacugcaucagccgcacccagcuggugaagaccgaggucgccgagauccacgaggacuccuacggcgggcccggcgagaagaucacgaucugcaacgggagcaccaucguggaccagcggcucggcuccgagcugggcugcuacaccaucaaccgcgucaagagcuacaagcugugcgagaacuccgcgagcgggaaguccugcgagaucgacagcaucccggugaagugcaagcagggcuucugccucaagaucacccaggaggggcggggccacgugaagcugucccgcgggacggagaucgugcuggacgucugcgacagcuccugcgagcucaugauccccaagggcaccggcgacauccugguggacugcagcgggggccagcagcacuuccugcagaacaaccucaucgaccuggggugccccaacgugccccugcucggcaagauggccaucuacgucugccggauguccaaccacccgaagaccaccauggccuuccuguucugguucagcuucggcuacgugaucacgugcaucgugugccgcguccuguucuaccuccugaucgccaucgggaccgugggcaagaagcugaagcaguaccgggagcucaagccccagaccugcaucgugugcgaguccguccccgugaacgccaucgacgcggagaugcacgagcugaacugcagcuacaacaucugccccuacugcgccucccgccugagcaccgacgggcucauccggcacgugacgcagugcccgaagcgccgggagaaggucgaggagaccgagcuguuccugaaccucgagcgcauccccuggcuggugcggaagcugcuccaggugagcgaguccaccggcauggcccugaagcgcagcugcuggaugaucacccugcucauccugcugcucgucuccaugagccccgugcaguccgcccccgugggg

SEQ ID NO: 12385 - RNA, 972 nt, Artificial Sequence
  derived and/or modified CDS sequence (opt1) from CCHFV(UCCR4448)__KY484042.1__Gn
agcgaggagaccuccgacgacugcaucagccgcacccagcugcuccggacggagaccgccgagauccacggcgacaacuacgggggccccggggacaagaucaccaucugcaacggcuccaccaucguggaccagcgccuggggagcgagcugggcugcuacacgaucaaccgggucaaguccuucaagcucugcgagaacagcgccaccggcaaguccugcgagaucgacagcgugccggugaagugccgccagggguacugccugcggaucacccaggagggccgcgggcacgucaagcugucccggggcagcgagguggugcucgacgcgugcgacaccuccugcgagaucaugauccccaaggggacgggcgacauccuggucgacugcagcggcgggcagcagcacuuccugaaggacaaccucaucgaccugggcugccccaagaucccccugcucgggaagauggccaucuacaucugccgcauguccaaccacccgaagaccaccauggccuuccuguucugguucagcuucggcuacgugaucacgugcauccugugcaaggccaucuucuaccuccugaucaucaucggcacccuggggaagcgguucaagcaguaccgcgagcucaagccccagaccugcaccaucugcgagaccacgcccgugaacgccaucgacgcggagaugcacgaccugaacugcuccuacaacaucugccccuacugcgccagccggcugaccuccgacggccucgcccgccacgucacccagugcccgaagcggaaggagaagguggaggagaccgagcuguaccugaaccucgagcgcauccccugggugguccggaagcugcuccaggugagcgaguccacggggguggcccugaagcgcagcagcuggcugaucguccugcucgugcuguucaccaucucccugagccccgugcaguccgcgcccaucagc

SEQ ID NO: 12386 - RNA, 972 nt, Artificial Sequence
  derived and/or modified CDS sequence (opt1) from CCHFV(SPU 45/88)__KJ682809.1__Gn
agcgaggaguccagcgacgacugccugucccgcacccagcuccugcggaccgagaacacggagauccacagcgacaacuacggcgggcccggcgacaagaucaccaucugcaacggguccaccaucguggaccagcgccugggcagcgagcucgggugcuacaccaucaaccgggucaaguccuucaagcugugcgagaacagcgccacgggcaaguccugcgagaucgacagcaccccggugcgcugccggcagggcuucugccugaagaucacccaggaggggcgcggccacgugaagcucucccgggggagcgaggucgugcuggacgccugcgacuccagcugcgagaucaugauccccaagggcaccggggacauccugguggacugcuccggcggccagcagcacuuccucaaggacaaccuggucgaccuggggugccccaacaucccccuccugggcaagauggcgaucuacaucugccgcaugagcaaccacccgaagacgaccaugggguuccuguucugguucuccuucggcuacgugaucacgugcauccucugcaaggugaucuucuaccugcugaucgucgugggcacccucgggaagaaguucaagcaguaccgggagcugaagccccagaccugcaccaucugcgagaccacccccgugaacgccaucgacgccgagaugcacgaccugaacugcagcuacaacaucugccccuacugcgccucccgccucacgagcgacggccuggcccggcacgucaugcagugcccgaagcgcaaggagaagaucgaggagaccgagcuguaccucaaccuggagcggauccccuggaucgugcgcaagcugcuccaggugagcgaguccaccggggucgcgcugaagcggagcuccuggcugguggugcuccugguccugcucaccgugagccugucccccgugcagagcgcccccaucggc

SEQ ID NO: 12387 - RNA, 1932 nt, Artificial Sequence
  derived and/or modified CDS sequence (opt1) from CCHFV(10200)__U39455.2__Gc
uuccuggacagcaccgccaagggcaugaagaaccuccugaacuccaccagccuggagacgucccucagcaucgaggcccccuggggggcgaucaacgugcaguccaccuacaagccgaccgucagcaccgccaacaucgcccuguccuggagcuccguggagcaccgcggcaacaagauccuggugagcgggcgguccgagagcaucaugaagcucgaggagcgcacgggcaucuccugggaccugggggucgaggacgccagcgaguccaagcugcucaccgugagcgugauggaccugucccagauguacagccccgucuucgaguaccuguccggcgaccggcagguggaggaguggcccaaggccaccugcaccggcgacugccccgagcgcugcgggugcacgagcagcaccugccuccacaaggaguggccgcacucccggaacuggcgcugcaaccccaccuggugcuggggcguggggaccggcugcacgugcugcgggcuggacgucaaggaccuguucaccgacuacauguucgugaaguggaagguggaguacaucaagaccgaggcgaucgucugcguggagcucaccagccaggagcggcagugcucccugaucgaggccggcacgcgcuucaaccugggccccgugaccaucacccucagcgagccccggaacauccagcagaagcugccgcccgagaucaucacccugcacccccgcaucgaggagggguucuucgaccucaugcacguccagaaggugcuguccgccagcacggugugcaagcugcaguccugcacccacggcguccccggggaccuccagguguaccacaucggcaaccugcugaagggcgacaaggugaacgggcaccucauccacaagaucgagccgcacuucaacaccagcuggauguccugggacggcugcgaccuggacuacuacugcaacaugggggacuggcccagcugcaccuacacgggcgucacccagcacaaccacgccuccuucgugaaccugcucaacaucgagaccgacuacaccaagaacuuccacuuccacagcaagcgggugacggcgcacggggacaccccccagcuggaccugaaggcccgccccaccuacggcgccggcgagaucaccguccucguggaggucgccgacauggagcugcacacgaagaagaucgagaucuccgggcugaaguucgccagccucgcgugcaccggcugcuacgccugcuccagcuccaucagcugcaaggugcggauccacguggacgagccggacgagcugaccguccacgugaaguccgacgaccccgacguggucgccgccagcagcucccugauggcccgcaagcucgaguucgggaccgacagcacguucaaggcguucuccgccaugcccaagaccagccugugcuucuacaucguggagcgggagcacugcaaguccugcagcgaggaggacaccaagaagugcgugaacaccaagcuggagcagccccaguccauccucaucgagcacaagggcaccaucaucgggaagcagaacagcacgugcaccgccaaggccuccugcuggcuggagagcgucaaguccuucuucuacggccugaagaacaugcucagcggcaucuucgggaacguguucaugggcaucuuccuguuccuggccccguucauccuccugauccuguucuucauguucggguggcgcauccuguucugcuucaagugcugccggcgcacccggggccucuucaaguaccgccaccugaaggacgacgaggagaccggguaccggcgcaucaucgagaagcugaacaacaagaagggcaagaacaagcuccuggacggcgagcgccuggcggacgggcggaucgccgagcucuucuccacgaagacccacaucggc

SEQ ID NO: 12388 - RNA, 1932 nt, Artificial Sequence
  derived and/or modified CDS sequence (opt1) from CCHFV(IbAr10200)__AF467768.2__Gc
uuccuggacagcaccgccaagggcaugaagaaccuccugaacuccaccagccuggagacgucccucagcaucgaggcccccuggggggcgaucaacgugcaguccaccuacaagccgaccgucagcaccgccaacaucgcccuguccuggagcuccguggagcaccgcggcaacaagauccuggugagcgggcgguccgagagcaucaugaagcucgaggagcgcacgggcaucuccugggaccugggggucgaggacgccagcgaguccaagcugcucaccgugagcgugauggaccugucccagauguacagccccgucuucgaguaccuguccggcgaccggcaggugggcgaguggcccaaggccaccugcaccggggacugccccgagcgcugcggcugcacgagcagcaccugccuccacaaggaguggccgcacucccggaacuggcgcugcaaccccaccuggugcuggggggugggcaccgggugcacgugcugcggccuggacgucaaggaccuguucaccgacuacauguucgugaaguggaagguggaguacaucaagaccgaggcgaucgucugcguggagcucaccagccaggagcggcagugcucccugaucgaggccggcacgcgcuucaaccuggggcccgugaccaucacccucagcgagccccggaacauccagcagaagcugccgcccgagaucaucacccugcacccccgcaucgaggagggcuucuucgaccucaugcacguccagaaggugcuguccgccagcacggugugcaagcugcaguccugcacccacgggguccccggcgaccuccagguguaccacaucggcaaccugcugaagggggacaaggugaacggccaccucauccacaagaucgagccgcacuucaacaccagcuggauguccugggacgggugcgaccuggacuacuacugcaacaugggcgacuggcccagcugcaccuacacgggggucacccagcacaaccacgccuccuucgugaaccugcucaacaucgagaccgacuacaccaagaacuuccacuuccacagcaagcgggugacggcgcacggcgacaccccccagcuggaccugaaggcccgccccaccuacggcgccggggagaucaccguccucguggaggucgccgacauggagcugcacacgaagaagaucgagaucuccggccugaaguucgccagccucgcgugcaccgggugcuacgccugcuccagcggcaucuccugcaaggugcggauccacguggacgagccggacgagcugaccguccacgugaagagcgacgaccccgacguggucgccgccuccagcagccugauggcccgcaagcucgaguucgggaccgacuccacguucaaggcguucagcgccaugcccaagaccucccugugcuucuacaucguggagcgggagcacugcaagagcugcuccgaggaggacaccaagaagugcgugaacaccaagcuggagcagccccagagcauccucaucgagcacaagggcaccaucaucggcaagcagaacuccacgugcaccgccaaggccagcugcuggcuggaguccgucaagagcuucuucuacgggcugaagaacaugcucuccggcaucuucgggaacguguucaugggcaucuuccuguuccuggccccguucauccuccugauccuguucuucauguucggguggcgcauccuguucugcuucaagugcugccggcgcacccggggccucuucaaguaccgccaccugaaggacgacgaggagaccggcuaccggcgcaucaucgagaagcugaacaacaagaaggggaagaacaagcuccuggacggcgagcgccuggcggaccggcgcaucgccgagcucuucagcacgaagacccacaucggg

SEQ ID NO: 12389 - RNA, 1932 nt, Artificial Sequence
  derived and/or modified CDS sequence (opt1) from CCHFV(Turkey-Kelkit06)__GQ337054.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccgugguccaccgcggcaacaagauccuggugaccgggcggagcgaguccaucaugaagcucgaggagcgcacgggcgugagcugggaccugggggucgaggacgccuccgagagcaagcugcucaccguguccaucauggaccugagccagauguacucccccguguucgaguaccugagcggcgaccggcaggucgaggaguggcccaaggccaccugcaccggcgacugccccgagcgcugcgggugcacguccagcaccugccuccacaaggaguggagccacucccggaacuggcgcugcaacccgaccuggugcuggggcguggggaccggcugcacgugcugcgggguggacgucaaggaccuguucaccgaccacauguucgugaaguggaagguggaguacaucaagaccgaggccaucgucugcguggcgcugaccagccaggagcggcagugcucccucaucgaggccggcacgcgcuucaaccugggccccgugaccaucacccugagcgagccccggaacauccagcagaagcuccccccggagaucaucacccugcaccccaagaucgaggagggguucuucgaccugaugcacguccagaaggugcucuccgccagcacggugugcaagcugcaguccugcacccacggcauccccggggaccugcaggucuaccacaucggcaaccuccugaagggcgaccgcgugaacgggcaccugauccacaagaucgagagccacuucaacaccuccuggaugagcugggacggcugcgaccucgacuacuacugcaacaugggggacuggcccuccugcaccuacacgggcgugacccagcacaaccacgccgcguucgucaaccugcugaacaucgagaccgacuacaccaagacguuccacuuccacagcaagcgggugaccgcccacggggacaccccgcagcucgaccugaaggcccgccccaccuacggcgccggcgggaucacgguccugguggagguggccgacauggagcuccacaccaagaaggucgagaucuccggccugaaguucgcgagccuggccugcaccgggugcuacgccugcuccagcggcaucuccugcaaggugcggauccacguggacgagcccgacgagcucaccguccacgugaagagcuccgaccccgacguggucgccgccagcacgagccugauggcgcgcaagcuggaguucgggaccgacuccaccuucaaggccuucagcgccaugccgaagaccucccucugcuucuacaucguggagcgggaguacugcaagagcugcuccgaggacgacacccagaagugcguggacacgcgccuggagcagccccagagcauccugaucgagcacaagggcaccaucaucggcaagcagaacgacaccugcaccgccaaggccuccugcuggcucgagagcgucaaguccuucuucuacgggcugaagaacaugcugggcagcguguucgggaaccucuucaucggcauccugcuguuccucgcgcccuucgugcugcugguccuguucuucauguucggguggaagauccucuucugcuucaagugcugccggcgcacgcggggccuguucaaguaccgccaccugaaggacgacgaggagaccggcuaccggcgcaucaucgagcgccucaacuccaagaaggggaagaaccggcugcuggacggcgaccgccucgccgaccggaagaucgccgagcuguucagcaccaagacccacaucggg

SEQ ID NO: 12390 - RNA, 1935 nt, Artificial Sequence
  derived and/or modified CDS sequence (opt1) from CCHFV(SR3)__AJ538199.1__Gc
cucuuccucgacagcaucgugaagggcaugaagaaccugcugaacuccaccagccucgagaccucccugagcaucgaggcccccuggggcgccaucaacguccaguccacguacaagccgaccgugagcaccgcgaacaucgcccuguccuggagcuccguggagcaccgcgggaacaagguccucgugagcgggcgguccgagagcaucaugaagcuggaggagcgcaccggcaucuccugggaccuggggguggaggacgccagcgaguccaagcuccugacggucagcgugauggaccugucccagauguacagccccguguucgaguaccucuccggcgaccggcaggucgaggaguggcccaaggcgaccugcaccggcgacugccccgagcgcugcgggugcaccagcagcacgugccugcacaaggaguggccgcacucccggaacuggcgcugcaaccccaccuggugcuggggcguggggaccggcugcacgugcugcgggcuggacgugaaggaccucuucaccgacuacauguucgucaaguggaagguggaguacaucaagaccgaggccaucgugugcgucgagcugaccagccaggagcggcagugcucccugaucgaggccggcacccgcuucaaccucggcagcgugacgaucacccuguccgagccccggaacauccagcagaagcugcccccggagaucaucacccuccaccccaagaucgaggagggguucuucgaccugaugcacgugcagaagguccugagcgccuccaccgugugcaagcuccagagcugcacgcacggcgugcccggggaccugcaggucuaccacaucggcaaccugcucaagggcgaccgcgugaacgggcaccugauccacaagaucgagcagcacuucaacaccuccuggaugagcugggacggcugcgaccuggacuacuacugcaacaugggggacuggcccuccugcaccuacaccggcgugacgcagcacaaccacgccagcuucgucaaccuccugaacaucgagaccgacuacaccaagaccuuccacuuccacuccaagcgggugacggcccacggggacaccccgcagcuggaccucaaggcgcgccccaccuacggcgccggcgagaucaccguccugguggagguggccgacauggagcugcacacgaagaagaucgagaucagcgggcucaaguucgccggccugaccugcaccgggugcuacgccugcuccagcggcaucuccugcaagguccggauccacguggacgagcccgacgagcugaccgugcacgucaagagcgacgaccccgacgugguggcggccuccagcagccucauggcccgcaagcuggaguucgggacggacuccaccuucaaggccuucagcgccaugccgaagaccucccugugcuucuacaucgucgagcgggaguacugcaagagcugcaacaaggaggacacccagaagugcgugaacaccaagcucgagcagccccaguccauccugaucgagcacaagggcacgaucaucggcaagcagaacaacacgugcaccgcgaaggccagcugcuggcuggaguccgucaagagcuucuucuacgggcucaagaacaugcugggcgggaucuucggcaacguguucaucgggaucuucaccuuccugacccccuucauccuccugauccuguucuucauguucggcuggcgcauccuguucugcuucaagugcugccggcgcacccggggccucuucaaguaccgccaccugaaggacgacgaggagaccggguaccggaagaucaucgagcgccugaacaacaagaagggcaagaaccgccuccuggacggggagcggcuggccgaccgcaagaucgccgagcuguucuccaccaagacgcacaucggc

SEQ ID NO: 12391 - RNA, 1935 nt, Artificial Sequence
  derived and/or modified CDS sequence (opt1) from CCHFV(UCCR4413)__KY484038.1__Gc
uuccugagcuccaucgugaagggcaagaagaaccuccugaacagcgccucccuggagaccagccucuccaucgaggcccccuggggcgcgaucaacgcccagagcaccuucaagccgacgaucuccaccgccaacaucgcccugagcugguccagcgucgagcaccgcgggaacaaggugcugguguccgggcggagcgaguccaucaugaagcucgaggagcgcaccggcaucagcuggaaccugggggucgaggacgccuccgagagccggaugcugaccguguccgugauggaccucagccagauguaccugcccgucuucgaguaccuguccggcgaccgccagguggaggaguggcccaaggcgacgugcaccggcgacugccccgagcggugcgggugcaccagcagcacgugccuccacaaggaguggccgcacucccgcaacuggcggugcaaccccaccuggugcuggggcguggggaccggcugcacgugcugcgggcuggacgucaaggaccuguucaccgacuacauguucgugaaguggaagguggaguacaucaagaccgaggccaucgucugcguggagcucaccagccaggagcgccagugcucccugaucgaggccggcacccgguucaaccugggccccgugaccaucacgcucagcgagccccgcaacauccagcagaagcugccguccgagaucgucacccugcaccccaagaucgaggagggguucuucgaccucaugcacgugcagaaggugcugagcgccuccaccgucugcaagcugcagagcugcacccacggcguggcgggggaccuccagguguaccacgucggcaaccugcugaagggcgacaagaucaacgggcacuccauccacaagaucgagccccaccucaacacgagcuggauguccugggacggcugcgaccuggacuacuacugcaacaugggggacuggcccagcugcaccuacaccggcgugacccagcacaaccacgccgccuucgugaaccugcucaacaucgagacggacuacaccaaguccuuccacuuccacagcaagcgggucaccgcccacggggacaccccgcagcuggaccugaaggcccgccccauguacggcgcgggcgagaucacggugcucgucgagguggccgacauggagcugcacuccaagaacaucgagaucagcgggcugaaguucgccucccugaccugcagcggcugcuacgccugcuccagcgggaucagcugcaaggugcggauccacgucgacgagcccgacgagcucgccgugcacgugaaguccgacgaccuggacgucguggcggccagcuccagccucauggcccgcaagaucgaguucggcaccgacuccaccuucaaggccuucagcuccaugcccaaggagagccugugcuucuacaucguggagcgggacuucugcaaguccugcgccgcggaggacacgcagaagugcgucaaggccaagcuggagcagccgcagagcauccucaucgagcacaaggggaccaucaucggcaagcagaacgacacgugcuccaccaagaccagcugcuggcuggaguccuucaagagcuucuucuacggccugaagaacaugcucuccgggguguucggcagcgccaucauggggauccugcuguuccucgcccccuucauccugcugauccuguucuucuucuucggcuggcgcauccucuucugccugcggugcugccgccggacccgcgggcuguucaaguacaagcacaucaaggacgacgaggaggccggcuacaagaagaucaucgagaagcucaacaacaagaagggcgggaccuccaagcugcuggacggcgagcggcucgcggaccgcaagaucgccgagcuguucagcaccaaggcccacaucggg

SEQ ID NO: 12392 - RNA, 1932 nt, Artificial Sequence
  derived and/or modified CDS sequence (opt1) from CCHFV(66019)__AB069669.1__Gc
uucagcgacuccaucgugaagggcaugaagaaccugcucaacagcaccucccuggagaccagccuguccaucgaggcccccuggggcgccaucaacguccagagcacguucaagccgaccguguccaccgcgaacaucgcccucagcugguccagcguggagcaccgcgggaacaagauccuggucuccgggcggagcgaguccaucaugaagcuggaggagcgcaccggcaucagcugggaccucgggguggaggacgccuccgagagcaagcugcugacgguguccgucauggaccucagccagauguacucccccguguucgaguaccugagcggcgaccgccagguggaggaguggcccaaggcgaccugcaccggcaacugccccgaccggugcgggugcaccagcuccacgugccugcacaaggaguggccgcacagccggaacuggcgcugcaaccccaccuggugcuggggcgucgggaccggcugcacgugcugcgggcucgacgugaaggaccuguucaccgacuacauguucgugaaguggaaggucgaguacaucaagaccgaggccaucgugugcguggagcugaacucccaggagcggcagugcagccucaucgaggccggcacccgcuucaaccugggccccgucaccaucacgcuguccgagccccggaacauccagcagaagcucccgagcgagaucaucacccugcacccccgcaucgaggagggguucuucgaccugaugcacgugcagaaggugcucuccgccagcaccgucugcaagcugcaguccugcacccacggcgugcccggggaccugcagaucuaccacaucggcaaccuccugaagggcgaccgggugaacgggcaccugauccacaagaucgagccccacuucaacacgagcuggauguccugggacggcugcgaccucgacuacuacugcaacaugggggacuggccgagcugcaccuacaccggcgucacccagcacaaccacgccgccuucgugaaccugcugaacaucgagacggacuacaccaagaacuuccacuuccacuccaagcgcgugaccgcgcacggggacacgccccagcucgaccugaaggcccggcccaccuacggcgccggcgagaucaccguccugguggaggucgccgacauggagcuccacaccaagaagaucgccaucagcgggcugaaguucgcgucccugaccugcacgggcugcuacgccugcagcuccgggaucagcugcaaggugcgcauccacguggacgagcccgacgagcucaccguccacgugaaguccgaggacccggacaucguggccgccagcagcucccugauggcccggaagcuggaguucggcaccgacagcaccuucaaggcguucuccgccaugcccaagacgagccucugcuucuacaucgucgagcgcgaguacugcgaguccugcagcaaggaggacacccagaagugcgugaacaccaagcuggagcagccccaguccauccugaucgagcacaaggggaccaucaucggcaagcagaacgacacgugcaccgccaaggccagcugcuggcucgaguccgucaagagcuucuucuacggccugaagaacaugcuguccgggaucuucggcaacguguucaucgggaucuuccucuuccuggcccccuucauccugcucauccuguucuucauguucggcuggcggauccuguucugcuucaagugcugccgccggacccgcgggcuguucaaguaccgguaccucaaggacgacgaggagagcggcuaccgccgcaucaucgagcggcugaacaacaagaagggcaagaacaagcugcucgacggggagcgccuggcggaccggcgcaucgccgagcuguucuccaccaagacccacaucggc

SEQ ID NO: 12393 - RNA, 1932 nt, Artificial Sequence
  derived and/or modified CDS sequence (opt1) from CCHFV(7001)__AB069670.1__Gc
uuccuggacaacaucgccaagggcaugaagucccuccugaacagcaccagccuggagaccucccucagcaucgaggcccccuggggcgcgaucaacgugcaguccacguucaagccgaccgucagcgccgccaacaucgcccuguccuggagcuccguggagcaccgcgggaacaagauccuggugagcgggcgguccgagagcaucaugaagcucgaggagcgcaccggcgucuccuggaaccuggggguggaggacgccagcgaguccaagacccugacggugagcgucauggaccucucccagauguacagccccguguucgaguaccuguccggcgaccgccagguggaggaguggcccaaggcgaccugcaccggcgacugccccgagcggugcgggugcaccagcagcacgugccugcacaaggaguggccgcacucccggaacuggcgcugcaaccccaccuggugcuggggcgucgggaccggcugcacgugcugcgggcucgacgugaaggacuucuucaccgacuacaugcuggugaaguggaaggucgaguacaucaagaccgaggccaucgugugcguggagcugaccagccaggagcggcagugcucccucaucgaggccggcacccgcuucaaccugggccccgucacgaucacccugagcgagccccggaacgugcagcagcgccucccgcccgagaucgugacccugcaccccaagaucgaggagggguucuucgaccugaugcacguccagaagauccucuccgccagcaccgugugcaagcugcaguccugcacgcacggcgugcccggggacuuccaggucuaccacgugggcaaccugcuccggggcgacaaggugaacgggcacagcauccacaagaucgagccgcacuucaacaccuccuggaugagcugggacggcugcgaccuggacuacuucugcaacaugggggacuggcccuccugcaccuacaccggcgucacgcagcacaaccgcgcggccuucaucaacaugcugaacaucgagaccgacuacaccaagaccuuccacuuccacagcaagcgggugacggcccacggggacacgccccagcucgaccugaaggcccgccccgccuacggcgcgggcgaggucaccgugcugguggaggucgccgaccucgagcugcacaccaagaagcuggagguguccgggcucaagaucgccagccugaccugcuccggcugcuacgccugcagcuccgggaucagcugcaaggugcggauccacgucaacgagccggacgaguucaccgugcacgugcgcuccagcgaccccgacgucguggccgcgggcagcucccugauggcccggaagaucgaguucggggccgacagcaccuucaaggccuucuccagcaugcccaaggacucccucugcuucuacaucguggagaaggacuacugcagcuccugcaccgacgacgacacgcagaagugcgucaacaccaagcuggaccacccccagagcauccugaucgagcacaagggcaccaucaucggcaagcagaacgacacgugcuccaccaagaccagcugcuggcucgaguccgugaagggguucuucuacggccugaagaacaugcugagcgggaucuucggcaacguguuccucgggaucuuccuguuccuggccccguucguccuccugaucuucuucuucuucuucggcuggcgccuccuguucugccugaagugcugccggcgcacccggggccugcugaaguacaagcaccucaaggacgaggaggaggcgggguacaagaagaucaucgagcgccugaacggcaagaaggggaagucccagcuguucgacggcgagcgccucgccgaccggaagaucgccgagcuguucagcaccaagauccacaucggc

SEQ ID NO: 12394 - RNA, 1932 nt, Artificial Sequence
  derived and/or modified CDS sequence (opt1) from CCHFV(75024)__AB069671.1__Gc
uuccuggacagcaucgugcgcggcaugaagaaccagcucaacuccaccagccuggagaccucccugagcaucgaggcccccuggggggccaucaacguccaguccacguacaagccgaccgugagcaccgcgaacaucgcccucuccuggagcuccguggagcaccggggcaacaagauccuggucagcgggcgcuccgagagcaucaugaagcuggaggagcggaccggcaucuccugggaccucgggguggaggacgccagcgaguccaagcugcugacggugagcgucauggaccucucccagauguacagccccguguucgaguaccuguccggcgaccgccagguggaggaguggcccaaggccaccugcaccggcgacugccccgagcggugcgggugcaccacgagcaccugccugcacaaggaguggccgcacagccgcaacuggcggugcaaccccaccuggugcuggggcgucgggaccggcugcacgugcugcgggcucgacgugaaggaccuguucaccgacuacaugaucgugaaguggaaggucgaguacaucaagaccgaggccaucgugugcguggagcugaccucccaggagcgccagugcagccucaucgaggcgggcacgcgguucaaccugggcuccgucaccaucacccugagcgagccccgcaacauccagcagaagcuccccccggagaucaucacccugcacccccggaucgaggagggguucuucgaccugaugcacgugcagaaggugcucuccgccagcacggucugcaagcugcaguccugcacccacggcgugcccggggaccugcagguguaccacgucggcaaccuccugaagggcgacaaggugaacgggcaccugauccacaagaucgagccccaccucaacaccagcuggauguccugggacggcugcgaccuggacuacuacugcaacaugggggacuggccgagcugcaccuacacgggcgugacccagcacaaccacgccuccuucgucaaccugcucaacaucgagaccgacuacaccaagagcuuccacuuccacuccaagcgcgugacggcccacggggacaccccccagcuggaccugaaggcgcggcccaccuacggcgccggcgagaucaccguccucguggagguggccgacauggaguucacgcccaagaagaucgagaucagcgggcugaaguucgccucccugaccugcaccggcugcuacgccugcagcuccgggaucagcugcaagguccgcauccacguggacgagccggacgagcucaccgugcacgucaaguccgacgaccccgacgugguggcggccagcagcucccugauggcccggaagcuggaguucggcacggacagcaccuucaaggccuucuccgccaugcccaagaccagccucugcuucuacaucgucgagcgcgaguacugcaaguccugcagcaaggaggacacccagaagugcgugaacaccaagcuggagcagccccaguccauccugaucgagcacaaggggacgaucaucggcaagcagaacaacaccugcaccgcgaaggccagcugcuggcucgaguccgugaagagcuucuucuacggccugaagaacaugcuguccgggaucuucggcaaccucuucauggggaucuuccuguuccuggccccguucauccuccugauccuguucuucauguucggcuggcggauccuguucugcuucaagugcugccgccggacccgcgggcucuucaaguaccggcaccugaaggacgacgaggagacgggcuaccgccgcaucaucgagcggcugaacaacaagaagggcaagaacaagcuccuggacggggagcgccuggccgaccggcgcaucgccgagcucuucagcaccaagacccacaucggc

SEQ ID NO: 12395 - RNA, 1932 nt, Artificial Sequence
  derived and/or modified CDS sequence (opt1) from CCHFV(7803)__AB069672.1__Gc
uuccuggacagcaucgugcgcggcaugaagaacccccucaacuccaccagccuggagaccucccugagcaucgaggccccguggggggccaucaacguccaguccacguacaagcccaccgugagcaccgcgaacaucgcccucuccuggagcuccguggagcaccggggcaacaagauccuggucagcgggcgcuccgagagcaucaugaagcuggaggagcggaccggcaucuccugggaccucgggguggaggacgccagcgaguccaagcugcugacggugagcgucauggaccucucccagauguacagccccguguucgaguaccuguccggcgaccgccagguggaggaguggcccaaggccaccugcaccggcgacugcccggagcggugcgggugcaccacgagcaccugccugcacaaggaguggccccacagccgcaacuggcggugcaaccccaccuggugcuggggcgucgggaccggcugcacgugcugcgggcucgacgugaaggaccuguucaccgacuacaugaucgugaaguggaaggucgaguacaucaagacccgcggcaucgugugcguggagcugaccucccaggagcggcagugcagccucaucgaggccggcacgcgcuucaaccugggguccgucaccaucacccugagcgagccccggaacauccagcagaagcucccgcccgagaucaucacccugcacccccgcaucgaggagggcuucuucgaccugaugcacgugcagaaggugcucuccgcgagcacggucugcaagcugcaguccugcacccacggggugcccggcgaccugcagguguaccacgucggcaaccuccugaagggggacaaggugaacggccaccugauccacaagaucgagccgcaccucaacaccagcuggauguccugggacgggugcgaccuggacuacuacugcaacaugggcgacuggcccagcugcaccuacacgggggugacccagcacaaccacgccuccuucgucaaccugcucaacaucgagaccgacuacaccaagagcuuccacuuccacuccaagcgggugacggcccacggcgacaccccccagcuggaccugaaggcccgccccaccuacggcgcgggggagaucaccguccucguggagguggccgacauggaguucacgccgaagaagaucgagaucagcggccugaaguucgccucccugaccugcaccgggugcuacgccugcagcuccggcaucagcugcaagguccggauccacguggacgagcccgacgagcucaccgugcacgucaaguccgacgaccccgacgugguggccgcgagcagcucccugauggcccgcaagcuggaguucgggacggacagcaccuucaaggccuucuccgccaugcccaagaccagccucugcuucuacaucgucgagcgggaguacugcaaguccugcagcaaggaggacacccagaagugcgugaacaccaagcuggagcagccgcaguccauccugaucgagcacaagggcacgaucaucggcaagcagaacaacaccugcaccgccaaggcgagcugcuggcucgaguccgugaagagcuucuucuacgggcugaagaacaugcuguccggcaucuucgggaacuucuucaugggcaucuuccucuuccuggcccccuucauccugcucauccuguucuucauguucggguggcgcauccuguucugcuucaagugcugccggcgcacccggggccuguucaaguaccgccaccucaaggacgacgaggagacgggcuaccgccggaucaucgagcgccugaacaacaagaaggggaagaacaagcugcucgacggcgagcggcuggccgaccgccggaucgccgagcuguucagcaccaagacccacaucggg

SEQ ID NO: 12396 - RNA, 1932 nt, Artificial Sequence
  derived and/or modified CDS sequence (opt1) from CCHFV(79121)__AB069673.1__Gc
uuccuggacagcaccgccaagggcaugaagucccuccugaacagcaccucccuggagacgagccucuccaucgaggcccccuggggggcgaucaacgugcagagcaccuucaagccgaccgucuccgccgccaacaucgcccugagcugguccagcguggagcaccgcggcaacaagauccugguguccgggcggagcgaguccaucaugaagcucgaggagcgcaccggcgucagcuggaaccuggggguggaggacgccuccgagagcaagacgcugaccguguccgucauggaccucagccagauguacucccccguguucgaguaccugagcggcgaccggcagguggaggaguggcccaaggcgaccugcaccggcgacugccccgagcgcugcgggugcacgagcuccaccugccugcacaaggaguggccgcacagccggaacuggcgcugcaaccccaccuggugcuggggcgucgggaccggcugcacgugcugcgggcucgacgugaaggacuucuucaccgacuacaugcuggugaaguggaaggucgaguacaucaagaccgaggccaucgugugcguggagcugaccucccaggagcggcagugcagccucaucgaggccggcacgcgcuucaaccugggccccgucaccaucacccuguccgagccccggaacgugcagcagcgccucccgcccgagaucgugacccugcaccccaagaucgaggagggguucuucgaccugaugcacguccagaagauccucagcgccuccacggugugcaagcugcagagcugcacccacggcgugcccggggacuuccagaucuaccacgucggcaaccugcuccggggcgacaaggugaacgggcacuccauccacaagaucgagccgcacuucaacaccagcuggauguccugggacggcugcgaccuggacuacuucugcaacaugggggacuggcccagcugcaccuacacgggcgugacccagcacaaccgcgcggccuucaucaacaugcugaacaucgagaccgacuacaccaagacguuccacuuccacuccaagcgggucaccgcccacggggacaccccccagcucgaccugaaggcccgccccgccuacggcgcgggcgaggugaccguccugguggagguggccgaccucgagcugcacacgaagaaccuggaggucagcgggcucaagaucgccucccugaccugcagcggcugcuacgccugcuccagcgggaucuccugcaaggugcggauccacgugaacgagccggacgaguucaccguccacgugcgcagcagcgaccccgacguggucgccgcgggcuccagccugauggcccggaagaucgaguucggggccgacuccaccuucaaggccuucagcuccaugcccaaggacagccucugcuucuacaucguggagaaggacuacugcuccagcugcacggacgacgacacccagaagugcgugaacaccaagcuggaccacccccaguccauccugaucgagcacaagggcaccaucaucggcaagcagaacgacaccugcagcacgaagaccuccugcuggcucgagagcgucaagggguucuucuacggccugaagaacaugcuguccgggaucuucggcaacguguuccucgggaucuuccuguuccuggccccguucgugcuccugaucuucuucuucuucuucggcuggcgccugcucuucugccugaagugcugccggcgcacccggggccugcugaaguacaagcaccucaaggacgaggaggaggcgggguacaagaagaucaucgagcgccugaacggcaagaaggggaagagccagcuguucgacggcgagcgccucgccgaccggaagaucgccgagcuguucuccaccaagauccacaucggc

SEQ ID NO: 12397 - RNA, 1932 nt, Artificial Sequence
  derived and/or modified CDS sequence (opt1) from CCHFV(8402)__AB069674.1__Gc
uucagcgacuccaucgugaagggcaugaagaaccugcucaacagcaccucccuggagaccagccuguccaucgaggcccccuggggcgccaucaacguccagagcacguucaagccgaccguguccgcggccaacaucgcccucagcugguccagcguggagcaccgcgggaacaagauccuggucuccgggcggagcgaguccaucaugaagcuggaggagcgcaccggcaucagcugggaccucgggguggaggacgccuccgagagcaagcugcugaccguguccgucauggaccucagccagauguacucccccguguucgaguaccugagcggcgaccgccagguggaggaguggcccaaggccacgugcaccggcgacugccccgagcggugcgggugcaccagcuccacgugccugcacaaggaguggccgcacagccggaacuggcgcugcaaccccaccuggugcuggggcgucgggaccggcugcacgugcugcgggcucgacgugaaggaccuguucaccgacuacauguucaucaaguggaagguggaguacaucaagaccgaggcgaucgucugcguggagcugaccucccaggagcggcagugcacccucaucgaggccggcacccgcuucaaccugggccccgugacgaucacccugagcgagccccggaacauccagcagaagcucccgcccgagaucgucacccugcacccccgcaucgaggagggguucuucgaccugaugcacgugcagaaggugcucuccgccagcaccgucugcaagcugcaguccugcacgcacggcgugcccggggaccuccagguguaccacaucggcaaccuccugaagggcgacaaggucaacgggcaccugauccacaagaucgagccgcacuucaacaccagcuggauguccugggacggcugcgaccucgacuacuacugcaacaugggggacuggcccagcugcaccuacaccggcgugacgcagcacaaccacgccgcguucgugaacaugcugaacaucgagaccgacuacaccaagaacuuccacuuccacuccaagcgggucaccgcccacggggacacgccccagcuggaccucaaggcccgccccaccuacggcgccggcgagaucaccgugcuggucgagguggccgacauggagcugcacaccaagaagaucgagaucagcgggcucaaguucgcgucccugacgugcaccggcugcuacgccugcagcuccgggaucagcugcaaggugcggauccacgucgacgagccggacgagcugaccgugcacgugaaguccgaggaccccgacaucgucgccgccagcuccagccucauggcccgcaagcuggaguucggcaccgacagcacguucaaggcguucuccgccaugcccaagaccagccugugcuucuacaucguggagcgggaguacugcaaguccugcagcaaggaggacacccagaagugcgugaacaccaagcucgagcagccccaguccauccugaucgagcacaaggggaccaucaucggcaagcagagcaacacgugcaccgccaaggccuccugcuggcuggagagcgucaaguccuucuucuacggccucaagaacaugcugagcgggaucuucggcaacguguucaucgggguguuccuguucuucgccccguucauccuccugauccuguucuucauguucggcuggcgcauccucuucugcuucaagugcugccggcgcacccgggggcuguucaaguaccgccaccugaaggacgacgaggagaccggcuaccggaagaucaucgagcgccugaacaacaagaagggcaagaacaagcuccuggacggggagcgccuggcggaccggaagaucgccgagcuguucuccacgaagacccacaucggc

SEQ ID NO: 12398 - RNA, 1932 nt, Artificial Sequence
  derived and/or modified CDS sequence (opt1) from CCHFV(88166)__AB069675.1__Gc
uucagcgacuccaucgugaagggcaugaagaaccugcucaacagcaccucccuggagaccagccuguccaucgaggcccccuggggcgccaucaacguccagagcacguucaagccgaccauguccgcggccaacaucgcccucagcugguccagcguggagcaccgcgggaacaagauccugguguccgggcggagcgaguccaucaugaagcuggaggagcgcaccggcaucagcuggaaccucggggucgaggacgccuccgagagcaagcugcugaccguguccgugauggaccucagccagauguacucccccgucuucgaguaccugagcggcgaccgccagguggaggaguggcccaaggccacgugcaccggcgacugccccgagcggugcgggugcaccagcuccacgugccugcacaaggaguggccgcacagccggaacuggcgcugcaaccccaccuggugcuggggcguggggaccggcugcacgugcugcgggcucgacgucaaggaccuguucaccgacuacauguucaucaaguggaagguggaguacaucaagaccgaggcgaucgugugcgucgagcugaccucccaggagcggcagugcacccucaucgaggccggcacccgcuucaaccugggccccgugacgaucacccugagcgagccccggaacauccagcagaagcucccgcccgagaucgugacccugcacccccgcaucgaggagggguucuucgaccugaugcacguccagaaggugcucuccgccagcaccgugugcaagcugcaguccugcacgcacggcguccccggggaccuccagguguaccacaucggcaaccugcugaagggcgacaaggugaacgggcaccugauccacaagaucgagccgcacuucaacaccagcuggauguccugggacggcugcgaccucgacuacuacugcaacaugggggacuggcccagcugcaccuacaccggcgucacgcagcacaaccacgccgcguucgugaacaugcugaacaucgagaccgacuacaccaagaacuuccacuuccacuccaagcgggugaccgcccacggggacacgccccagcuggaccucaaggcccgccccaccuacggcgccggcgagaucaccguccugguggaggucgccgacauggagcugcacaccaagaagaucgagaucagcgggcucaaguucgcgucccugacgugcaccggcugcuacgccugcagcuccgggaucagcugcaaggugcggauccacguggacgagccggacgagcugaccguccacgugaaguccgaggaccccgaccucguggccgccagcuccagccugauggcccgcaagcuggaguucggcaccgacagcacguucaaggcguucuccgccaugcccaagaccagccucugcuucuacaucgucgagcgggaguacugcaaguccugcagcaaggaggacacccagaagugcgugaacaccaagcuggagcagccccaguccauccugaucgagcacaaggggaccaucaucggcaagcagaacaacacgugcaccgccaaggccagcugcuggcucgaguccgucaagagcuucuucuacggccugaagaacaugcuguccgggaucuucggcaacguguucaucgggguguuccucuucuucgccccguucauccugcugauccucuucuucauguucggcuggcgcauccuguucugcuucaagugcugccggcgcacccgggggcuguucaaguaccgccaccugaaggacgacgaggagaccggcuaccggaagaucaucgagcgccucaacaacaagaagggcaagaacaagcugcuggacggggagcgccucgcggaccggaagaucgccgagcuguucagcacgaagacccacaucggc

SEQ ID NO: 12399 - RNA, 1932 nt, Artificial Sequence
  derived and/or modified CDS sequence (opt1) from CCHFV(BA88166)__AF338470.1__Gc
uaccuggacagcaucgugaagggcaugaagaaccuccugaacuccaccagccuggagaccucccucagcaucgaggcccccuggggcgccaucaacguccaguccacguucaagccgaccaugagcgcggccaacaucgcccuguccuggagcuccguggagcaccgcgggaacaagauccuggugagcgggcgguccgagagcaucaugaagcucgaggagcgcaccggcaucuccuggaaccugggggucgaggacgccagcgaguccaagcugcucaccgugagcgugauggaccugucccagauguacagccccgucuucgaguaccuguccggcgaccgccagguggaggaguggcccaaggccacgugcaccggcgacugccccgagcggugcgggugcaccagcagcacgugccuccacaaggaguggccgcacucccggaacuggcgcugcaaccccaccuggugcuggggcguggggaccggcugcacgugcugcgggcuggacgucaaggaccuguucaccgacuacauguucaucaaguggaagguggaguacaucaagaccgaggcgaucgugugcgucgagcucaccagccaggagcggcagugcacccugaucgaggccggcacccgcuucaaccugggccccgugaucaucacgcucuccgagccccggaacauccagcagaagcugccgcccgagaucgugacccugcacccccgcaucgaggagggguucuucgaccucaugcacguccagaaggugcugagcgccuccaccgugugcaagcugcagagcugcacccacggcguccccggggaccuccagguguaccacaucggcaaccugcugaagggcgacaaggugaacgggcaccucauccacaagaucgagccgcacuucaacacguccuggaugagcugggacggcugcgaccuggacuacuacugcaacaugggggacuggcccuccugcaccuacaccggcgucacccagcacaaccacgccgcguucgugaacaugcugaacaucgagacggacuacaccaagaacuuccacuuccacagcaagcgggugaccgcccacggggacacgccccagcucgaccugaaggcccgccccaccuacggcgccggcgagaucaccguccugguggaggucgccgacauggagcuccacaccaagaagaucgagaucuccgggcugaaguucgcgagccugaccugcacgggcugcuacgccugcuccagcgggaucuccugcaaggugcggauccacguggacgagccggacgagcucaccguccacgucaagagcgaggaccccgacaucguggccgccuccagcucccugauggcccgcaagcuggaguucggcaccgacagcaccuucaaggcguucagcgccaugcccaagacgucccucugcuucuacaucguggagcgggaguacugcaagagcugcuccaaggaggacacccagaagugcgugaacaccaagcuggagcagccccagagcauccugaucgagcacaaggggaccaucaucggcaagcagaacaacacgugcaccgccaaggccuccugcuggcucgagagcgugaaguccuucuucuacggccugaagaacaugcugagcgggaucuucggcaacgucuucaucgggguguuccucuucuucgccccguucauccugcugauccucuucuucauguucggcuggcgcauccuguucugcuucaagugcugccggcgcacccgggggcuguucaaguaccgccaccugaaggacgacgaggagaccggcuaccggaagaucaucgagcgccucaacaacaagaagggcaagaacaagcugcuggacggggagcgccucgcggaccggaagaucgccgagcuguucuccaccaagacgcacaucggc

SEQ ID NO: 12400 - RNA, 1932 nt, Artificial Sequence
  derived and/or modified CDS sequence (opt1) from CCHFV(BA66019)__AF350448.1__Gc
uucagcgacuccaucgugaagggcaugaagaaccugcucaacagcaccucccuggagaccagccuguccaucgaggcccccuggggcgccaucaacguccagagcacguucaagccgaccguguccaccgcgaacaucgcccucagcugguccagcguggagcaccgcgggaacaagauccuggucuccgggcggagcgaguccaucaugaagcuggaggagcgcaccggcaucagcugggaccucgggguggaggacgccuccgagagcaagcugcugacgguguccgucauggaccucagccagauguacucccccguguucgaguaccugagcggcgaccgccagguggaggaguggcccaaggcgaccugcaccggcgacugccccgaccggugcgggugcaccagcuccacgugccugcacaaggaguggccgcacagccggaacuggcgcugcaaccccaccuggugcuggggcgucgggaccggcugcacgugcugcgggcucgacgugaaggaccuguucaccgacuacauguucgugaaguggaaggucgaguacaucaagaccgaggccaucgugugcguggagcugaacucccaggagcggcagugcagccucaucgaggccggcacccgcuucaaccugggccccgucaccaucacgcuguccgagccccggaacauccagcagaagcucccgcccgagaucaucacccugcacccccgcaucgaggagggguucuucgaccugaugcacgugcagaaggugcucagcgccuccaccgucugcaagcugcagagcugcacccacggcgugcccggggaccugcagaucuaccacaucggcaaccuccugaagggcgaccgggugaacgggcaccugauccacaagaucgagccgcacuucaacacguccuggaugagcugggacggcugcgaccucgacuacuacugcaacaugggggacuggcccuccugcaccuacaccggcgucacccagcacaaccacgccgccuucgugaaccugcugaacaucgagacggacuacaccaagaacuuccacuuccacagcaagcgcgugaccgcgcacggggacacgccccagcucgaccugaaggcccggcccaccuacggcgccggcgagaucaccguccugguggaggucgccgacauggagcuccacaccaagaagaucgccaucuccgggcugaaguucgcgagccugaccugcacgggcugcuacgccugcuccagcgggaucuccugcaaggugcgcauccacguggacgagccggacgagcucaccguccacgucaagagcgaggaccccgacaucguggccgccuccagcagccugauggcccggaagcuggaguucggcaccgacuccaccuucaaggcguucagcgccaugcccaagacgucccucugcuucuacaucguggagcgcgaguacugcgagagcugcuccaaggaggacacccagaagugcgugaacaccaagcuggagcagccccagagcauccugaucgagcacaaggggaccaucaucggcaagcagaacgacacgugcaccgccaaggccuccugcuggcucgagagcgugaaguccuucuucuacggccugaagaacaugcugagcgggaucuucggcaacgucuucaucgggaucuuccucuuccuggccccguucauccugcucauccuguucuucauguucggcuggcggauccuguucugcuucaagugcugccgccggacccgcgggcuguucaaguaccgguaccucaaggacgacgaggaguccggcuaccgccgcaucaucgagcggcugaacaacaagaagggcaagaacaagcugcucgacggggagcgccuggcggaccggcgcaucgccgagcuguucagcaccaagacccacaucggc

SEQ ID NO: 12401 - RNA, 1932 nt, Artificial Sequence
  derived and/or modified CDS sequence (opt1) from CCHFV(BA8402)__AF350449.1__Gc
uucagcgacuccaucgugaagggcaugaagaaccugcucaacagcaccucccuggagaccagccuguccaucgaggcccccuggggcgccaucaacguccagagcacguucaagccgaccguguccgcggccaacaucgcccucagcugguccagcguggagcaccgcgggaacaagauccuggucuccgggcggagcgaguccaucaugaagcuggaggagcgcaccggcaucagcugggaccucgggguggaggacgccuccgagagcaagcugcugaccguguccgucauggaccucagccagauguacucccccguguucgaguaccugagcggcgaccgccagguggaggaguggcccaaggccacgugcaccggcgacugccccgagcggugcgggugcaccagcuccacgugccugcacaaggaguggccgcacagccggaacuggcgcugcaaccccaccuggugcuggggcgucgggaccggcugcacgugcugcgggcucgacgugaaggaccuguucaccgacuacauguucaucaaguggaagguggaguacaucaagaccgaggcgaucgucugcguggagcugaccucccaggagcggcagugcacccucaucgaggccggcacccgcuucaaccugggccccgugacgaucacccugagcgagccccggaacauccagcagaagcucccgcccgagaucgucacccugcacccccgcaucgaggagggguucuucgaccugaugcacgugcagaaggugcucuccgccagcaccgucugcaagcugcaguccugcacgcacggcgugcccggggaccuccagguguaccacaucggcaaccuccugaagggcgacaaggucaacgggcaccugauccacaagaucgagccgcacuucaacaccagcuggauguccugggacggcugcgaccuccacuacuacugcaacaugggggacuggcccagcugcaccuacaccggcgugacgcagcacaaccacgccgcguucgugaacaugcugaacaucgagaccgacuacaccaagaacuuccacuuccacuccaagcgggucaccgcccacggggacacgccccagcuggaccucaaggcccgccccaccuacggcgccggcgagaucaccgugcuggucgagguggccgacauggagcugcacaccaagaagaucgagaucagcgggcucaaguucgcgucccugacgugcaccggcugcuacgccugcagcuccgggaucagcugcaaggugcggauccacgucgacgagccggacgagcugaccgugcacgugaaguccgaggaccccgacaucgucgccgccagcuccagccucauggcccgcaagcuggaguucggcaccgacagcacguucaaggcguucuccgccaugcccaagaccagccugugcuucuacaucguggagcgggaguacugcgaguccugcagcaaggaggacacccagaagugcgugaacaccaagcucgagcagccccaguccauccugaucgagcacaaggggaccaucaucggcaagcagagcaacacgugcaccgccaaggccuccugcuggcuggagagcgucaaguccuucuucuacggccucaagaacaugcugagcgggaucuucggcaacguguucaucgggguguuccuguucuucgccccguucauccuccugauccuguucuucauguucggcuggcgcauccucuucugcuucaagugcugccggcgcacccgggggcuguucaaguaccgccaccugaaggacgacgaggagaccggcuaccggaagaucaucgagcgccugaacaacaagaagggcaagaacaagcuccuggacggggagcgccuggcggaccggaagaucgccgagcuguucuccacgaagacccacaucggc

SEQ ID NO: 12402 - RNA, 1932 nt, Artificial Sequence
  derived and/or modified CDS sequence (opt1) from CCHFV(Matin)__AF467769.2__Gc
uuccuggacagcaucaucaagggcaugaagaaccuccugaacuccaccagccuggagaccucccucagcaucgaggcccccuggggcgccaucaacgugcaguccacguucaagccgaccaugagcgcggccaacaucgcccuguccuggagcuccgucgagcaccgcgggaacaagauccuggugagcgggcgguccgagagcaucaugaagcucgaggagcgcaccggcaucuccugggaccuggggguggaggacgccagcgaguccaagcugcucaccgucagcgugauggaccugucccagauguacagccccguguucgaguaccuguccggcgaccggcaggucgaggaguggcccaaggccacgugcaccggcgacugccccgagcgcugcgggugcaccagcagcacgugccuccacaaggaguggccgcacucccggaacuggcgcugcaaccccaccuggugcuggggcguggggaccggcugcacgugcugcgggcuggacgugaaggaccuguucaccgacuacauguucgucaaguggaagguggaguacaucaagaccgaggugaucgucugcguggagcucaccagccaggagcggcagugcucccugaucgaggcgggcacccgcuucaaccugggccccgugaccaucacgcucagcgagccccggaacauccagcagaagcugccgcccgagaucgucacccugcacccccgcaucgaggagggguucuucgaccucaugcacgugcagaaggugcuguccgccagcaccgucugcaagcugcaguccugcacccacggcgugcccggggaccuccagguguaccacaucggcaaccugcugaagggcgacaaggucaacgggcaccucauccacaagaucgagccgcacuucaacacgagcuggauguccugggacggcugcgaccuggacuacuacugcaacaugggggacuggcccagcugcuccuacaccggcgugacccagcacaaccacgccgccuucgugaacaugcugagcaucgagaccgacuacacgaagaacuuccacuuccacuccaagcgggucaccgcgcacggggacacgccccagcucgaccugaaggcccgccccaccuacggcgccggcgagaucaccgugcuggucgagguggccgacauggagcuccacaccaagaagaucgagaucagcgggcugaaguucgccucccugaccugcaccggcugcuacgcgugcagcuccgggaucagcugcaaggugcggauccacgucgacgagccggacgagcucacggugcacgugaaguccgaggaccccgacaucgucgccgccagcagcucccugauggcccgcaagcuggaguucggcaccgacagcaccuucaaggccuucuccgcgaugcccaagaccagccucugcuucuacaucguggagcgggaguacugcaaguccugcagcaaggaggacacgcagaagugcgugaacaccaagcuggagcagccccaguccauccugaucgagcacaaggggaccaucaucggcaagcagaacgacacgugcaccgccaaggccagcugcuggcucgaguccgucaagagcuucuucuacggccugaagaacaugcuguccgggaucuucggcaacguguucaucgggaucuuccucuuccuggccccguucgcccugcucauccuguucuucauguucggcuggcgcauccuguucugcuucaagugcugccggcgcacccgggggcuguucaaguaccgccaccucaaggacgacgaggagaccggcuaccggaagaucaucgagcgccugaacaacaagaagggcaagaacaagcugcucgacggggagcgccuggcggaccggaagaucgccgagcuguucagcaccaagacccacgugggc

SEQ ID NO: 12403 - RNA, 1932 nt, Artificial Sequence
  derived and/or modified CDS sequence (opt1) from CCHFV(Baghdad 12)__AJ538197.2__Gc
uuccucgacagcaucgugaagggcaccaagaaccuccugaacuccaccagccuggagacgucccucagcaucgaggcccccuggggcgccaucaacgugcaguccaccuacaagccgaccgugagcaccgcgaacaucgcccuguccuggagcuccguggagcaccgcgggaacaagauccuggucagcgggcgguccgagagcaucaugaagcucgaggagcgcacgggcaucuccugggaccuggggguggaggacgccagcgaguccaagcugcucaccgugagcgucauggaccugucccagauguacagccccguguucgaguaccuguccggcgaccgccagguggaggaguggcccaaggcgaccugcaccggcgacugccccgagcggugcgggugcacgaccagcacgugccuccacaaggaguggccgcacagccggaacuggcgcugcaaccccaccuggugcuggggcgucgggacgggcugcacgugcugcgggcuggacgugaaggaccuguucaccgacuacauguucgugaaguggaaggucgaguacaucaagaccgacgccaucgugugcguggagcucaccucccaggagcggcagugcagccugaucgaggccggcacccgcuucaaccugggcuccgucaccaucacccucagcgagccccggaacauccagcagaagcugcccccggagaucaucacgcugcacccccgcaucgaggagggguucuucgaccucaugcacgugcagaaggugcuguccgccagcaccgucugcaagcugcaguccugcacccacggcgugcccggggaccuccagguguaccacaucggcaaccugcugaagggcgacaaggucaacgggcaccucauccacaagaucgagccccacuucaacaccagcuggauguccugggacggcugcgaccuggacuacuacugcaacaugggggacuggccgagcugcacguacaccggcgugacccagcacaaccacgccuccuucgugaaccugcucaacaucgagaccgacuacaccaagagcuuccacuuccacuccaagcgggucaccgcccacggggacacgccccagcuggaccugaaggugcgccccaccuacggcgcgggcgagaucaccguccucguggagguggccgacauggagcugcacaccaagaagaucgagaucagcgggcugaaguucgccucccugaccugcaccggcugcuacgccugcagcuccgggaucagcugcaagguccggauccacguggacgagcccgacgagcucacggugcacgucaaguccgacgacccggacgugguggccgcgagcagcucccugauggcccgcaagcucgaguucggcaccgacagcaccuucaaggccuucuccgccaugcccaagaccagccugugcuucuacaucgucgagcgggaguacugcaaguccugcagcaaggaggacacccagaagugcgugaacacgaagcuggagcagccccaguccauccucaucgagcacaaggggaccaucaucggcaagcagaacaacacgugcaccgccaagaccagcugcuggcuggaguccgucaagagcuucuucuacggccugaagaacaugcucuccgggaucuucggcaacuucuucauggggaucuuccuguuccuggcgcccuucauccuccugauccuguucuucauguucggcuggcgcauccuguucugcuucaagugcugccggcgcacccggggccucuucaaguaccgccaccugaaggacgacgaggagaccggguaccggcgcaucaucgagcgccugaacaacaagaagggcaagaacaagcuccuggacggggagcggcuggccgaccgccggaucgccgagcuguucagcaccaagacgcacaucggc

SEQ ID NO: 12404 - RNA, 1932 nt, Artificial Sequence
  derived and/or modified CDS sequence (opt1) from CCHFV(VLG/TI29414)__AY179961.1__Gc
uuccuggacagcaucgugaagggcaugaagaaccuccugaacuccaccaaccuggagaccagccucuccaucgaggcccccuggggggccaucaacguccagagcacguucaagccgaccguguccaccgcgaacaucgcccugagcugguccagcguggagcaccgcggcaacaagauccuggucaccgggcgguccgagagcaucaugaagcucgaggagcgcacgggcguguccugggaccuggggguggaggacgccagcgaguccaagcugcucaccgucagcaucauggaccugucccagauguacagccccguguucgaguaccuguccggcgaccggcagguggaggaguggcccaaggccaccugcaccggcgacugccccgagcgcugcgggugcacgagcuccaccugccuccacaaggaguggccgcacagccggaacuggcgcugcaaccccaccuggugcugggaggucggcaccgggugcacgugcugcggcuggaacgugaaggaccuguucaccgaccacauguucgugaaguggaaggucgaguacaucaagaccgaggccaucgugugcguggagcugaccagccaggagcggcagugcucccucaucgaggcggggacgcgcuucaaccugggccccgucaccaucacccugagcgagccccggaacauccagcagaagcucccgcccgagaucaucacccugcaccccaagguggaggagggcuucuucgaccugaugcacgugcagaagguccucuccgccagcacggugugcaagcugcaguccugcacccacgggauccccggcgaccugcagguguaccacaucgggaaccuccugaagggcgaccgcgucaacggccaccugauccacaagaucgagccgcacuucaacaccagcuggauguccugggacgggugcgaccucgacuacuacugcaacaugggcgacuggcccagcugcaccuacacggggaugacccagcacaaccacgccgccuucgugaaccugcugaacaucgagaccgacuacaccaagacguuccacuuccacuccaagcgggugaccgcgcacggcgacaccccccagcucgaccugaaggcccgccccaccuacggggccggcgagaucacgguccugguggaggucgccgacauggagcuccacaccaagaagguggagaucagcggccugaaguucgccucccuggcgugcaccgggugcuacgccugcagcuccggcaucagcugcaaggugcggauccacgucgacgagccggacgagcucaccgugcacgugaaguccaacgaccccgacgucaucgccgccagcacgucccugauggcccgcaagcuggaguucgggaccgacagcaccuucaaggcguucuccgccaugcccaagaccagccucugcuucuacaucgccgagcgggaguacugcaagagcugcuccgaggaggacacccagaagugcguggacacgaagcuggagcagccccagagcauccugaucgagcacaagggcaccaucaucgggaagcagaacgacaccugcaccgccaaggccuccugcuggcucgagagcgugaaguccuucuucuacggccugaagaacaugcugggcagcgucuucgggaacuucuucaucggcauccuccuguuccuggcgccguucgugcuccuggugcuguucuucauguucggguggaagauccuguucugcuucaagugcugccgccggacgcgcggccuccugaaguaccggcugcucaaggacgacgaggagaccggguaccgccggaucaucgagcgccugaacaacaagaagggcaagaaccgccugcucgacggcgagcggcuggccgaccgcaagaucgccgagcuguucuccaccaagacccacaucggg

SEQ ID NO: 12405 - RNA, 1932 nt, Artificial Sequence
  derived and/or modified CDS sequence (opt1) from CCHFV(TADJ/HU8966)__AY179962.1__Gc
uuccuggacagcaucgugaagggcaugaagaacccccucaacuccaccagccuggagaccucccugagcaucgaggccccguggggcgccaucaacguccaguccacguacaagcccaccgugagcaccgcgaacaucgcccucuccuggagcuccaucgagcaccgcgggaacaacauccuggugagcgggcgguccgagagcaucaugaagcuggaggagcgcaccggcaucuccggggaccucggcgucgaggacgccagcgaguccaagcugcugacggugagcgugauggaccucucccagauguacagccccgucuucgaguaccuguccggcgaccgccagguggaggaguggcccaaggcgaccugcaccggggacugcccggagcggugcggcugcaccagcagcacgugccugcacaaggaguggccccacucccggaacuggcgcugcaaccccaccuggugcuggggcguggggaccgggugcacgugcugcggccucgacgucaaggaccuguucaucgacuacauguucgugaaguggaagguggacuacaucaagaccgaggccaucgucugcguggagcugaccagccaggagcggcagugcucccucguggaggccggcacccgcuucaaccuggggcccgucaccaucacgcugagcgagccgcggaacauccagcagaagcucccgcccgagaucaucacccugcacccccgcaucgaggagggcuucuucgaccugaugcacgugcagaaggugcucuccgccagcaccgucugcaagcugcaguccugcacccacggggugcccggcgaccuccagguguaccacaucggcaaccuccugaagggggacaaggagaacggccaccugauccacaagaucgagccccacuucaacacgagcuggauguccugggacgggugcgaccucgacuacuacugcaacaugggcgacuggcccagcugcaccuacaccggggucacccagcacaaccacgccuccuucgugaaccugcugaacaucgagacggacuacaccaagagcuuccacuuccacuccaagcgggugaccgcccacggcgacacgccccagcucgaccugaaggcgcgcccgaccuacggcgccggggagaucaccguccugguggaggucgccgacauggagcuccacaccaagaagaucgagaucaccggccugaaguucgccagccugacgugcaccgggugcuacgccugcuccagcggcaucuccugcaaggugcggauccacguggacgagcccgacgagcucaccguccacgucaagagcgacgaccccgacgugguggcggccuccagcagccugauggcccgcaagcuggaguucgggaccgacuccacguucaaggccuucagcgccaugcccaagaccucccucugcuucuacaucguggagcgggaguaccgcaagagcugcuccaaggaggacacccagaagugcgugaacaccaagcuggagcagccgcagagcauccugaucgagcacaagggcaccaucaucggcaagcagaacaacacgugcaccgcgaaggccuccugcuggcucgagagcgucaaguccuucuucuacgggcugaagaacaugcugagcggcaucuucgggaacguguucgugggcaucuuccucuuccuggcccccuucauccugcucauccuguucuucauguucggguggcggauccuguccugcuucaagugcugccgccggacccgcggccugcucaagcaccggcaccugaaggacgacgaggagaccggcuaccgccgcaucaucgagcggcugaacaacaagaaggggaagaacaagcuccuggacggcgagcgccuggccgaccggcgcaucgccgagcuguucagcacgaagacccacaucggg

SEQ ID NO: 12406 - RNA, 1932 nt, Artificial Sequence
  derived and/or modified CDS sequence (opt1) from CCHFV(Hodzha)__AY223476.1__Gc
uuccuggacagcaucgugaagggcaccaagaaccuccugaacuccaccagccuggagacgucccucagcaucgaggcccccuggggggccaucaacguccaguccaccuacaagccgaccgugagcaccgcgaacaucgcccuguccuggagcuccguggagcaccgcggcaacaagauccuggucagcgggcgguccgagagcaucaugaagcucgaggagcgcacgggcaucuccugggaccuggggguggaggacgccagcgaguccaagcugcucaccgugagcgucauggaccugucccagauguacagccccguguucgaguaccuguccggcgaccggcagguggaggaguggcccaaggccaccugcaccggcgacugccccgagcgcugcgggugcacgagcagcaccugccuccacaaggaguggccgcacucccggaacuggcgcugcaaccccaccuggugcuggggcgucgggaccggcugcacgugcugcgggcuggacgugaaggaccuguucaccgacuacauguucgugaaguggaaggucgacuacaucaagaccgaggccaucgugugcguggagcucaccagccaggagcggcagugcucccuggucgaggcgggcacgcgcuucaaccugggccccgugaccaucacccucagcgagccccggaacauccagcagaagcugccgcccgagaucaucacccugcacccccgcaucgaggagggguucuucgaccucaugcacgugcagaagguccuguccgccagcacggugugcaagcugcaguccugcacccacggcgugcccggggaccuccaggucuaccacaucggcaaccugcugaagggcgacaaggugaacgggcaccucauccacaagaucgagccgcacuucaacaccagcuggauguccugggacggcugcgaccuggacuacuacugcaacaugggggacuggcccagcugcaccuacacgggcgugacccagcacaaccacgccuccuucgucaaccugcucaacaucgagaccgacuacaccaagagcuuccacuuccacuccaagcgggugacggcccacggggacaccccccagcuggaccugaaggcgcgccccaccuacggcgccggcgagaucaccguccucguggagguggccgacauggagcugcacacgaagaagaucgagaucaccgggcugaaguucgccagccucaccugcaccggcugcuacgccugcuccagcgggaucuccugcaagguccggauccacguggacgagccggacgagcugacggugcacgucaagagcgacgaccccgacgugguggcggccuccagcagccugauggcccgcaagcucgaguucggcaccgacuccaccuucaaggccuucagcgccaugcccaagaccucccugugcuucuacaucgucgagcgggaguacugcaagagcugcuccaaggaggacacccagaagugcgugaacacgaagcuggagcagccccagagcauccucaucgagcgcaaggggaccaucaucggcaagcagaacaacaccugcaccgcgaaggccuccugcuggcuggagagcgugaaguccuucuucuacggccugaagaacaugcucagcgggaucuucggcaacgucuucguggggaucuuccuguuccuggccccguucauccuccugauccuguucuucauguucggcuggcggauccuguucugcuucaagugcugccgccggacgcgcgggcucuucaaguacaagcaccugaaggacgacgaggagaccggcuaccggcgcaucaucgagcgccugaacaacaagaagggcaagaacaagcuccuggacggggagcggcuggccgaccgccggaucgccgagcucuucuccaccaagacccacaucggc

SEQ ID NO: 12407 - RNA, 1932 nt, Artificial Sequence
  derived and/or modified CDS sequence (opt1) from CCHFV(Kosovo/9553/2001)__AY675511.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcugaccucccaggagcggcagugcagccucaucgaggcgggcacgcgcuucaaccugggccccgugaccaucacccuguccgagccccggaacauccagcagaagcucccgcccgagaucaucacccugcaccccaagaucgaggagggguucuucgaccugaugcacgugcagaagguccucagcgccuccacggugugcaagcugcagagcugcacccacggcauccccggggaccugcagguguaccacaucggcaaccuccugaagggcgaccgcgucaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgugaaccugcugaacaucgagaccgacuacaccaagacguuccacuuccacagcaagcgggucaccgcgcacggggacaccccccagcucgaccugaaggcccgccccaccuacggcgccggcgagaucacggugcuggucgagguggccgacauggagcuccacaccaagaagguggagaucuccgggcugaaguucgccagccuggcgugcaccggcugcuacgccugcuccagcgggaucuccugcaagguccggauccacguggacgagccggacgagcucaccgugcacgucaagagcuccgaccccgacgugguggccgccagcacgucccugauggcccgcaagcuggaguucggcaccgacagcaccuucaaggcguucagcgccaugcccaagaccucccucugcuucuacaucgucgagaaggaguacugcaagagcugcuccgaggacgacaccaagaagugcguggacacgaagcuggagcagccccagagcauccugaucgagcaccgggggaccaucaucggcaagccgaacgacaccugccccgccaagaccuccugcuggcucgagagcgugaaguccuucuucuacggccugaagaacaugcuggggagcgucuucggcaacuucuucaucgggauccuccuguuccuggcccccuucuuccucuggaugcuguccuucauguucggcuggaagauccuguucugcuucaagugcugccgccggacgcgcgggcuguucaaguaccggcaccucaaggacgacgaggagaccggcuaccgccggaucaucgagcgccugaacaacaagaagggcaagaaccgccugcucgacggggagcggcuggccgaccgcaagaucgcggagcuguucagcaccaagacccacaucggc

SEQ ID NO: 12408 - RNA, 1932 nt, Artificial Sequence
  derived and/or modified CDS sequence (opt1) from CCHFV(SPU41/84)__AY900142.1__Gc
uuccuggacagcaucgugaagggcaugaagaaccuccugaacuccaccagccuggagaccucccucagcaucgaggcccccuggggcgccaucaacguccaguccacguacaagccgaccgugagcaccgcgaacaucgcccuguccuggagcuccguggagcaccgcgggaacaagauccuggucagcgggcgguccgagagcaucaugaagcucgaggagcgcaccggcaucuccugggaccuggggguggaggacgccagcgaguccaagcugcucacggugagcgucauggaccugucccagauguacagccccguguucgaguaccuguccggcgaccgccagguggaggaguggcccaaggcgaccugcaccggcgacugccccgagcggugcgggugcaccagcagcacgugccuccacaaggaguggccgcacucccggaacuggcgcugcaaccccaccuggugcuggggcgucgggaccggcugcacgugcugcgggcuggacgugaaggaccuguucaccgacuacauguucgugaaguggaaggucgaguacaucaagaccgaggccaucgugugcguggagcucaccagccaggagcggcagugcucccugaucgaggccggcacccgcuucaaccugggccccgucacgaucacccucagcgagccccggaacauccagcagaagcugccgcccgagaucaucacccugcacccccgcaucgaggagggguucuucgaccucaugcacgugcagaaggugcuguccgccagcaccgucugcaagcugcaguccugcacgcacggcgugcccggggaccuccagguguaccacaucggcaaccugcugaagggcgacaaggucaacgggcaccucgugcacaagaucgagccgcacuucaacaccagcuggauguccugggacggcugcgaccuggacuacuacugcaacaugggggacuggcccagcugcaccuacaccggcgugacgcagcacaaccacgccuccuucgucaacaugcugaacaucgagaccgacuacaccaagaacuuccacuuccacagcaagcgggugaccgcccacggggacacgccccagcucgaccugaaggcgcgccccaccuacggcgccggcgagaucaccguccugguggagguggccgacauggagcuccacaccaagaagaucgagaucuccgggcugaaguucacgagccugaccugcaccggcugcuacgccugcuccagcgggaucuccugcaagguccggauccacguggacgagccggacgagcucaccgugcacgucaagagcgaggaccccgacgugguggccgcguccagcagccugauggcccgcaagcuggaguucggcacggacuccaccuucaaggccuucagcgccaugcccaagaccucccucugcuucuacaucgucgagcgggaguacugcaagagcugcuccgaggaggacacccagaagugcgugaacaccaagcuggagcagccccagagcauccugaucgagcgcaaggggacgaucaucggcaagcagaacaacacgugcaaggccaaggcgggcugcuggcucgaguccgucaagagcuucuucuacgggcugaagaacaugcuguccggcaucuucgggaacguguucaucggcaucuuccucuuccuggccccguucauccugcucauccuguucuucauguucggguggcggauccuguucugcuucaagugcugccgccggacccgcggccuguucaaguaccggcaccucaaggacgacgaggagaccggcuaccgcaagaucaucgagcgccugaacaacaagaaggggaagaacaagcugcucgacggcgagcggcuggccgaccgccggaucgccgagcuguucagcaccaagacccacaucggg

SEQ ID NO: 12409 - RNA, 1932 nt, Artificial Sequence
  derived and/or modified CDS sequence (opt1) from CCHFV(UG3010)__AY900143.1__Gc
uaccuggacagcaucgccaagggcaugaagucccuccugaacagcaccaaccuggagaccucccucagcaucgaggcccccuggggcgcgaucaacgugcaguccacguucaagccgaccgucagcgccgccaacaucgcccuguccuggagcuccguggagcaccgcgggaacaagauccuggugagcgggcgguccgagagcaucaugaagcucgaggagcgcaccggcaucuccuggagccugggggucgaggacgccuccgagagcaagacccugacgguguccgugauggaccucagccagauguacucccccgucuucgaguaccugagcggcgaccgccagguggaggaguggcccaaggcgaccugcaccggcgacugccaggagcggugcgggugcaccagcuccacgugccugcacaaggaguggccccacagccggaacuggcgcugcaacccgaccuggugcuggggcguggggaccggcugcacgugcugcgggcucgacguccgggaccuguucaccgacuacaugauggugaaguggaagguggaguacgucaagaccgaggccaucaugugcguggagcugaccucccaggagcgccagugcagccucaucgaggccggcacccgguucaaccugggccccgugacgaucacccuguccgagccccgcaacauccagcagcggcuccccagcgagaucgucacccugcacccgaagaucgaggagggguucuucgaccugaugcacgugcagaaggugcucuccgccagcaccgucugcaagcugcaguccugcacgcacggcgugcccggggaccuccagguguaccacgucggcaaccuccugaagggcgacaaggugaacgggcacagcauccacaagaucgagucccacuucaacaccagcuggauguccugggacggcugcgaccuggacuacuucugcaacaugggggacuggcccagcugcaccuacaccggcgugacgcagcacaaccgcgcggccuucaucaacaugcucaacaucgagaccgacuacaccaagaccuuccacuuccacuccaagcgggucacggcccacggggacacgccccagcuggaccugaaggcccgcccgaccuacggcgccggcgaggugaccguccucguggagguggcggaccuggagcugcacaccaagaagaucgaggucagcgggcucaaguucgccucccugaccugcagcggcugcuacgccugcuccagcgggaucagcugcaaggugcggauccacgugaacgagcccgacgaguucaccguccacgugaaguccagcgaccccgacguggucgccgccggcuccagccugauggcgcgcaagaucgaguucggggccgacuccaccuucaaggccuucagcuccaugcccaagaacagccucugcuucuacaucguggagcgggacuacugcuccagcugcacgaacgacgacacccagaagugcguggacaccaagcuggagcacccgcaguccauccugaucgagcacaagggcaccaucaucggcaagcagaacgacacgugcagcaccaagaccuccugcuggcucgagagcgucaaguccuucuucuacgggcugaagaacaugcugggcgggaucuucggcaacguguuccucgggaucuuccuguuccuggcccccuucgcccuccugaucuucuucuucuucuucggcuggcgccugcuguucugccugaagugcugccggcgcacccggggccugcugaaguacaagcagcucaaggacgaggaggaggcgggguacaagaagaucaucgagcgccugaacgacaagaagggcaagagccgccuguucgacggggagcggcucgccgaccgcaagaucgccgagcuguucuccaccaagacgcacaucggc

SEQ ID NO: 12410 - RNA, 1932 nt, Artificial Sequence
  derived and/or modified CDS sequence (opt1) from CCHFV(Hy13)__AY900145.1__Gc
uucagcgacuccaucgugaagggcaugaagaaccugcucaacagcaccucccuggagaccagccuguccaucgaggcccccuggggcgccaucaacguccagagcacguucaagccgaccguguccgcggccaacaucgcccucagcugguccagcguggagcaccgcgggaacaagauccuggucuccgggcggagcgaguccaucaugaagcuggaggagcgcaccggcaucagcugggaccucgggguggaggacgccuccgagagcaagcugcugaccguguccaucauggaccucagccagauguacucccccgucuucgaguaccugagcggcgaccgccagguggaggaguggcccaaggccacgugcaccggcgacugccccgagcggugcgggugcaccagcuccacgugccugcacaaggaguggccgcacagccggaacuggcgcugcaaccccaccuggugcuggggcguggggaccggcugcacgugcugcgggcucgacgucaaggaccuguucaccgaccacauguucgugaaguggaagguggaguacaucaagaccgaggcgaucgucugcguggagcugaccucccaggagcggcagugcagccucaucgaggccggcacccgcuucaaccugggccccgugaccaucacgcuguccgagccccggaacauccagcagaagcucccgcccgagaucgucacccugcacccccgcaucgaggagggguucuucgaccugaugcacgugaagaaggugcucagcgccuccaccgucugcaagcugcagagcugcacccacggcgugcccggggaccuccagguguaccacaucggcaaccugcugaagggcgacaaggucaacgggcaccugauccacaagaucgagccgcacuucaacacguccuggaugagcugggacggcugcgaccucgacuacuacugcaacaugggggacuggcccuccugcagcuacaccggcgugacccagcacaaccacgccgcguucgugaacaugcugaacaucgagaccgacuacacgaagaucuuccacuuccacuccaagcgggucaccgcccacggggacacgccccagcuggaccucaaggcccgccccaccuacggcgccggcgagaucaccgugcuggucgagguggccgacauggagcugcacaccaagaagaucgagaucagcgggcucaaguucgcgucccugaccugcaccggcugcuacgccugcagcuccgggaucagcugcaaggugcggauccacgucgacgagccggacgagcugacggugcacgugaaguccgaggaccccgacaucgucgccgccagcagcucccucauggcccgcaagcuggaguucggcaccgacagcaccuucaaggcguucuccgccaugcccaagaccagccugugcuucuacaucguggagcgggaguacugcaaguccugcagcaaggaggacacgcagaagugcgugaacaccaagcucgagcagccccaguccauccugaucgagcacaaggggaccaucaucggcaagcagaacgacacgugcaccagcaaggccggcugcuggcuggaguccgucaagagcuucuucuacgggcucaagaacaugcuguccggcaucuucgggaacguguucaucggcaucuuccuguuccucgccccguucauccugcugauccucuucuucauguucggguggcgcauccuguucugcuucaagugcugccggcgcacccggggccuguucaaguaccgccaccugaaggacgacgaggagaccggcuaccggaagaucaucgagcgccucaacaacaagaaggggaagaacaagcugcuggacggcgagcgccucgccgaccggaagaucgcggagcuguucagcaccaagacccacaucggg

SEQ ID NO: 12411 - RNA, 1932 nt, Artificial Sequence
  derived and/or modified CDS sequence (opt1) from CCHFV(Semunya)__DQ094832.1__Gc
uuccuggacagcaucgccaagggcaagaagucccuccugaacagcaccaaccuggagaccucccucagcaucgaggcccccuggggcgcgaucaacgugcaguccacguucaagccgaccgugagcgccgccaacaucgcccuguccuggagcuccguggagcaccgcgggaacaagauccuggugagcgggcgguccgagagcaucaugaagcucgaggagcgcaccggcaucuccuggagccugggggucgaggacgccuccgagagcaagacccugacgguguccgugauggaccucagccagauguacucccccgucuucgaguaccugagcggcgaccgccagguggaggaguggcccaaggcgaccugcaccggcgacugccccgagcggugcgggugcaccagcuccacgugccugcacaaggaguggccgcacagccggaacuggcgcugcaaccccaccuggugcuggggcguggggaccggcugcacgugcugcgggcucgacguccgggaccuguucaccgacuacaugauggugaaguggaagguggaguacgucaagaccgaggccaucaugugcguggagcugaccucccaggagcgccagugcagccucaucgaggccggcacccgguucaaccugggccccgugacgaucacccuguccgagccccgcaacguccagcagcggcucccgagcgagaucgugacccugcaccccaagaucgaggagggguucuucgaccugaugcacgugcagaagguccucuucugcaaguacucccugcaggccaccagcugcacgcacggcgugcccggggaccuccagguguaccacgucggcaaccugcugaagggcgacaaggugaacgggcacuccauccacaagaucgagagccacuucaacaccuccuggaugagcugggacggcugcgaccuggacuacuucugcaacaugggggacuggcccuccugcaccuacaccggcgugacgcagcacaaccgcgcggccuucgucaacaugcucaacaucgagaccgacuacaccaagaccuuccacuuccacagcaagcgggugacggcccacggggacaccccgcagcuggaccugaaggcccgccccaccuacggcgccggcgaggucaccgugcucguggaggucgcggaccuggagcugcacacgaagaagaucgagguguccgggcucaaguucgccagccugaccugcuccggcugcuacgccugcagcuccgggaucagcugcaaggugcggauccacgucaacgagcccgacgaguucaccgugcacgucaagagcaacgaccccgacgugguggccgccggcuccagccugauggcgcgcaagaucgaguucggggccgacuccaccuucaaggccuucagcuccaugccgaagaacagccucugcuucuacaucguggagcgggacuacugcuccagcugcacggacgacgacacccagaagugcgucaacaucaagcuggagcacccccaguccauccugaucgagcacaagggcaccaucaucggcaagcagaacgacacgugccccaccaagaccagcugcuggcucgaguccgucaagagcuucuucuacgggcugaagaacaugcugggcgggaucuucggcaacguguuccucgggaucuuccuguuccuggcccccuucgcccuccugauccuguucuucuucuucggcuggcgccuccuguucugccugaagugcugccggcgcacccggggccugcucaaguacaagcagcugaaggacgaggaggaggcgggguacaagaagaucaucgagcgccugaacgacaagaagggcaagucccgccucuucgacggggagcggcuggccgaccgcaagaucgccaagcuguucagcaccaagacccacaucggc

SEQ ID NO: 12412 - RNA, 1932 nt, Artificial Sequence
  derived and/or modified CDS sequence (opt1) from CCHFV(SPU128/81/7)__DQ157174.1__Gc
uuccuggacagcaucgugaagggcaugaagaaccuccugaacuccaccagccuggagaccucccucagcaucgaggcccccuggggcgccaucaacgugcaguccacguacaagccgaccgugagcaccgcgaacaucgcccuguccuggagcuccguggagcaccgcgggaacaagauccuggucagcgggcgguccgagagcaucaugaagcucgaggagcgcaccggcaucuccugggaccuggggguggaggacgccagcgaguccaagcugcucacggugagcgucauggaccugucccagauguacagccccguguucgaguaccuguccggcgaccgccagguggaggaguggcccaaggcgaccugcaccggcgacugccccgagcggugcgggugcaccagcagcacgugccuccacaaggaguggccgcacucccggaacuggcgcugcaaccccaccuggugcuggggcgucgggaccggcugcacgugcugcgggcuggacgugaaggaccuguucaccgacuacauguucgugaaguggaaggucgaguacaucaagaccgaggccaucgugugcguggagcucaccagccaggagcggcagugcucccugaucgaggccggcacccgcuucaaccugggccccgucacgaucacccucagcgagccccggaacauccagcagaagcugccgcccgagaucaucacccugcacccccgcaucgaggagggguucuucgaccucaugcacgugcagaaggugcuguccgccagcaccgucugcaagcugcaguccugcacgcacggcgugcccggggaccuccagguguaccacaucggcaaccugcugaagggcgacaaggucaacgggcaccucauccacaagaucgagccgcacuucaacaccagcuggauguccugggacggcugcgaccuggacuacuacugcaacaugggggacuggcccagcugcaccuacaccggcgugacgcagcacaaccacgccuccuucgugaaccugcucaacaucgagaccgacuacaccaagaacuuccacuuccacagcaagcgggucaccgcccacggggacacgccccagcuggaccugaaggcgcgccccaccuacggcgccggcgagaucaccgugcucgucgagguggccgacauggagcugcacaccaagaagaucgagaucuccgggcugaaguucgccagccucacgugcaccggcugcuacgccugcuccagcgggaucuccugcaaggugcggauccacgucgacgagccggacgagcugaccgugcacgucaagagcgacgaccccgacgugguggcggccuccagcagccugauggcccgcaagcucgaguucggcaccgacuccacguucaaggccuucagcgccaugcccaagaccucccugugcuucuacaucguggagcgggagcacugcaagagcugcuccgaggaggacaccaagaagugcgucaacaccaagcuggagcagccccagagcauccucaucgagcacaaggggaccaucaucggcaagcagaacuccacgugcaccgcgaaggccagcugcuggcuggaguccgucaagagcuucuucuacggccugaagaacaugcucuccgggaucuucggcaacguguucaucgggaucuuccuguuccugggcccguucauccuccugauccuguucuucauguucggguggcgcauccuguucugcuucaagugcugccggcgcacccggggccuccugaaguaccgccaccugaaggaggacgaggagaccggcuaccggcgcaucaucgagcgccucaacaacaagaaggggaagaacaagcugcuggacggcgagcggcucgccgaccgccggaucgccgagcuguucagcacgaagacccacaucggg

SEQ ID NO: 12413 - RNA, 1932 nt, Artificial Sequence
  derived and/or modified CDS sequence (opt1) from CCHFV(ROS/HUVLV-100)__DQ206448.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcugaccucccaggagcggcagugcagccucaucgaggcgggcacgcgcuucaaccugggccccgugaccaucacccuguccgagccccggaacauccagcagaagcucccgcccgagaucaucacccugcaccccaagguggaggagggguucuucgaccugaugcacguccagaaggugcucagcgccuccacggugugcaagcugcagagcugcacccacggcauccccggggaccugcaggucuaccacaucggcaaccuccugaagggcgaccgcgugaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgucaaccugcugaacaucgagaccgacuacaccaagacguuccacuuccacagcaagcgggugaccgcgcacggggacaccccccagcucgaccugaaggcccgccccaccuacggcgccggcgagaucacgguccugguggagguggccgacauggagcuccacaccaagaaggucgagaucuccgggcugaaguucgccagccuggcgugcaccggcugcuacgccugcuccagcgggaucuccugcaaggugcggauccacguggacgagccggacgagcucaccguccacgugaagagcuccgaccccgacguggucgccgccagcacgucccugauggcccgcaagcuggaguucggcaccgacagcaccuucaaggcguucagcgccaugcccaagaccucccucugcuucuacaucguggagcgggaguacugcaagagcugcuccgaggaggacacccagaagugcguggacacgaagcuggagcagccccagagcauccugaucgagcacaaggggaccaucaucggcaagcagaacgacaccugcaccgccaaggccuccugcuggcucgagagcgucaaguccuucuucuacggccugaagaacaugcuggggagcguguucggcaacuucuucaucgggauccuccuguuccuggccccguucgugcuccugguccuguucuucauguucggcuggaagauccuguucugcuucaagugcugccgccggacgcgcgggcuccugaaguaccggcugcucaaggacgacgaggagaccggcuaccgccggaucaucgagcgccugaacaacaagaagggcaagaaccgccugcucgacggggagcggcuggcggaccgcaagaucgccgagcuguucuccaccaagacccacaucggc

SEQ ID NO: 12414 - RNA, 1932 nt, Artificial Sequence
  derived and/or modified CDS sequence (opt1) from CCHFV(AP92)__DQ211625.1__Gc
uuccuggacagcaucgccaagggcgugaagaaccuccugaacuccaccagccuggagaccucccucagcaucgaggcccccuggggggcgaucaacgcccaguccacguacaagccgaccgccagcuccgccaacaucgcccugaccuggagcuccgucgagcaccgcggcaacaagauccuggugagcgggcgguccgagagcaucaugaagcucgaggagcgcaccggcaucuccuggaaccuggggguggaggacgcgagcgagucccggacgcugaccaucagcgucauggaccucucccagauguacagccccguguucgaguaccuguccggcgaccgccagguggaggaguggcccaaggccaccugcaccggcaacugccccgagcggugcgggugcacgagcagcaccugccuguacaaggaguggccgcacucccgcaacuggcggugcaaccccaccuggugcuggggcgucgggaccggcugcacgugcugcgggcucgacgugaaggagcuguucaccgaccacaugcuggugaaguggaaggucgaguacaucaagaccgaggccaucgugugcguggagcucaccagccaggagcgccagugcucccugaucgaggccggcacgcgguucagccugggccccgucaccaucacccucuccgagccccgcaacauccagcagaagcugccgcccgagcugaucacccuccaccccaagaucgaggacggguacuucgaccugaugcacgugcagaaggugaugagcgcguccacggucugcaagcugcagagcugcacccacggcgugcccggggaccuccagaucuaccacgugggcaaccugcugaagggcgaccgggucaacgggcaccucauccacaagguggagccgcaccugaacaccuccuggaugagcugggacggcugcgaccuggacuacuucugcaacaugggggacuggcccuccugcaccuacacgggcgugacccagcacaaccacgccgccuucgccaaccuccugaacaucgagaccgacuacaccaagacguuccacuuccacagcaagcgcgucaccgcccacggggacaccccccagcuggaccucaaggcgcggccccgcuacggcgccggcgagaucaccgugcugguggaggucgccgacauggagcugcacacgaagaagguggaggucaccgggcucaaguucgccucccugaccugcagcggcugcuacgccugcuccagcgggaucuccugcaaggugcggauccacguggacgagccggacgagcugaccguccacgugaagagcuccgaccccgacaucguggcggccagcagcucccucauggcccgcaagaucgaguucggcgucgacagcacguucaaggccuucuccagcaugcccaaggacucccugugcuucuacaucguggagcgggacuacugcaacagcugcaagaacgaggagacccagcgcugcgugaacgccaagcuggagcagccccaguccauccucaucgagcacaccgggaccaucaucggcaagcagaacgacaccugcggcagccggacguccugcuggcuggacagcuucaaguccuucuucuacgggcugaagagcaugcucuccggcaucuucgggaacgucuuccugggcaucuuccuguuccucgcgccguucgcccugcugcuguucuucuucuucuucggguggcgcauccucuucugcuucaagugcugccggcgcacccgcggccuguucaaguaccggcacaucaaggacgacgaggaggugggcuacaagaagaucaucgagcgccugaacaacaagaaggggaagcaccggcuccuggacggcgagcgccuggccgaccggaagaucgccgagcucuucagcaccaagacccacaucggg

SEQ ID NO: 12415 - RNA, 1932 nt, Artificial Sequence
  derived and/or modified CDS sequence (opt1) from CCHFV(ArD8194)__DQ211626.1__Gc
uuccuggaccgcaucgccaagggcaugaagucccuccugaacagcaccagccuggagaccucccucagcaucgaggcccccuggggcgcgaucaacgugcaguccacguucaagccgaccgucagcgccgccaacaucgcccuguccuggagcuccguggagcacaaggggaacaagauccuggugagcgggcgguccgagagcaucaugaagcucgaggagcgcaccggcaucuccuggugccugggggucgaggacgccagcgaguccaagacccugacggugagcgugauggaccucucccagauguacagccccgucuucgaguaccuguccggcgaccgccagguggaggaguggcccaaggcgaccugcaccggcgacugccccgagcggugcgggugcaccagcagcacgugccugcacaaggaguggccgcacucccggaacuggcgcugcaaccccaccuggugcuggggcguggggaccggcugcacgugcugcgggcucgacgucaaggaccuguucaccgacuacaugcuggugaaguggaagguggaguacaucaagaccgaggccaucaucugcgucgagcucaccagccaggagcggcagugcucccugaucgaggccggcacccgcuucaaccugggccccgugacgaucacccucagcgagccccggaacgugcagcagcgccugccgcccgagaucaucacccugcaccccaagaucgaggagggguucuucgaccucaugcacguccagaaggugauguccgccagcaccgugugcaagcugcaguccugcacgcacggcguccccggggaccuccagguguaccacgugggcaaccuccugaagggcgacaaggucaacgggcacagcauccacaagaucgagucccaccugaacaccagcuggauguccugggacggcugcgaccucgacuacuucugcaacaugggggacuggccgagcugcaccuacaccggcgugacgcagcacaaccacgcggccuucaucaacaugcugaacaucgagaccgacuacaccaagaccuuccacuuccacuccaagcgggugacggcccacggggacacgccccagcuggaccucaaggcccgccccgccuacggcgcgggcgagaucaccguccugguggaggucgccgaccuggagcuccacaccaagaagaucgaggugagcgggcugaaguucgccucccugagcugcuccggcugcuacgccugcagcuccgggaucagcugcaaggugcggauccacgucaacgagcccgacgaguucaccgugcacgucaagagcaacgacccggacgugguggccgcgggcuccagccucauggcccgcaagaucgaguccggggccgacagcaccuucaaggccuucuccagcaugcccaagaacucccugugcuucuacaucguggagcgggacuacugcagcuccugcaccgacgacgacacccagaagugcgucgacaucaagcuggagcacccccagagcauccucaucgagcacaagggcacgaucaucggcaagcagaacgacacgugccccaccaagaccuccugcuggcuggagagcaucaaguccuucuucuacgggcugaagaacaugcucagcggcaucuucgggaacguguuccugggcaugcugcuguuccuggccccguucauccugcucauccuguucuucuucuucggguggcgccugcuguucugccucaagugcugccggcgcacccggaagcugcugaaguacaagcaccuccgcgacgaggaggaguccggcuacaagaagaucaucgagcggcugaacgacaagaagggcaagagccgccuguucgacggggagcgccucgcggaccggaagaucgccgagcuguucuccaccaagacccacaucggc

SEQ ID NO: 12416 - RNA, 1932 nt, Artificial Sequence
  derived and/or modified CDS sequence (opt1) from CCHFV(ArD15786)__DQ211627.1__Gc
agccuggacuccaucgccaagggcaugaagucccuccugaacagcaccagccuggagaccucccucagcaucgaggcccccuggggcgcgaucaacgugcaguccacguucaagccgaccaucagcgccgccaacaucgcccuguccuggagcuccgucgagcacaaggggaacaagauccuggugagcgggcgcuccgagagcaucaugaagcucgaggagcggaccggcaucuccuggugccuggggguggaggacgccagcgaguccaagacccugacggucagcgugauggaccucucccagauguacagccccguguucgaguaccugagcggcgaccgccaggucgaggaguggcccaaggcgaccugcaccggcgacugccccgagcggugcgggugcaccuccagcacgugccugcacaaggaguggccgcacucccgcaacuggcggugcaaccccaccuggugcuggggcguggggaccggcugcacgugcugcgggcucgacgugaaggaccuguucaccgacuacaugcuggucaaguggaagguggaguacaucaagaccgaggccaucaucugcguggagcucaccagccaggagcgccagugcucccugaucgaggccggcacccgguucaaccugggccccgucacgaucacccucagcgagccccgcaacgugcagcagcggcugccgcccgagaucaucacccugcaccccaagaucgaggagggguucuucgaccucaugcacgugcagaaggucauguccgccagcaccgugugcaagcugcaguccugcacgcacggcgugcccggggaccugcaggucuaccacgugggcaaccuccugaagggcgacaaggugaacgggcacagcauccacaagaucgagucccaccugaacaccagcuggauguccugggacggcugcgaccucgacuacuucugcaacaugggggacuggccgagcugcaccuacaccggcgucacgcagcacaaccgcgcggccuucaucaacaugcugaacaucgagaccgacuacaccaagaccuuccacuuccacuccaagcgggugacggcccacggggacacgccccagcuggaccucaaggcccgccccaccuacggcgccggcgagaucaccgugcuggucgagguggcggaccuggagcuccacaccaagaagaucgaggucagcgggcugaaguucgccucccugaccugcagcggcugcuacgccugcuccagcgggaucagcugcaaggugcggauccacgugaacgagcccgacgaguucaccguccacgugaaguccaacgacccggacguggucgccgccggcagcucccucauggcgcgcaagaucgagagcggggccgacuccaccuucaaggccuucagcuccaugcccaagaacagccugugcuucuacaucguggagcgggacuacugcuccagcugcacggacgacgacacccagaagugcguggacaucaagcuggagcacccccaguccauccucaucgagcacaagggcaccaucaucggcaagcagaacgacacgugccccaccaagaccagcugcuggcuggaguccaucaagagcuucuucuacgggcugaagaacaugcucuccggcaucuucgggaacaucuuccugggcaugcuccuguuccuggccccguucguccugcucauccuguucuucuucuucggguggcgccugcuguucugccucaagugcugccggcgcacccggaagcugcugaaguacaagcaccuccgcgacgaggaggagagcggcuacaagaagaucaucgagcggcugaacgacaagaagggcaagucccgccuguucgacggggagcgccucgccgaccggaagaucgcggagcuguucagcaccaagacccacgugggc

SEQ ID NO: 12417 - RNA, 1932 nt, Artificial Sequence
  derived and/or modified CDS sequence (opt1) from CCHFV(ArD39554)__DQ211628.1__Gc
uuccuggacagcaccgccaaguccaugaagucccuccugaacagcaccagccuggagacgucccucagcaucgaggcccccuggggcgcgaucaacgugcaguccaccuucaagccgaccgccagcaccgccaacaucgcccuguccuggagcuccgucgagcaccgcgggaacaagauccuggugacgggccggagcgaguccaucaugaagcucgaggagcgcaccgggaucagcuggaaccugggcguggaggacgccuccgagagcaagacccugaccgucuccgugauggaccucagccagauguacuccacgguguucgaguaccugagcggggaccggcaggucgaggaguggcccaaggcgaccugcaccggcgacugccccgagcgcugcggcugcaccagcuccacgugccugcacaaggccuggccccacagccggaacuggcgcugcaacccgaccuggugcuggggcguggggaccgggugcacgugcugcggccucgacgugaagaaccuguucaccgacuacaugcugaucaaguggaaggucgaguucaucaagaccgaggccaucgugugcguggagcucaccucccaggagcggcagugcagccugaucgaggccgggacccgcuucaaccugggccccgucacgaucacccucuccgagccccggaacauccagcagaagcugcccccggagcuggugacccuccacccccgcguggaggagggcuucuucgaccugaugcacguccagaaggugcugagcgcguccaccgugugcaagcuccagagcugcacgcacgggguccccggcgaccuccagguguaccacguggggaaccugcucaagggcgacaagaucaacggcaacuccuuccacaagaucgagcccaaccugaacaccagcuggauguccugggacgggugcgaccuggacuacuacugcaacaugggcgacuggccgagcugcaccuacaccggggucacgcagcacaaccacgccgccuucgugaaccuccugaacaucgagaccgacuacaccaagaacuuccacuuccacuccaagcgggugaccgcccacggcgagacgccccagcuggaccucaaggcccgccccaaguacggggcgggcgaggucaccgugcuggucgagguggccgacauggagcugcacaccaagaagaucgagaucagcggccucaaguucgccucccugaccugcacggggugcuacgccugcagcuccggcaucagcugcaaggugcggcugcacgucgacgagcccgacgagcucaccgugcacgugaaguccgacgacccggacgucguggccgcgagcagcucccugauggcccgcaagaucgaguucgggaccgacagcaccuucaaggccuucuccagcaugcccaaggacaagcugugcuucuacaucguggagcgggacuacugcuccagcugcuccaaggaggacacccagaagugcgucaacgccaagcucgagcagccccagagcauccugaucgagcacaagggcacgaucaucgggaagcagaacgacacgugcaccgugaaggccuccugcuggcuggagagcgugaaguccuucuucuacggccucaagaacaugcugggcgggaucuucggcaacgucauccuggggaucaucauguuccucgcgcccuucgcccugcugcuccuguucuuccuguucggcuggcgcauccuguucugccuccggugcugccgccggacccgcgggcuguucaaguacaagcacaucaaggacgacgaggagagcggcuacaagcggaucaucgagcgccugaacaacaagaagggcaagaacaagcuguucgacggggagcgccuggccgacaagaagaucgccgagcuguucuccaccaagacccacaucggc

SEQ ID NO: 12418 - RNA, 1932 nt, Artificial Sequence
  derived and/or modified CDS sequence (opt1) from CCHFV(C-68031)__DQ211629.1__Gc
uucagcgacuccaucgugaagggcaugaagaaccugcucaacagcaccucccuggagaccagccuguccaucgaggcccccuggggcgccaucaacguccagagcacguucaagccgaccguguccgcggccaacaucgcccucagcugguccagcguggagcaccgcgggaacaagauccuggucuccgggcggagcgaguccaucaugaagcuggaggagcgcaccggcaucagcugggaccucgggguggaggacgccuccgagagcaagcugcugaccguguccaucauggaccucagccagauguacucccccgucuucgaguaccugagcggcgaccgccagguggaggaguggcccaaggccacgugcaccggcgacugccccgagcggugcgggugcaccagcuccacgugccugcacaaggaguggccgcacagccggaacuggcgcugcaaccccaccuggugcuggggcguggggaccggcugcacgugcugcgggcucgacgucaaggaccuguucaccgacuacauguucgugaaguggaagguggaguacaucaagaccgaggcgaucgucugcguggagcugaccucccaggagcggcagugcagccucaucgaggccggcacccgcuucaaccugggccccgugaccaucacgcuguccgagccccggaacauccagcagaagcucccgcccgagaucgucacccugcacccccgcaucgaggagggguucuucgaccugaugcacgugaagaaggugcucagcgccuccaccgucugcaagcugcagagcugcacccacggcgugcccggggaccuccagguguaccacaucggcaaccugcugaagggcgacaaggucaacgggcaccugauccacaagaucgagccgcacuucaacacguccuggaugagcugggacggcugcgaccucgacuacuacugcaacaugggggacuggcccuccugcagcuacaccggcgugacccagcacaaccacgccgcguucgugaacaugcugaacaucgagaccgacuacacgaagaucuuccacuuccacuccaagcgggucaccgcccacggggacacgccccagcuggaccucaaggcccgccccaccuacggcgccggcgagaucaccgugcuggucgagguggccgacauggagcugcacaccaagaagaucgagaucagcgggcucaaguucgcgucccugaccugcaccggcugcuacgccugcagcuccgggaucagcugcaaggugcggauccacgucgacgagccggacgagcugacggugcacgugaaguccgaggaccccgacaucgucgccgccagcagcucccucauggcccgcaagcuggaguucggcaccgacagcaccuucaaggcguucuccgccaugcccaagaccagccugugcuucuacaucguggagcgggaguacugcaaguccugcagcaaggaggacacgcagaagugcgugaacaccaagcucgagcagccccaguccauccugaucgagcacaaggggaccaucaucggcaagcagaacgacacgugcaccagcaaggccggcugcuggcuggaguccgucaagagcuucuucuacgggcucaagaacaugcuguccggcaucuucgggaacguguucaucggcaucuuccuguuccucgccccguucauccugcugauccucuucuucauguucggguggcgcauccuguucugcuucaagugcugccggcgcacccggggccuguucaaguaccgccaccugaaggacgacgaggagaccggcuaccggaagaucaucgagcgccucaacaacaagaaggggaagaacaagcugcuggacggcgagcgccucgccgaccggaagaucgcggagcuguucagcaccaagacccacaucggg

SEQ ID NO: 12419 - RNA, 1932 nt, Artificial Sequence
  derived and/or modified CDS sequence (opt1) from CCHFV(Drosdov)__DQ211630.1__Gc
uuccucgacagcaccgugaagggcaugaagaaccuccugaacuccaccagccuggagacgucccucagcaucgaggcccccuggggcgccaucaacguccaguccaccuucaagccgaccgugagcaccgcgaacaucgcccuguccuggagcuccguggagcaccgcgggaacaagauccuggucacggggcggagcgaguccaucaugaagcucgaggagcgcaccggcgugagcugggaccuggggguggaggacgccuccgagagcaagcugcucaccgucuccaucauggaccugagccagauguacucccccguguucgaguaccugagcggcgaccgccagguggaggaguggcccaaggcgaccugcacgggcgacugccccgagcggugcgggugcaccuccagcacgugccuccacaaggaguggccgcacagccggaacuggcgcugcaaccccaccuggugcuggggcgucgggaccggcugcacgugcugcgggguggacgugaaggaccuguucaccgaccacauguucgucaaguggaagguggaguacaugaagaccgaggccaucgugugcgucgagcugaccucccaggagcggcagugcagccucaucgaggccggcacccgcuucaaccugggccccgugaccaucacccuguccgagccccggaacauccagcagaagcucccgcccgagaucaucacgcugcaccccaagaucgaggagggguucuucgaccugaugcacgugcagaagguccucagcgccuccaccgugugcaagcugcagagcugcacccacggcauccccggggaccugcagaucuaccacaucggcaaccuccugaagggcgaccgcgugaacgggcaccugauccacaagaucgagccgcacuucaacaccuccuggaugagcugggacggcugcgaccucgacuacuacugcaacauggggaacuggcccuccugcacguacaccggcgucacccagcacaaccacgccgccuucgugaaccugcugaacaucgagaccgacuacacgaagaccuuccacuuccacagcaagcgggugaccgcgcacggggacacgccccagcucgaccugaaggcccgccccaccuacggcgccggcgagaucaccguccugguggaggucgccgacauggagcuccacaccaagaagguggagaucuccgggcugaaguucgccagccuggugugcaccggcugcuacgcgugcuccagcgggaucuccugcaagguccggauccacguggacgagccggacgagcucacggugcacgucaagagcuccgaccccgacgugguggccgccagcaccucccugauggcccgcaagcuggaguucggcaccgacagcaucuucaaggccuucagcgcgaugcccaagaccucccucugcuucuacaucgucgagcgggaguacugcaagagcugcuccgaggacgacaccaagaagugcguggacacgaagcuggagcagccccagagcauccugaucgagcacaaggggaccaucaucggcaagcagaacgacacgugcaccgccaaggccuccugcuggcucgagagcgugaaguccuucuucuacggccugaagaacaugcuggggagcgucuucggcaacuucuucguggggauccuccuguuccuggccccguucgugcuccugguccuguucuucauguucggcuggaagauccuguucugcuucaagugcugccgccggacccgcggccucuucaaguaccggcaccugaaggacgacgaggagaccggguaccgccggaucaucgagcgccugaacuccaagaagggcaagaaccgccuccuggacggggagcggcuggccgaccgcaagaucgcggagcuguucagcaccaagacccacaucggc

SEQ ID NO: 12420 - RNA, 1932 nt, Artificial Sequence
  derived and/or modified CDS sequence (opt1) from CCHFV(Kashmanov)__DQ211631.1__Gc
uuccuggacagcaucgugaagggcaugaagaacucccucaacagcaccucccuggagaccagccuguccaucgaggcccccuggggggccaucaacguccagagcacguucaagccgaccguguccaccgcgaacaucgcccucagcugguccagcguggagcaccgcggcaacaagauccuggucaccgggcgguccgagagcaucaugaagcuggaggagcgcacgggcguguccugggaccucgggguggaggacgccagcgaguccaagcugcugaccgucagcaucauggaccucucccagauguacagccccguguucgaguaccuguccggcgaccggcagguggaggaguggcccaaggccaccugcaccggcgacugccccgagcgcugcgggugcacgagcagcaccugccugcacaaggaguggccgcacucccggaacuggcgcugcaaccccaccuggugcuggggcgucgggaccggcugcacgugcugcgggguggacgugaaggaccucuucaccgaccacauguucgucaaguggaagguggaguacaucaagaccgaggccaucgugugcgucgagcugaccagccaggagcggcagugcucccugaucgaggcgggcacgcgcuucaaccucggccccgugaccaucacccugagcgagccccggaacauccagcagaagcugccgcccgagaucaucacccuccaccccaagguggaggagggguucuucgaccugaugcacguccagaaggugcuguccgccagcacggugugcaagcuccaguccugcacccacggcauccccggggaccugcaggucuaccacaucggcaaccugcucaagggcgaccgcaucaacgggcaccugauccacaagaucgagccgcacuucaacaccagcuggauguccugggacggcugcgaccuggacuacuacugcaacaugggggacuggcccagcugcaccuacacgggcgugacccagcacaaccacgccgccuucgugaaccuccugaacaucgagaccgacuacaccaagacguuccacuuccacuccaagcgggucaccgcgcacggggacaccccccagcuggaccucaaggcccgccccaccuacggcgccggcgagaucacggugcuggucgagguggccgacauggagcugcacaccaagaagguggagaucagcgggcucaaguucgccucccuggcgugcaccggcugcuacgccugcagcuccgggaucagcugcaagguccggauccacguggacgagccggacgagcugaccgugcacgucaaguccagcgaccccgacgugguggccgccuccacgagccucauggcccgcaagcuggaguucggcaccgacagcaccuucaaggcguucuccgccaugcccaagaccagccugugcuucuacaucgucgagcgggaguacugcaaguccugcagcgaggaggacacccagaagugcguggacacgaagcucgagcagccccaguccauccugaucgagcacaaggggaccaucaucggcaagcagaacgacaccugcaccgccaaggccagcugcuggcuggaguccgugaagagcuucuucuacggccucaagaacaugcugggguccgucuucggcaacuucuucaucgggauccugcucuuccuggccccguucgugcugcucgugcuguucuucauguucggcuggaagauccuguucugcuucaagugcugccgccggacgcgcgggcugcucaaguaccggcaccugaaggacgacgaggagaccggcuaccgccggaucaucgagcgccugaacaacaagaagggcaagaaccgccuccuggacggggagcggcuggcggaccgcaagaucgccgagcucuucagcaccaagacccacaucggc

SEQ ID NO: 12421 - RNA, 1932 nt, Artificial Sequence
  derived and/or modified CDS sequence (opt1) from CCHFV(Oman)__DQ211632.1__Gc
uuccucgacagcaucgccaagggcaugaagaaccuccugaacuccaccagccuggagaccucccucagcaucgaggcccccuggggcgcgaucaacgugcaguccacguucaagccgaccgucagcaccgccaacaucgcccuguccuggagcuccguggagcaccgcgggaacaagauccuggugagcgggcgguccgagagcaucaugaagcucgaggagcgcaccggcaucuccugggaccugggggucgaggacgccagcgaguccaagcugcucacggugagcgugauggaccugucccagauguacagccccgucuucgaguaccuguccggcgaccgccagguggaggaguggcccaaggcgaccugcaccggcgacugccccgagcggugcgggugcaccagcagcacgugccuccacaaggaguggccgcacucccggaacuggcgcugcaaccccaccuggugcuggggcguggggaccggcugcacgugcugcgggcuggacgucaaggaccuguucaccgacuacauguucgugaaguggaagguggaguacaucaagaccgaggccaucgucugcguggagcucaccagccaggagcggcagugcucccugaucgaggccggcacccgcuucaaccugggccccgugacgaucacccucagcgagccccggaacauccagcagaagcugccgcccgagaucgucacccugcacccccgcaucgaggagggguucuucgaccucaugcacgugcagaaggugcuguccgccagcaccgucugcaagcugcaguccugcacgcacggcgugcccggggaccuccagguguaccacaucggcaaccugcugaagggcgacaaggucaacgggcaccucauccacaagguggagccgcacuucaacaccagcuggauguccugggacggcugcgaccuggacuacuacugcaacaugggggacuggcccagcugcaccuacaccggcgugacgcagcacaaccacgccgcguucgucaaccugcucaacaucgagaccgacuacaccaagaacuuccacuuccacuccaagcgggugaccgcccacggggacacgccccagcuggaccugaaggcccgccccaacuacggcgccggcgaggucaccgugcucguggaggucgccgacauggagcugcacaccaagaagaucgagaucagcgggcugaaguucgcgucccugaccugcacgggcugcuacgccugcagcuccgggaucagcugcaaggugcggauccacguggacgagccggacgagcucaccguccacgugaaguccgaggaccccgacaucguggccgccagcuccagccugauggcccgcaagcucgaguucggcaccgacagcaccuucaaggcguucuccgccaugcccaagacgagccugugcuucuacaucgucgagcgggaguacugcaaguccugcagcaaggaggacacccagaagugcgugaacgccaagcuggagcgcccccaguccauccucaucgagcacaaggggaccaucaucggcaagcagaacgacacgugcaccgccaaggccagcugcuggcuggaguccgucaagagcuucuucuacggccugaagaacaugcucuccgggaucuucggcaacguguucaucgggaucuuccuguuccuggcgccguucauccuccugauccuguucuucauguucggcuggcggauccuguucugcuucaagugcugccgccggacccgcggccucuucaaguaccggcaccugaaggacgacgaggagaccggguaccgcaagaucaucgagcgccugaacaacaagaagggcaagaacaagcuccuggacggggagcggcuggccgaccgcaagaucgccgagcuguucagcaccaagacccacaucggc

SEQ ID NO: 12422 - RNA, 1932 nt, Artificial Sequence
  derived and/or modified CDS sequence (opt1) from CCHFV(SPU97/85)__DQ211633.1__Gc
uuccuggacagcaucgugaagggcaagaagaaccuccugaacuccaccagccuggagaccucccucagcaucgaggcccccuggggcgccaucaacguccaguccacguucaagccgaccgugagcgcggccaacaucgcccuguccuggagcuccguggagcaccgcgggaacaagauccuggucagcgggcgguccgagagcaucaugaagcucgaggagcgcaccggcaucuccugggaccuggggguggaggacgccagcgaguccaagcugcucaccgugagcgucauggaccugucccagauguacagccccguguucgaguaccuguccggcgaccgccagguggaggaguggcccaaggccacgugcaccggcgacugccccgagcggugcgggugcaccagcagcacgugccuccacaaggaguggccgcacucccggaacuggcgcugcaaccccaccuggugcuggggcgucgggaccggcugcacgugcugcgggcuggacgugaaggaccuguucaccgacuacauguucgugaaguggaaggucgaguacaucaagaccgaggcgaucgugugcguggagcucaccagccaggagcggcagugcucccugaucgaggccggcacccgcuucaaccugggccccgucaccaucacgcucagcgagccccggaacauccagcagaagcugccgcccgagaucaucacccugcacccccgcaucgaggagggguucuucgaccucaugcacgugcagaaggugcuguccgccagcaccgucugcaagcugcaguccugcacccacggcgugcccggggaccuccagguguaccacaucggcaaccugcugaagggcgacaaggucaacgggcaccucauccacaagaucgagccgcacuucaacacgagcuggauguccugggacggcugcgaccuggacuacuacugcaacaugggggacuggcccagcugcaccuacaccggcgugacccagcacaaccacgccgcguucgugaaccugcucaacaucgagacggacuacaccaagaacuuccacuuccacuccaagcgggucaccgcccacggggacacgccccagcuggaccugaaggcccgccccaccuacggcgccggcgaggugaccguccucguggagguggccgacauggagcugcacaccaagaagaucgagaucagcgggcugaaguucgcgucccucagcugcaccggcugcuacgccugcuccagcgggaucuccugcaagguccggauccacguggacgagccggacgagcugacggugcacgucaagagcgaggaccccgacaucguggccgccggcuccagccugauggcccgcaagcucgaguucggggcggacagcaccuucaaggccuucuccgccaugcccaagaccagccugugcuucuacaucguggagcgggaguacugcaaguccugcagccgcgaggacacccagaagugcgucaacacgaagcuggagcggccccaguccauccucaucgagcacaagggcaccaucaucggcaagcagaacgacacgugcaccgccaaggccagcugcuggcuggaguccgucaagagcuucuucuacgggcugaaguccaugcucagcggcaucuucgggaacguguucaucggcaucuuccuguucaucgcgccguucgugcugcucauccuguucuucauguucggguggcgcauccuguucugcuucaagugcugccggcgcacccggggccuguucaaguaccgccaccucaaggacgacgaggagaccggcuaccgcaagaucaucgagcggcugaacaacaagaaggggaagaacaagcugcucgacggcgagcgccuggccgaccggaagaucgccgagcuguucuccaccaagagccacaucggg

SEQ ID NO: 12423 - RNA, 1932 nt, Artificial Sequence
  derived and/or modified CDS sequence (opt1) from CCHFV(SPU103/87)__DQ211634.1__Gc
uuccucgacaacaucgugaagggcaugaagaaccuccugaacagcaccucccuggagaccagccucuccaucgaggcccccuggggcgccaucaacgugcagagcacguacaagccgaccguguccaccgcgaacaucgcccugagcugguccagcguggagcaccgcgggaacaagauccuggucuccgggcggagcgaguccaucaugaagcucgaggagcgcaccggcaucagcugggaccuggggguggaggacgccuccgagagcaagcugcucacgguguccgucauggaccugagccagauguacucccccguguucgaguaccugagcggcgaccgccagguggaggaguggcccaaggcgaccugcaccggcgacugccccgagcggugcgggugcaccuccagcacgugccuccacaaggaguggccgcacagccggaacuggcgcugcaaccccaccuggugcuggggcgucgggaccggcugcacgugcugcgggcuggacgugaaggaccuguucaccgacuacauguucgugaaguggaagaucgaguacaucaagaccgaggccaucgucugcguggagcucaccucccaggagcggcagugcagccugaucgaggccggcacccgcuucaaccugggccccgugacgaucacccucuccgagccccggaacauccagcagaagcugccgagcgagaucaucacccugcacccccgcaucgaggagggguucuucgaccucaugcacguccagaaggugcuguccgccagcaccgugugcaagcugcaguccugcacgcacggcguccccggggaccuccagguguaccacaucggcaaccugcugaagggcgacaaggugaacgggcaccucguccacaagaucgagccccacuucaacaccagcuggauguccugggacggcugcgaccuggacuacuacugcaacaugggggacuggccgagcugcaccuacaccggcgugacgcagcacaaccacgccuccuucgugaaccugcucaacaucgagaccgacuacaccaagaacuuccacuuccacagcaagcgggucaccgcccacggggacacgccccagcuggaccugaaggcgcgccccaccuacggcgccggcgagaucaccgugcucgucgagguggccgacauggagcugcacaccaagaagaucgagaucuccgggcugaaguucacgagccugaccugcaccggcugcuacgccugcuccagcgggaucuccugcaaggugcggauccacgucgacgagcccgacgagcucaccgugcacgucaagagcgacgacccggacgugguggccgcguccagcagccugauggcccgcaagcucgaguucggcacggacuccaccuucaaggccuucagcgccaugcccaagaccucccugugcuucuacaucguggagcgggaguacugcaagagcugcuccgaggaggacacccagaagugcgucaacaccaagcuggagcagccccagagcauccucaucgagcacaaggggacgaucaucggcaagcagaacaacacgugcaaggcccgcgcgggcugcuggcuggaguccgucaagagcuucuucuacgggcugaagaacaugcucuccggcaucuucgggaacguguucaucggcaucuuccuguuccuggcccccuucauccuccugauccuguucuucauguucggguggcggauccuguucugcuucaagugcugccgccggacccgcggccucuucaaguaccggcaccugaaggacgacgaggagaccggcuaccgcaagaucaucgagcgccugaacaacaagaaggggaagaacaagcuccuggacggcgagcggcuggccgaccgccggaucgccgagcuguucagcaccaagacccacaucggg

SEQ ID NO: 12424 - RNA, 1932 nt, Artificial Sequence
  derived and/or modified CDS sequence (opt1) from CCHFV(SPU415/85)__DQ211635.1__Gc
uuccuggacagcaucgugaagggcaugaagaaccuccugaacuccaccagccuggagaccucccucagcaucgaggcccccuggggcgccaucaacguccaguccacguucaagccgaccgugagcgcggccaacaucgcccuguccuggagcuccguggagcaccgcgggaacaagauccuggucagcgggcgguccgagagcaucaugaagcucgaggagcgcaccggcaucuccugggaccuggggguggaggacgccagcgaguccaagcugcucaccgugagcgucauggaccugucccagauguacagccccguguucgaguaccuguccggcgaccgccagguggaggaguggcccaaggccacgugcaccggcgacugccccgagcggugcgggugcaccagcagcacgugccuccacaaggaguggccgcacucccggaacuggcgcugcaaccccaccuggugcuggggcgucgggaccggcugcacgugcugcgggcuggacgugaaggaccuguucaccgacuacauguucgugaaguggaaggucgaguacaucaagaccgaggcgaucgugugcguggagcucaccagccaggagcggcagugcucccugaucgaggccggcacccgcuucaaccugggccccgucaccaucacgcucagcgagccccggaacauccagcagaagcugccgcccgagaucaucacccugcacccccgcaucgaggagggguucuucgaccucaugcacgugcagcgggugcuguccgccagcaccgucugcaagcugcaguccugcacccacggcgugcccggggaccuccagguguaccacaucggcaaccugcugaagggcgacaaggucaacgggcaccucauccacaagaucgagccgcacuucaacacgagcuggauguccugggacggcugcgaccuggacuacuacugcaacaugggggacuggcccagcugcaccuacaccggcgugacccagcacaaccacgccgcguucgugaaccugcucaacaucgagacggacuacaccaagaacuuccacuuccacuccaagcgcgucaccgcccacggggacacgccccagcuggaccugaaggcccggcccaccuacggcgccggcgaggugaccguccucguggagguggccgacauggagcugcacaccaagaagaucgagaucagcgggcugaaguucgcgucccugaccugcacgggcugcuacgccugcagcuccgggaucagcugcaaggucaagauccacguggacgagccggacgagcucaccgugcacgucaaguccgaggaccccgacaucguggccgccggcagcucccugauggcccgcaagcucgaguucggggcggacagcaccuucaaggccuucagcgccaugcccaagaccucccugugcuucuacaucguggagcgggaguacugcaagagcugcucccgcgaggacacgcggaagugcgucaacaccaagcuggaccgcccccagagcauccucaucgagcacaagggcaccaucaucggcaagcagaacaacacgugcaccgccaaggccuccugcuggcuggagagcgugaaguccuucuucuacgggcugaagaacaugcucagcggcaucuucgggaacguguucaucggcaucuuccuguucaucgcgccguucguccugcucauccuguucuucauguucggguggcggauccuguucugcuucaagugcugccgccggacccgcggccuguucaaguaccgccaccucaaggacgacgaggagaccggcuaccggaagaucaucgagcgccugaacaacaagaaggggaagaacaagcugcucgacggcgagcggcuggccgaccgcaagaucgccgagcuguucuccaccaagagccacaucggg

SEQ ID NO: 12425 - RNA, 1932 nt, Artificial Sequence
  derived and/or modified CDS sequence (opt1) from CCHFV(Turkey200310849)__DQ211636.1__Gc
uuccuggacagcaucgugaagggcaugaagaaccuccugaacuccaccagccuggagaccucccucagcaucgaggcccccuggggcgccaucaacguccaguccacguucaagccggcggugagcaccgccaacaucgcccuguccuggagcuccguggagcaccgcgggaacaagauccuggucaccgggcggagcgaguccaucaugaagcucgaggagcgcaccggcgugagcugggaccuggggguggaggacgccuccgagagcaagcugcucacggucuccaucauggaccugagccagauguacucccccguguucgaguaccugagcggcgaccgccagguggaggaguggcccaaggcgaccugcaccggcgacugccccgagcggugcgggugcaccuccagcacgugccuccacaaggaguggccgcacagccggaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcugaccucccaggagcggcagugcagccucaucgaggccggcacccgcuucaaccugggccccgugacgaucacccuguccgagccccggaacauccagcagaagcucccgcccgagaucaucacccugcaccccaagaucgaggagggguucuucgaccugaugcacgugcagaagguccucagcgccuccaccgugugcaagcugcagagcugcacgcacggcauccccggggaccuccagguguaccacaucggcaaccugcugaagggcgaccgcgucaacgggcaccugauccacaagaucgagucccacuucaacaccagcuggauguccugggacggcugcgaccucgacuacuacugcaacaugggggacuggccgagcugcaccuacaccggcgugacgcagcacaaccacgccgcguucgugaaccugcugaacaucgagaccgacuacaccaagaccuuccacuuccacuccaagcgggucacggcccacggggacacgccccagcucgaccugaaggcccgccccaccuacggcgccggcgagaucaccgugcuggucgagguggccgacauggagcuccacaccaagaagguggagaucagcgggcugaaguucgcgucccuggccugcaccggcugcuacgccugcagcuccgggaucagcugcaagguccggauccacguggacgagcccgacgagcucaccgugcacgucaaguccagcgacccggacgugguggccgccuccaccagccugauggcgcgcaagcuggaguucggcacggacagcaccuucaaggccuucuccgccaugcccaagaccagccucugcuucuacaucgucgagcgggaguacugcaaguccugcagcgaggacgacacccagaagugcguggacacccgccuggagcagccccaguccauccugaucgagcacaaggggacgaucaucggcaagcagaacgacacgugcaccgccaaggccagcugcuggcucgaguccgucaagagcuucuucuacggccugaagaacaugcugggguccguguucggcaaccucuucaucgggauccugcuguuccucgcgcccuucgugcugcuggugcuguucuucauguucggcuggaagauccucuucugcuucaagugcugccggcgcacccgggggcuguucaaguaccgccaccugaaggacgacgaggagaccggcuaccggcgcaucaucgagcgccucaacagcaagaagggcaagaaccggcugcuggacggggaccgccucgccgaccggaagaucgccgagcuguucuccaccaagacccacaucggc

SEQ ID NO: 12426 - RNA, 1932 nt, Artificial Sequence
  derived and/or modified CDS sequence (opt1) from CCHFV(Iran-52)__DQ446215.1__Gc
uuccuggacagcaucgugaagggcaugaagaaccuccugaacuccaccagccuggagaccucccucagcaucgaggcccccuggggcgccaucaacguccaguccacguacaagccgaccgugagcaccgcgaacaucgcccuguccuggagcuccguggagcaccgcgggaacaagguccuggugagcgggcgguccgagagcaucaugaagcucgaggagcgcaccggcaucuccugggaccuggggguggaggacgccagcgaguccaagcugcucacggucagcgugauggaccugucccagauguacagccccguguucgaguaccuguccggcgaccggcaggucgaggaguggcccaaggcgaccugcaccggcgacugccccgagcgcugcgggugcaccagcagcacgugccuccacaaggaguggccgcacucccggaacuggcgcugcaaccccaccuggugcuggggcguggggaccggcugcacgugcugcgggcuggacgugaaggaccuguucaccgacuacauguucgucaaguggaagguggaguacaucaagaccgaggccaucgugugcgucgagcucaccagccaggagcggcagugcucccugaucgaggccggcacccgcuucaaccugggcagcgugacgaucacccucuccgagccccggaacauccagcagaagcugcccccggagaucaucacccugcaccccaagaucgaggagggguucuucgaccucaugcacgugcagaagguccugagcgccuccaccgugugcaagcugcagagcugcacgcacggcgugcccggggaccuccaggucuaccacaucggcaaccugcugaagggcgaccgcgugaacgggcaccucauccacaagaucgagcagcacuucaacaccuccuggaugagcugggacggcugcgaccuggacuacuacugcaacaugggggacuggcccuccugcaccuacaccggcgugacgcagcacaaccacgccagcuucgucaaccugcucaacaucgagaccgacuacaccaagaccuuccacuuccacuccaagcgggugacggcccacggggacaccccgcagcuggaccugaaggcgcgccccaccuacggcgccggcgagaucaccguccucguggagguggccgacauggagcugcacacgaagaagaucgagaucagcgggcugaaguucgccggccugaccugcaccgggugcuacgccugcuccagcggcaucuccugcaagguccggauccacguggaggagcccgacgagcucaccgugcacgucaagagcgacgaccccgacgugguggcggccuccagcagccugauggcccgcaagcucgaguucgggacggacuccaccuucaaggccuucagcgccaugccgaagaccucccugugcuucuacaucgucgagcgggaguacugcaagagcugcuccaaggaggacacccagaagugcgugaacaccaagcuggagcagccccagagcauccucaucgagcacaagggcacgaucaucggcaagcagaacaacacgugcaccgcgaaggccuccugcuggcuggagagcgugaaguccuucuucuacgggcugaagaacaugcucggcgggaucuucggcaacgucuucaucgggaucuucaccuuccugacccccuucauccugcucauccuguucuucauguucggcuggcgcauccuguucugcuucaagugcugccggcgcacccggggccuguucaaguaccgccaccucaaggacgacgaggagaccggguaccggaagaucaucgagcgccugaacaacaagaagggcaagaaccgccugcucgacggggagcggcuggccgaccgcaagaucgccgagcuguucagcaccaagacgcacaucggc

SEQ ID NO: 12427 - RNA, 1932 nt, Artificial Sequence
  derived and/or modified CDS sequence (opt1) from CCHFV(Iran-53)__DQ446216.1__Gc
uuccuggacagcaucgugaagggcaugaagaaccuccugaacuccaccagccuggagaccucccucagcaucgaggcccccuggggcgccaucaacguccaguccacguacaagccgaccgugagcaccgcgaacaucgcccuguccuggagcuccguggagcaccgcgggaacaagguccuggugagcgggcgguccgagagcaucaugaagcucgaggagcgcaccggcaucuccugggaccuggggguggaggacgccagcgaguccaagcugcucacggucagcgugauggaccugucccagauguacagccccguguucgaguaccuguccggcgaccggcaggucgaggaguggcccaaggcgaccugcaccggcgacugccccgagcgcugcgggugcaccagcagcacgugccuccacaaggaguggccgcacucccggaacuggcgcugcaaccccaccuggugcuggggcguggggaccggcugcacgugcugcgggcuggacgugaaggaccuguucaccgacuacauguucgucaaguggaagguggaguacaucaagaccgaggccaucgugugcgucgagcucaccagccaggagcggcagugcucccugaucgaggccggcacccgcuucaaccugggcagcgugacgaucacccucuccgagccccggaacauccagcagaagcugcccccggagaucaucacccugcaccccaagaucgaggagggguucuucgaccucaugcacgugcagaagguccugagcgccuccaccgugugcaagcugcagagcugcacgcacggcgugcccggggaccuccaggucuaccacaucggcaaccugcugaagggcgaccgcgugaacgggcaccucauccacaagaucgagcagcacuucaacaccuccuggaugagcugggacggcugcgaccuggacuacuacugcaacaugggggacuggcccuccugcaccuacaccggcgugacgcagcacaaccacgccagcuucgucaaccugcucaacaucgagaccgacuacaccaagaccuuccacuuccacuccaagcgggugacggcccacggggacaccccgcagcuggaccugaaggcgcgccccaccuacggcgccggcgaggucaccgugcucguggaggucgccgacauggagcugcacacgaagaagaucgagaucagcgggcugaaguucgccggccugaccugcaccgggugcuacgccugcuccagcggcaucuccugcaaggugcggauccacguggacgagcccgacgagcucaccguccacgucaagagcgacgaccccgacgugguggcggccuccagcagccugauggcccgcaagcucgaguucgggacggacuccaccuucaaggccuucagcgccaugccgaagaccucccugugcuucuacaucguggagcgggaguacugcaagagcugcuccaaggaggacacccagaagugcgugaacaccaagcuggagcagccccagagcauccucaucgagcacaagggcacgaucaucggcaagcagaacaacacgugcaccgcgaaggccuccugcuggcuggagagcgucaaguccuucuucuacgggcugaagaacaugcucggcgggaucuucggcaacguguucaucgggaucuucaccuuccugacccccuucauccugcucauccuguucuucauguucggcuggcgcauccuguucugcuucaagugcugccggcgcacccggggccuguucaaguaccgccaccucaaggacgacgaggagaccggguaccggaagaucaucgagcgccugaacaacaagaagggcaagaaccgccugcucgacggggagcggcuggccgaccgcaagaucgccgagcuguucagcaccaagacgcacaucggc

SEQ ID NO: 12428 - RNA, 1932 nt, Artificial Sequence
  derived and/or modified CDS sequence (opt1) from CCHFV(Kosova Hoti)__EU037902.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcaucagcugggaccuggggguggaggacgccuccgagagcaagcugcucaccguguccaucauggaccugagccagauguacucccccgucuucgaguaccugagcggcgaccggcagguggaggaguggcccaaggccaccugcaccggcgacugcccccagcgcugcgggugcacguccagcaccugccuccacaaggaguggccgcacagccggaacuggcgcugcaaccccaccuggugcuggggcguggggaccggcugcacgugcugcggggucgacgugaaggaccuguucaccgaccacauguucgugaaguggaaggucgaguacaucaagaccgaggccaucgugugcguggagcugaccucccaggagcggcagugcagccucaucgaggcgggcacgcgcuucaaccugggccccgucaccaucacccuguccgagccccggaacauccagcagaagcucccgcccgagaucaucacccugcaccccaagaucgaggagggguucuucgaccugaugcacgugcagaaggugcucagcgccuccacggucugcaagcugcagagcugcacccacggcauccccggggaccugcagguguaccacaucggcaaccuccugaagggcgaccgcgugaacgggcaccugauccacaagaucgagccgcacuucaacaccuccuggaugagcugggacggcugcgaccucgacuacuacugcaacaugggggacuggcccuccugcaccuacacgggcgucacccagcacaaccacgccgccuucgugaaccugcugaacaucgagaccgacuacaccaagacguuccacuuccacagcaagcgggugaccgcgcacggggacaccccccagcucgaccugaaggcccgccccaccuacggcgccggcgagaucacgguccugguggaggucgccgacauggagcuccacaccaagaagguggagaucuccgggcugaaguucgccagccuggcgugcaccggcugcuacgccugcuccagcgggaucuccugcaaggugcggauccacgucgacgagccggacgagcucaccgugcacgugaagagcuccgaccccgacgucguggccgccggcacgagccugauggcccgcaagcuggaguucgggaccgacuccaccuucaaggcguucagcgccaugcccaagaccagccucugcuucuacaucguggagaaggaguacugcaaguccugcagcgaggacgacaccaagaagugcgucgacacgaagcuggagcagccccaguccauccugaucgagcaccggggcaccaucaucggcaagcagaacgacaccugcaccgccaaggccagcugcuggcucgaguccgugaagagcuucuucuacgggcugaagaacaugcugggcuccguguucgggaacuucuucaucggcauccuccuguuccuggccccguucguccuccuggugcuguucuucauguucggguggaagauccuguucugcuucaagugcugccgccggacgcgcggccucuucaaguaccggcaccugaaggacgacgaggagaccggcuaccgccggaucaucgagcgccugaacaacaagaaggggaagaaccgccuccuggacggcgagcggcuggcggaccgcaagaucgccgagcucuucagcaccaagacccacaucggg

SEQ ID NO: 12429 - RNA, 1932 nt, Artificial Sequence
  derived and/or modified CDS sequence (opt1) from CCHFV(YL04057)__FJ562094.1__Gc
uuccuggacagcaucgccaagggcaagaagucccuccugaacagcaccucccuggagaccagccucuccaucgaggcccccuggggcgcgaucaacgugcagagcacguucaagccgaccgucuccgccgccaacaucgcccugagcugguccagcguggagcaccgcgggaacaagauccugguguccgggcggagcgaguccaucaugaagcucgaggagcgcaccggcgucagcuggaaccuggggguggaggacgccuccgagagcaagacccugacgguguccgucauggaccucagccagauguacucccccguguucgaguaccugagcggcgaccgccagguggaggaguggcccaaggcgaccugcaccggcgacugccccgagcggugcgggugcaccagcuccacgugccugcacaaggaguggccgcacagccggaacuggcgcugcucccccaccuggugcuggggcgucgggaccggcugcacgugcugcgggcucgacgugaaggacuucuucaccgacuacaugcuggugaaguggaaggucgaguacaucaagaccgaggccaucgugugcguggagcugaccagccaggagcggcagugcucccucaucgaggccggcacccgcuucaaccugggccccgucacgaucacccugagcgagccccggaacgugcagcagcgccucccgcccgagaucgugacccugcaccccaagaucgaggagggguucuucgaccugaugcacguccagaagauccucuccgccagcaccgugugcaagcugcaguccugcacgcacggcgugcccggggacuuccaggucuaccacgugggcaaccugcuccggggcgacaaggugaacgggcacagcauccacaagaucgagccgcacuucaacaccuccuggaugagcugggacggcugcgaccuggacuacuucugcaacaugggggacuggcccuccugcaccuacaccggcgucacgcagcacaaccgcgcggccuucaucaacaugcugaacaucgagaccgacuacaccaagaccuuccacuuccacagcaagcgggugacggcccacggggacacgccccagcucgaccugaaggcccgccccgccuacggcgcgggcgaggucaccgugcugguggaggucgccgaccucgagcugcacaccaagaagcuggagguguccgggcucaagaucgccagccugaccugcuccggcugcuacgccugcagcuccgggaucagcugcaaggugcggauccacgucaacgagccggacgaguucaccgugcacgugcgcagcuccgaccccgacgucguggccgcgggcagcucccugauggcccggaagaucgaguucggggccgacagcaccuucaaggccuucuccagcaugcccaaggacucccucugcuucuacaucguggagaaggacuacugcagcuccugcaccgacgacgacacgcagaagugcgucaacaccaagcuggaccacccccagagcauccugaucgagcacaagggcaccaucaucggcaagcagaacgacacgugcuccaccaagaccagcugcuggcucgaguccgugaagggguucuucuacggccugaagaacaugcugagcgggaucuucggcaacguguuccucgggauccugcuguuccucgccccguucguccugcugaucuucuucuucuucuucggcuggcgccuccuguucugccugaagugcugccggcgcacccggggccugcucaaguacaagcaccugaaggacgaggaggaggcgggguacaagaagaucaucgagcgccugaacggcaagaaggggaagucccagcuguucgacggcgagcgccucgccgaccggaagaucgccgagcuguucagcaccaagauccacaucggc

SEQ ID NO: 12430 - RNA, 1932 nt, Artificial Sequence
  derived and/or modified CDS sequence (opt1) from CCHFV(V42/81)__GU477490.1__Gc
uuccuggacagcaucgugaagggcaagaagaaccuccugaacuccaccagccuggagaccucccucagcaucgaggcccccuggggcgccaucaacauccaguccacguucaagccgaccgucagcgcggccaacaucgcccuguccuggagcuccguggagcaccgcgggaacaagauccuggugagcgggcgguccgagagcaucaugaagcucgaggagcgcaccggcgucuccuggaaccuggggguggaggacgccagcgaguccaagcugcucaccgugagcaucauggaccugucccagauguacagccccgucuucgaguaccuguccggcgaccgccagguggaggaguggcccaaggccacgugcaccggcgacugccccgagcggugcgggugcaccagcagcacgugccuccacaaggaguggccgcacucccggaacuggcgcugcaaccccaccuggugcuggggcguggggaccggcugcacgugcugcggggucgacgugaaggaccuguucaucgaccacauguucgugaaguggaaggucgaguacaucaagaccgaggcgaucgugugcguggagcugaccagccaggagcggcagugcucccucaucgaggccggcacccgcuucaaccugggccccgucaccaucacccugagcgagccccggaacauccagcagaagcucccgcccgagaucaucacgcugcaccccaagaucgaggagggguucuucgaccugaugcacgugcagaaggugcucuccgccagcaccgucugcaagcugcaguccugcacccacggcauccccggggaccuccagguguaccacaucggcaaccuccugaagggcgaccgcgugaacgggcaccugauccacaagaucgagccgcacuucaacaccagcuggauguccugggacggcugcgaccucgacuacuacugcaacaugggggacuggcccagcugcacguacaccggcgucacccagcacaaccacgccgcguucgugaaccugcugaacaucgagaccgacuacacgaagaccuuccacuuccacuccaagcgggugaccgcccacggggagacgccccagcucgaccugaaggcccgccccgccuacggcgccggcgagaucaccguccugguggaggucgcggacauggagcuccacaccaagaagguggagaucagcgggcugaaguucgccucccuggccugcaccggcugcuacgccugcagcuccgggaucagcugcaaggugcggauccacgucgacgagccggacgagcucaccgugcacgugaaguccaacgaccccgacgucguggccgcgagcacgucccugauggcccgcaagcuggagagcggcaccgacagcaccuucaaggccuucuccgccaugcccaagaccagccucugcuucuacaucguggagcgggaguacugcaaguccugcagcgaggacgacacgcagaagugcgucgagaccaagcuggagcagccccaguccauccugaucgagcacaaggggaccaucaucggcaagcagaacgacacgugcaccgccaaggcgagcugcuggcucgaguccgucaagagcuucuucuacggccugaagaacaugcugggguccguguucggcaacuucuucaucgggauccuccuguuccuggccccguucgugcuccuggugcuguucuucauguucggcuggaagauccuguucugcuucaagugcugccgccggacccgcggccucuucaaguaccggcaccugaaggaggacgaggagaccggguaccgccggaucaucgagcgccugaacagcaagaagggcaagaaccgccuccuggacggggagcggcuggccgaccgcaagaucgccgagcuguucuccaccaagacccacaucggc

SEQ ID NO: 12431 - RNA, 1932 nt, Artificial Sequence
  derived and/or modified CDS sequence (opt1) from CCHFV(79121M18)__GU477493.1__Gc
uuccuggacagcaccgccaagggcaugaagucccuccugaacagcaccucccuggagacgagccucuccaucgaggcccccuggggggcgaucaacgugcagagcaccuucaagccgaccgucuccgccgccaacaucgcccugagcugguccagcguggagcaccgcggcaacaagauccugguguccgggcggagcgaguccaucaugaagcucgaggagcgcaccggcgucagcuggaaccuggggguggaggacgccuccgagagcaagacgcugaccguguccgucauggaccucagccagauguacucccccguguucgaguaccugagcggcgaccggcagguggaggaguggcccaaggcgaccugcaccggcgacugccccgagcgcugcgggugcacgagcuccaccugccugcacaaggaguggccgcacagccggaacuggcgcugcaaccccaccuggugcuggggcgucgggaccggcugcacgugcugcgggcucgacgugaaggacuucuucaccgacuacaugcuggugaaguggaaggucgaguacaucaagaccgaggccaucgugugcguggagcugaccucccaggagcggcagugcagccucaucgaggccggcacgcgcuucaaccugggccccgucaccaucacccuguccgagccccggaacgugcagcagcgccucccgcccgagaucgugacccugcaccccaagaucgaggagggguucuucgaccugaugcacguccagaagauccucagcgccuccacggugugcaagcugcagagcugcacccacggcgugcccggggacuuccagaucuaccacgucggcaaccugcuccggggcgacaaggugaacgggcacuccauccacaagaucgagccgcacuucaacaccagcuggauguccugggacggcugcgaccuggacuacuucugcaacaugggggacuggcccagcugcaccuacacgggcgugacccagcacaaccgcgcggccuucaucaacaugcugaacaucgagaccgacuacaccaagacguuccacuuccacuccaagcgggucaccgcccacggggacaccccccagcucgaccugaaggcccgccccgccuacggcgcgggcgaggugaccguccugguggagguggccgaccucgagcugcacacgaagaagcuggaggucagcgggcucaagaucgccucccugaccugcagcggcugcuacgccugcuccagcgggaucuccugcaaggugcggauccacgugaacgagccggacgaguucaccguccacgugcgcagcagcgaccccgacguggucgccgcgggcuccagccugauggcccggaagaucgaguucggggccgacuccaccuucaaggccuucagcuccaugcccaaggacagccucugcuucuacaucguggagaaggacuacugcuccagcugcacggacgacgacacccagaagugcgugaacaccaagcuggaccacccccaguccauccugaucgagcacaagggcaccaucaucggcaagcagaacgacaccugcagcacgaagaccuccugcuggcucgagagcgucaagggguucuucuacggccugaagaacaugcuguccgggaucuucggcaacguguuccucgggaucuuccuguuccuggccccguucgugcuccugaucuucuucuucuucuucggcuggcgccugcucuucugccugaagugcugccggcgcacccggggccugcugaaguacaagcaccucaaggacgaggaggaggcgggguacaagaagaucaucgagcgccugaacggcaagaaggggaagagccagcuguucgacggcgagcgccucgccgaccggaagaucgccgagcuguucuccaccaagauccacaucggc

SEQ ID NO: 12432 - RNA, 1932 nt, Artificial Sequence
  derived and/or modified CDS sequence (opt1) from CCHFV(Afg09-2990)__HM452306.1__Gc
uuccuggacagcaucgugaagggcaugaagaaccuccugaacuccaccagccuggagaccucccucagcaucgaggcccccuggggcgccaucaacguccaguccacguacaagccgaccgugagcaccgcgaacaucgcccuguccuggagcuccguggagcaccgcgggaacaagguccuggugagcgggcgguccgagagcaucaugaagcucgaggagcgcaccggcaucuccugggaccuggggguggaggacgccagcgaguccaagcugcucacggucagcgugauggaccugucccagauguacagccccguguucgaguaccuguccggcgaccggcaggucgaggaguggcccaaggcgaccugcaccggcgacugccccgagcgcugcgggugcaccagcagcacgugccuccacaaggaguggccgcacucccggaacuggcgcugcaaccccaccuggugcuggggcguggggaccggcugcacgugcugcgggcuggacgugaaggaccuguucaccgacuacauguucgucaaguggaagguggaguacaucaagaccgaggccaucgugugcgucgagcucaccagccaggagcggcagugcucccugaucgaggccggcacccgcuucaaccugggcagcgugacgaucacccucuccgagccccggaacauccagcagaagcugcccccggagaucaucacccugcaccccaagaucgaggagggguucuucgaccucaugcacgugcagaagguccugagcgccuccaccgugugcaagcugcagagcugcacgcacggcgugcccggggaccuccaggucuaccacaucggcaaccugcugaagggcgaccgcgugaacgggcaccucauccacaagaucgagcagcacuucaacaccuccuggaugagcugggacggcugcgaccuggacuacuacugcaacaugggggacuggcccuccugcaccuacaccggcgugacgcagcacaaccacgccagcuucgucaaccugcucaacaucgagaccgacuacaccaagaccuuccacuuccacuccaagcgggugacggcccacggggacaccccgcagcuggaccugaaggcgcgccccaccuacggcgccggcgagaucaccguccucguggagguggccgacauggagcugcacacgaagaagaucgagaucagcgggcugaaguucgccggccugaccugcaccgggugcuacgccugcuccagcggcaucuccugcaagguccggauccacguggacgagcccgacgagcucaccgugcacgucaagagcgacgaccccgacgugguggcggccuccagcagccugauggcccgcaagcucgaguucgggacggacuccaccuucaaggccuucagcgccaugccgaagaccucccugugcuucuacaucgucgagcgggaguacugcaagagcugcuccaaggaggacacccagaagugcgugaacaccaagcuggagcagccccagagcauccucaucgagcacaagggcacgaucaucggcaagcagaacaacacgugcaccgcgaaggccuccugcuggcuggagagcgugaaguccuucuucuacgggcugaagaacaugcucggcgggaucuucggcaacgucuucaucgggaucuucaccuuccugacccccuucauccugcucauccuguucuucauguucggcuggcgcauccuguucugcuucaagugcugccggcgcacccggggccuguucaaguaccgccaccucaaggacgacgaggagaccggguaccggaagaucaucgagcgccugaacaacaagaagggcaagaaccgccugcucgacggggagcggcuggccgaccgcaagaucgccgagcuguucagcaccaagacgcacaucggc

SEQ ID NO: 12433 - RNA, 1932 nt, Artificial Sequence
  derived and/or modified CDS sequence (opt1) from CCHFV(Sudan Al-Fulah 3-2008)__HQ378184.1__Gc
uuccuggacagcaucgugaagggcaugaagaaccuccugaacuccaccagccuggagaccucccucagcaucgaggcccccuggggcgccaucaacguccaguccacguacaagccgaccgugagcaccgcgaacaucgcccuguccuggagcuccguggagcaccgcgggaacaagauccuggucagcgggcgguccgagagcaucaugaagcucgaggagcgcaccggcaucuccugggaccuggggguggaggacgccagcgaguccaagcugcucacggugagcgucauggaccugucccagauguacagccccguguucgaguaccuguccggcgaccgccagguggaggaguggcccaaggcgaccugcaccggcgacugccccgagcggugcgggugcaccagcagcacgugccuccacaaggaguggccgcacucccggaacuggcgcugcaaccccaccuggugcuggggcgucgggaccggcugcacgugcugcgggcuggacgugaaggaccuguucaccgacuacauguucgugaaguggaaggucgaguacaucaagaccgaggccaucgugugcguggagcucaccagccaggagcggcagugcucccugaucgaggccggcacccgcuucaaccugggccccgucacgaucacccucagcgagccccggaacauccagcagaagcugccgcccgagaucaucacccugcacccccgcaucgaggagggguucuucgaccucaugcacgugcagaaggugcuguccgccagcaccgucugcaagcugcaguccugcacgcacggcgugcccggggaccuccagguguaccacaucggcaaccugcugaagggcgacaaggucaacgggcaccucauccacaagaucgagccgcacuucaacaccagcuggauguccugggacggcugcgaccuggacuacuacugcaacaugggggacuggcccagcugcaccuacaccggcgugacgcagcacaaccacgccuccuucgugaaccugcucaacaucgagaccgacuacaccaagaacuuccacuuccacagcaagcgggucaccgcccacggggacacgccccagcuggaccugaaggcgcgccccaccuacggcgccggcgagaucaccgugcucgucgagguggccgacauggagcugcacaccaagaagaucgagaucuccgggcugaaguucgccagccucacgugcaccggcugcuacgccugcuccagcgggaucuccugcaaggugcggauccacgucgacgagccggacgagcugaccgugcacgucaagagcgacgaccccgacgugguggcggccuccagcagccugauggcccgcaagcucgaguucggcaccgacuccacguucaaggccuucagcgccaugcccaagaccucccugugcuucuacaucguggagaaggaguacugcaagagcugcuccgaggaggacaccaagaagugcgucaacaccaagcuggagcagccccagagcauccucaucgagcacaaggggaccaucaucggcaagcagaacuccacgugcaccgcgaaggugagcugcuggcuggaguccgccaagagcuucuucuacggccugaaggacaugcucuccgggaucuucggcaacguguucaucgggaucuuccuguuccuggccccguucguccuccuggugcuguucuucauguucggcuggcggauccugcucugcuuccgcugcugccggcgcacccgggggcuguucaaguaccgccaccugaaggacgacgaggagaccggcuaccggcgcaucaucgagcgccucaacaacaagaagggcaagaacaagcugcuggacggggagcggcucgccgaccgcaagaucgccgagcuguucagcacgaagacccacaucggc

SEQ ID NO: 12434 - RNA, 1932 nt, Artificial Sequence
  derived and/or modified CDS sequence (opt1) from CCHFV(Sudan AB1-2009)__HQ378187.1__Gc
uuccucgacagcaucgccaagggcaugaagaaccuccugaacuccaccagccuggagaccucccucagcaucgaggcccccuggggcgcgaucaacgugcaguccacguacaagccgaccgucagcaccgccaacaucgcccuguccuggagcuccguggagcaccgcgggaacaagauccuggugagcgggcgguccgagagcaucaugaagcucgaggagcgcaccggcaucuccugggaccugggggucgaggacgccagcgaguccaagcugcucacggugagcgugauggaccugucccagauguacagccccgucuucgaguaccuguccggcgaccgccagguggaggaguggcccaaggcgaccugcaccggcgacugccccgagcggugcgggugcaccagcagcacgugccuccacaaggaguggccgcacucccggaacuggcgcugcaaccccaccuggugcuggggcguggggaccggcugcacgugcugcgggcuggacgucaaggaccuguucaccgacuacauguucgugaaguggaagguggaguacaucaagaccgaggccaucgucugcguggagcucaccagccaggagcggcagugcucccugaucgaggccggcacccgcuucaaccugggccccgugacgaucacccucagcgagccccggaacauccagcagaagcugccgcccgagaucaucacccugcacccccgcaucgaggagggguucuucgaccucaugcacguccagaaggugcuguccgccagcaccgugugcaagcugcaguccugcacgcacggcguccccggggaccuccagguguaccacaucggcaaccugcugaagggcgacaaggugaacgggcaccucauccacaagaucgagccgcacuucaacaccagcuggauguccugggacggcugcgaccuggacuacuacugcaacaugggggacuggcccagcugcaccuacaccggcgucacgcagcacaaccacgccuccuucgugaaccugcucaacaucgagaccgacuacaccaagaacuuccacuuccacagcaagcgggugaccgcgcacggggacacgccccagcuggaccugaaggcccgccccaccuacggcgccggcgagaucaccguccucguggaggucgccgacauggagcugcacaccaagaagaucgagaucuccgggcugaaguucgccagccucacgugcaccggcugcuacgcgugcuccagcgggaucuccugcaaggugcggauccacguggacgagccggacgagcugaccguccacgucaagagcgacgaccccgacgugguggccgccuccagcagccugauggcccgcaagcucgaguucggcaccgacuccacguucaaggccuucagcgcgaugcccaagaccucccugugcuucuacaucguggagcgggagcacugcaagagcugcaacgaggaggacaccaagaagugcgugaacaccaagcuggagcagccccaguccauccucaucgagcacaaggggaccaucaucggcaagcagaacagcacgugcaccgcccgcgccuccugcuggcuggagagcgucaaguccuucuucuacggccugaagaacaugcucagcgggaucuucggcaacguguucauggggaucuuccuguuccuggccccguucauccuccugauccuguucuucauguucggcuggcggauccuguucugcuucaagugcugccgccggacccgcggccucuucaaguaccggcaccugaaggacgacgaggagaccggguaccgccgcaucaucgagcggcugaacaacaagaagggcaagaacaagcuccuggacggggagcgccuggccgaccggcgcaucgcggagcuguucuccacgaagacccacaucggc

SEQ ID NO: 12435 - RNA, 1932 nt, Artificial Sequence
  derived and/or modified CDS sequence (opt1) from CCHFV(NIVA 118595)__JN572083.1__Gc
uuccuggacagcaucgugaagggcaugaagaaccuccugaacuccaccagccuggagaccucccucagcaucgaggcccccuggggcgccaucaacguccaguccacguacaagccgaccgugagcgcggccaacaucgcccuguccuggagcuccguggagcaccgcgggaacaagauccuggucagcgggcgguccgagagcaucaugaagcucgaggagcgcaccggcaucuccugggaccuggggguggaggacgccagcgaguccaagcugcucaccgugagcgucauggaccugucccagauguacagccccguguucgaguaccuguccggcgaccgccagguggaggaguggcccaaggccacgugcaccggcgacugccccgagcggugcgggugcaccagcagcacgugccuccacaaggaguggccgcacucccggaacuggcgcugcaaccccaccuggugcuggggcgucgggaccggcugcacgugcugcgggcuggacgugaaggaccuguucaccgacuacauguucgugaaguggaaggucgaguacaucaagaccgaggcgaucgugugcguggagcucaccagccaggagcggcagugcucccugaucgaggccggcacccgcuucaaccugggcagcgucaccaucacgcucuccgagccccggaacauccagcagaagcugcccccggagaucaucacccugcacccccgcaucgaggagggguucuucgaccucaugcacgugcagaaggugcugagcgccuccaccgucugcaagcugcagagcugcacccacggcgugcccggggaccuccagguguaccacaucggcaaccugcugaagggcgaccgggucaacgggcaccucauccacaagaucgagcagcaccugaacacguccuggaugagcugggacggcugcgaccuggacuacuacugcaacaugggggacuggcccuccugcaccuacaccggcgugacccagcacaaccacgccagcuucgugaaccuccugaacaucgagacggacuacaccaagaccuuccacuuccacuccaagcgcgucaccgcgcacggggacacgccgcagcuggaccucaaggcccggcccaccuacggcgccggcgagaucaccgugcuggucgagguggccgacauggagcugcacaccaagaagaucgagaucagcgggcucaaguucgccucccugagcugcacgggcugcuacgcgugcuccagcgggaucuccugcaaggugcgcauccacgucgacgagcccgacgagcugaccgugcacgucaagagcgacgaccccgacgugguggccgccagcuccagccucauggcccggaagcuggaguccggcaccgacagcaccuucaaggccuucuccgcgaugccgaagacgagccugugcuucuacaucguggagcgcgaguacugcaaggggugcuccaaggaggacacccagaagugcgucaacaccaagcucgagcagccccagagcauccugaucgagcacaagggcaccaucaucggcaagcagaacaacacgugcaccgccaaggccuccugcuggcuggagagcgugaaguccuucuucuacgggcucaagaacaugcugagcggcaucuucgggaacguguuccugggcaucuucuccuuccucgcccccuucguccugcugauccuguucuucauguucggguggcggauccucuucugcuucaagugcugccgccggacccgcggccuguucaaguaccggcaccugaaggacgacgaggagaccggcuaccgcaagaucaucgagcgccucaacaacaagaaggggaagaacaagcugcuggacggcgagcggcucgccgaccgcaagaucgcggagcuguucagcaccaagacgcacaucggg

SEQ ID NO: 12436 - RNA, 1932 nt, Artificial Sequence
  derived and/or modified CDS sequence (opt1) from CCHFV(NIV 112143)__JN572085.1__Gc
uuccuggacagcaucgugaagggcaugaagaaccuccugaacuccaccagccuggagaccucccucagcaucgaggcccccuggggcgccaucaacguccaguccacguacaagccgaccgugagcgcggccaacaucgcccuguccuggagcuccguggagcaccgcgggaacaagauccuggucagcgggcgguccgagagcaucaugaagcucgaggagcgcaccggcaucuccugggaccuggggguggaggacgccagcgaguccaagcugcucaccgugagcgucauggaccugucccagauguacagccccguguucgaguaccuguccggcgaccgccagguggaggaguggcccaaggccacgugcaccggcgacugccccgagcggugcgggugcaccagcagcacgugccuccacaaggaguggccgcacucccggaacuggcgcugcaaccccaccuggugcuggggcgucgggaccggcugcacgugcugcgggcuggacgugaaggaccuguucaccgacuacauguucgugaaguggaaggucgaguacaucaagaccgaggcgaucgugugcguggagcucaccagccaggagcggcagugcucccugaucgaggccggcacccgcuucaaccugggcagcgucaccaucacgcucuccgagccccggaacauccagcagaagcugcccccggagaucaucacccugcacccccgcaucgaggagggguucuucgaccucaugcacgugcagaaggugcugagcgccuccaccgucugcaagcugcagagcugcacccacggcgugcccggggaccuccagguguaccacaucggcaaccugcugaagggcgaccgggucaacgggcaccucauccacaagaucgagcagcaccugaacacguccuggaugagcugggacggcugcgaccuggacuacuacugcaacaugggggacuggcccuccugcaccuacaccggcgugacccagcacaaccacgccagcuucgugaaccuccugaacaucgagacggacuacaccaagaccuuccacuuccacuccaagcgcgucaccgcgcacggggacacgccgcagcuggaccucaaggcccggcccaccuacggcgccggcgagaucaccgugcuggucgagguggccgacauggagcugcacaccaagaagaucgagaucagcgggcucaaguucgccucccugagcugcacgggcugcuacgcgugcuccagcgggaucuccugcaaggugcgcauccacgucgacgagcccgacgagcugaccgugcacgucaagagcgacgaccccgacgugguggccgccagcuccagccucauggcccggaagcuggaguucggcaccgacuccaccuucaaggccuucagcgcgaugccgaagacgucccugugcuucuacaucguggagcgcgaguacugcaaggggugcagcaaggaggacacccagaagugcgucaacaccaagcucgagcagccccaguccauccugaucgagcacaagggcaccaucaucggcaagcagaacaacacgugcaccgccaaggccagcugcuggcuggaguccgucaagagcuucuucuacgggcucaagaacaugcuguccggcaucuucgggaacguguuccugggcaucuucagcuuccucgcccccuucgugcugcugauccuguucuucauguucggguggcggauccucuucugcuucaagugcugccgccggacccgcggccuguucaaguaccggcaccugaaggacgacgaggagaccggcuaccgcaagaucaucgagcgccucaacaacaagaaggggaagaacaagcugcuggacggcgagcggcucgccgaccgcaagaucgcggagcuguucuccaccaagacgcacaucggg

SEQ ID NO: 12437 - RNA, 1932 nt, Artificial Sequence
  derived and/or modified CDS sequence (opt1) from CCHFV(SCT ex Afghanistan)__KC344856.1__Gc
uuccugaacagcaucgugaagggcaugaagaaccuccugaacuccaccaaccuggagaccagccucuccaucgaggcccccuggggcgccaucaacguccagagcacguucaagccgaccguguccaccgcgaacaucgcccugagcugguccagcguggagcaccgcgggaacaagauccuggucuccgggcggagcgaguccaucaugaagcucgaggagcgcaccggcaucagcugggaccuggggguggaggacgccuccgagagcaagucccugacggugagcgucauggaccucucccagauguacagccccguguucgaguaccuguccggcgaccgccagguggaggaguggcccaaggcgaccugcaccggcgacugccccgagcggugcgggugcaccagcagcacgugccugcacaaggaguggccgcacucccggaacuggcgcugcaaccccaccuggugcuggggcgucgggaccggcugcacgugcugcgggcucgacgugaaggaccuguucaccgacuacauguucgugaaguggaaggucgaguacaucaagaccgaggccaucgugugcguggagcugaccagccaggagcggcagugcucccucaucgaggccggcacccgcuucaaccugggccccgucacgaucacccugagcgagccccggaacauccagcagaagcucccgcccgagaucaucacccugcacccccgcaucgaggagggguucuucgaccugaugcacgugcagaaggugcucuccgccagcaccgucugcaagcugcaguccugcacgcacggcgugcccggggaccuccagguguaccacaucggcaaccuccugaagggcgacaagcugaacgggcacaugauccacaagaucgagccgcacuucaacaccagcuggauguccugggacggcugcgaccucgacuacuacugcaacaugggggacuggcccagcugcaccuacaccggcgucacgcagcacaaccacgccgccuucgugaaccugcugaacaucgagaccgacuacaccaagaacuuccacuuccacuccaagcgggugaccgcgcacggggacacgccccagcucgaccugaaggcccgccccaccuacggcgccggcgagaucaccguccugguggaggucgccgacauggagcuccacaccaagaagaucgacaucagcgggcugaaguucgccucccugacgugcgcgggcugcuacgccugcagcuccgggaucagcugcaaggugcggauccacguggacgagccggacgagcucaccguccacgugaaguccgaggaccccgacaucguggccgccagcaccucccugaucgcccgcaagcuggagcucggcaccgacagcacguucaaggcguucagcgccaugcccaagaccucccugugcuucuacaucgucgagcgggaguacugcaagagcugcuccaaggaggacacccagaagugcgugaacaccaagcuggagcacccccaggggauccucaucgagcacaagggcaccaucaucggcaagcagaacgacacgugcaccgccaaggccgggugcuggcuggagagcgugaaguccuucuucuacggccugaagaacaugcucagcgggaucuucggcaacgucuucaucgggaucuuccuguuccuggccccguucgugcuccugauccuguucuucauguucggcuggcgccugcuguucugcuucaagugcugccggcgcacccggggccuguucaaguaccgccaccugaaggaggacgaggaguccggguaccggcgcaucaucgagcgccucaacaacaagaagggcaagaacaagcugcuggacggggagcggcucgcggaccgccggaucgccgagcuguucagcaccaagacgcacaucggc

SEQ ID NO: 12438 - RNA, 1932 nt, Artificial Sequence
  derived and/or modified CDS sequence (opt1) from CCHFV(Zahedan 2007)__KC867273.1__Gc
uuccuggacagcaucgugaaggacaugaagaaccuccugaacuccaccagccuggagaccucccucagcaucgaggcccccuggggcgccaucaacguccaguccacguacaagccgaccgugagcaccgcgaacaucgcccuguccuggagcuccguggagcaccgcgggaacaagguccuggugagcggccgguccgagagcaucaugaagcucgaggagcgcaccgggaucuccugggaccugggcguggaggacgccagcgaguccaagcugcucacggucagcgugauggaccugucccagauguacagccccguguucgaguaccuguccggggaccggcaggucgaggaguggcccaaggcgaccugcaccggcgacugccccgagcgcugcggcugcaccagcagcacgugccuccacaaggaguggccgcacucccggaacuggcgcugcaaccccaccuggugcuggggcguggggaccgggugcacgugcugcggccuggacgugaaggaccuguucaccgacuacauguucgucaaguggaagguggaguacaucaagaccgaggccaucgugugcgucgagcucaccagccaggagcggcagugcucccugaucgaggccgggacccgcuucaaccugggcagcgugacgaucacccucuccgagccccggaacauccagcagaagcugcccccggagaucaucacccugcaccccaagaucgaggagggcuucuucgaccucaugcacgugcagaagguccugagcgccuccaccgugugcaagcugcagagcugcacgcacggggugcccggcgaccuccaggucuaccacaucgggaaccugcugaagggcgaccgcgugaacggccaccucauccacaagaucgagcagcacuucaacaccuccuggaugagcugggacgggugcgaccuggacuacuacugcaacaugggcgacuggcccuccugcaccuacaccggggugacgcagcacaaccacgccagcuucgucaaccugcucaacaucgagaccgacuacaccaagaccuuccacuuccacuccaagcgggugacggcccacggcgacaccccgcagcuggaccugaaggcgcgccccaccuacggggccggcgagaucaccguccucguggagguggccgacauggagcugcacacgaagaagaucgagaucagcggccugaaguucgccgggcugaccugcaccggcugcuacgccugcuccagcgggaucuccugcaagguccggauccacguggacgagcccgacgagcucaccgugcacgucaagagcgacgaccccgacgugguggcggccuccagcagccugauggcccgcaagcucgaguucggcacggacuccaccuucaaggccuucagcgccaugccgaagaccucccugugcuucuacaucgucgagcgggaguacugcaagagcugcuccaaggaggacacccagaagugcgugaacaccaagcuggagcagccccagagcauccucaucgagcacaaggggacgaucaucggcaagcagaacaacacgugcaccgcgaaggccuccugcuggcuggagagcgugaaguccuucuucuacggccugaagaacaugcucgggggcaucuucgggaacgucuucaucggcaucuucaccuuccugacccccuucauccugcucaucuucuucuucauguucggguggcgcauccuguucugcuucaagugcugccggcgcacccggggccuguucaaguaccgccaccugaaggacgacgaggagaccggcuaccggaagaucaucgagcgccucaacaacaagaaggggaagaaccgccugcuggacggcgagcggcucgccgaccgcaagaucgccgagcuguucagcaccaagacgcacaucggg

SEQ ID NO: 12439 - RNA, 1932 nt, Artificial Sequence
  derived and/or modified CDS sequence (opt1) from CCHFV(SPU 44/08)__KJ682805.1__Gc
uuccuggacagcaucgugaagggcaugaagaaccuccugaacuccaccagccuggagaccucccucagcaucgaggcccccuggggcgccaucaacguccaguccacguucaagccgaccgugagcgcggccaacaucgcccuguccuggagcuccguggagcaccgcgggaacaagauccuggucagcgggcgguccgagagcaucaugaagcucgaggagcgcaccggcaucuccugggaccuggggguggaggacgccagcgaguccaagcugcucaccgugagcgucauggaccugucccagauguacagccccguguucgaguaccuguccggcgaccgccagguggaggaguggcccaaggccacgugcaccggcgacugccccgagcggugcgggugcaccagcagcacgugccuccacaaggaguggccgcacucccggaacuggcgcugcaaccccaccuggugcuggggcgucgggaccggcugcacgugcugcgggcuggacgugaaggaccuguucaccgacuacauguucgugaaguggaaggucgacuacaucaagaccgaggcgaucgugugcguggagcucaccagccaggagcggcagugcucccugaucgaggccggcacccgcuucaaccugggccccgucaccaucacgcucagcgagccccggaacauccagcagaagcugccgcccgagaucgugacccugcacccccgcaucgaggagggguucuucgaccucaugcacauccagaaggugcuguccgccagcaccgucugcaagcugcaguccugcacccacggcgugcccggggaccuccagaucuaccacaucggcaaccugcugaagggcgacaaggugaacgggcaccucauccacaagaucgagccgcacuucaacacgagcuggauguccugggacggcugcgaccuggacuacuacugcaacaugggggacuggcccagcugcuccuacaccggcgucacccagcacaaccacgccgcguucgugaacaugcugaacaucgagaccgacuacacgaagaacuuccacuuccacagcaagcgggugaccgcccacggggacacgccccagcucgaccugaaggcccgccccaccuacggcgccggcgagaucaccguccugguggaggucgccgacauggagcuccacaccaagaagaucgagaucuccgggcugaaguucgcgagccugaccugcaccggcugcuacgccugcuccagcgggaucuccugcaaggugcggauccacguggacgagccggacgagcucacgguccacgucaagagcgaggaccccgacaucguggccgccuccagcagccugauggcccgcaagcuggaguucggcaccgacuccaccuucaaggcguucagcgccaugcccaagaccucccucugcuucuacaucguggagcgggaguacugcaagagcugcuccaaggaggacacgcagaagugcgugaacaccaagcuggagcagccccagagcauccugaucgagcacaaggggaccaucaucggcaagcagaacgacacgugcaccgccaaggccuccugcuggcucgagagcaucaaguccuucuucuacggccugaagaacaugcugagcgggaucuucggcaacguguucaucgggaucuuccucuuccuggccccguucaucaugcugauccucuucuucauguucggcuggcgcauccuguucugcuucaagugcugccggcgcacccgggggcuguucaaguaccgccaccugaaggacgacgaggagaucggcuaccggaagaucaucgagcgccucaacaacaagaagggcaagaacaagcugcuggacggggagcgccucgcggaccggaagaucgccgagcuguucuccaccaagacccacaucggc

SEQ ID NO: 12440 - RNA, 1932 nt, Artificial Sequence
  derived and/or modified CDS sequence (opt1) from CCHFV(SPU 383/87)__KJ682806.1__Gc
uuccuggacagcaucgugaagggcaugaagaaccuccugaacuccaccagccuggagaccucccucagcaucgaggcccccuggggcgccaucaacguccaguccacguucaagccgaccgugagcgcggccaacaucgcccuguccuggagcuccguggagcaccgcgggaacaagauccuggucagcgggcgguccgagagcaucaugaagcucgaggagcgcaccggcaucuccugggaccuggggguggaggacgccagcgaguccaagcugcucaccgugagcgucauggaccugucccagauguacagccccguguucgaguaccuguccggcgaccgccagguggaggaguggcccaaggccacgugcaccggcgacugccccgagcggugcgggugcaccagcagcacgugccuccacaaggaguggccgcacucccggaacuggcgcugcaaccccaccuggugcuggggcgucgggaccggcugcacgugcugcgggcuggacgugaaggaccuguucaccgacuacauguucgugaaguggaaggucgacuacaucaagaccgaggcgaucgugugcguggagcucaccagccaggagcggcagugcucccugaucgaggccggcacccgcuucaaccugggccccgucaccaucacgcucagcgagccccggaacauccagcagaagcugccgcccgagaucgugacccugcacccccgcaucgaggagggguucuucgaccucaugcacauccagaaggugcuguccgccagcaccgucugcaagcugcaguccugcacccacggcgugcccggggaccuccagaucuaccacaucggcaaccugcugaagggcgacaaggugaacgggcaccucauccacaagaucgagccgcacuucaacacgagcuggauguccugggacggcugcgaccuggacuacuacugcaacaugggggacuggcccagcugcuccuacaccggcgucacccagcacaaccacgccgcguucgugaacaugcugaacaucgagaccgacuacacgaagaacuuccacuuccacagcaagcgggugaccgcccacggggacacgccccagcucgaccugaaggcccgccccaccuacggcgccggcgagaucaccguccugguggaggucgccgacauggagcuccacaccaagaagaucgagaucuccgggcugaaguucgcgagccugaccugcaccggcugcuacgccugcuccagcgggaucuccugcaaggugcggauccacguggacgagccggacgagcucacgguccacgucaagagcgaggaccccgacaucguggccgccuccagcagccugauggcccgcaagcuggaguucggcaccgacuccaccuucaaggcguucagcgccaugcccaagaccucccucugcuucuacaucguggagcgggaguacugcaagagcugcuccaaggaggacacgcagaagugcgugaacaccaagcuggagcagccccagagcauccugaucgagcacaaggggaccaucuucggcaagcagaacgacacgugcaccgccaaggccuccugcuggcucgagagcgugaaguccuucuucuacggccugaagaacaugcugagcgggaucuucggcaacgucuucaucgggguguuccucuuccuggccccguucaucaugcugauccucuucuucauguucggcuggcgcauccuguucugcuucaagugcugccggcgcacccgggggcuguucaaguaccgccaccugaaggacgacgaggagaucggcuaccggaagaucaucgagcgccucaacaacaagaagggcaagaacaagcugcuggacggggagcgccucgcggaccggaagaucgccgagcuguucuccaccaagacccacaucggc

SEQ ID NO: 12441 - RNA, 1932 nt, Artificial Sequence
  derived and/or modified CDS sequence (opt1) from CCHFV(SPU 130/89)__KJ682807.1__Gc
agccuggacuccaucgugaagggcaugaagaaccuccugaacagcaccucccuggagaccagccucuccaucgaggcccccuggggcgccaucaacguccagagcacguucaagccgaccguguccgcggccaacaucgcccugagcugguccagcguggagcaccgcgggaacaagauccuggucuccgggcggagcgaguccaucaugaagcucgaggagcgcaccggcaucagcugggaccuggggguggaggacgccuccgagagcaagcugcucaccguguccgucauggaccugagccagauguacucccccguguucgaguaccugagcggcgaccgccagguggaggaguggcccaaggccacgugcaccggcgacugccccgagcggugcgggugcaccagcuccacgugccuccacaaggaguggccgcacagccggaacuggcgcugcaaccccaccuggugcuggggcgucgggaccggcugcacgugcugcgggcuggacgugaaggaccuguucaccgacuacauguucgugaaguggaaggucgacuacaucaagaccgaggcgaucgugugcguggagcucaccucccaggagcggcagugcagccugaucgaggccggcacccgcuucaaccugggccccgucaccaucacgcucuccgagccccggaacauccagcagaagcugccgcccgagaucgugacccugcacccccgcaucgaggagggguucuucgaccucaugcacauccagaaggugcugagcgccuccaccgucugcaagcugcagagcugcacccacggcgugcccggggaccuccagaucuaccacaucggcaaccugcugaagggcgacaaggugaacgggcaccucauccacaagaucgagccgcacuucaacacguccuggaugagcugggacggcugcgaccuggacuacuacugcaacaugggggacuggcccuccugcagcuacaccggcgucacccagcacaaccacgccgcguucgugaacaugcugaacaucgagaccgacuacacgaagaacuuccacuuccacuccaagcgggugaccgcccacggggacacgccccagcucgaccugaaggcccgccccaccuacggcgccggcgagaucaccguccugguggaggucgccgacauggagcuccacaccaagaagguggagaucagcgggcugaaguucgcgucccugaccugcaccggcugcuacgccugcagcuccgggaucagcugcaaggugcggauccacgucgacgagccggacgagcucacggugcacgugaaguccgaggaccccgacaucgucgccgccagcagcucccugauggcccgcaagcuggaguucggcaccgacagcaccuucaaggcguucuccgccaugcccaagaccagccucugcuucuacaucguggagcgggagcacugcaaguccugcagcaaggaggacacgcagcgcugcgugaacaccaagcuggagcagccccaguccauccugaucgagcacaaggggaccaucaucggcaagcagaacgacacgugcaccgccaaggccagcugcuggcucgaguccaucaagagcuucuucuacggccugaagaacaugcuguccgggaucuucggcaacgucuucaucgggguguuccucuuccuggccccguucaucauccugauccucuucuucauguucggcuggcggauccuguucugcuucaagugcugccgccggacccgcgggcugcugaaguaccggcaccucaaggacgacgaggagaucggcuaccgcaagaucaucgagcgccugaacaacaagaagggcaagaacaagcugcucgacggggagcggcuggcggaccgcaagaucgccgagcuguucagcaccaagacccacaucggc

SEQ ID NO: 12442 - RNA, 1932 nt, Artificial Sequence
  derived and/or modified CDS sequence (opt1) from CCHFV(SPU 497/88)__KJ682808.1__Gc
uuccucgacagcaucgugaagggcaugcgcaaccuccugaacuccaccagccuggagaccucccucagcaucgaggcccccuggggcgccaucaacguccaguccacguucaagccgaccgugagcgcggccaacaucgcccuguccuggagcuccguggagcaccgggggaacaagauccuggucagcgggcgcuccgagagcaucaugaagcucgaggagcggaccggcaucuccugggaccuggggguggaggacgccagcgaguccaagcugcucaccgugagcgucauggaccugucccagauguacagccccguguucgaguaccuguccggcgaccgccagguggaggaguggcccaaggccacgugcaccggcgacugccccgagcggugcgggugcaccagcagcacgugccuccacaaggaguggccgcacucccgcaacuggcggugcaaccccaccuggugcuggggcgucgggaccggcugcacgugcugcgggcuggacgugaaggaccuguucaccgacuacauguucgugaaguggaaggucgacuacaucaagaccgaggcgaucgugugcguggagcucaccagccaggagcgccagugcucccugaucgaggccggcacccgguucaaccugggccccgucaccaucacgcucagcgagccccgcaacauccagcagaagcugccgcccgagaucgugacccugcacccccggaucgaggagggguucuucgaccucaugcacauccagaaggugcuguccgccagcaccgucugcaagcugcaguccugcacccacggcgugcccggggaccuccagaucuaccacaucggcaaccugcugaagggcgacaaggugaacgggcaccucauccacaagaucgagccgcacuucaacacgagcuggauguccugggacggcugcgaccuggacuacuacugcaacaugggggacuggcccagcugcuccuacaccggcgucacccagcacaaccacgccgcguucgugaacaugcugaacaucgagaccgacuacacgaagaacuuccacuuccacagcaagcgcgugaccgcccacggggacacgccccagcucgaccugaaggcccggcccaccuacggcgccggcgagaucaccguccugguggaggucgccgacauggagcuccacaccaagaagaucgagaucuccgggcugaaguucgcgagccugaccugcaccggcugcuacgccugcuccagcgggaucuccugcaaggugcgcauccacguggacgagccggacgagcucacgguccacgucaagagcgaggaccccgacaucguggccgccuccagcagccugauggcccggaagcuggaguucggcaccgacuccaccuucaaggcguucagcgccaugcccaagaccucccucugcuucuacaucguggagcgcgaguacugcaagagcugcuccaaggaggacacgcagaagugcgugaacaccaagcuggagcagccccagagcauccugaucgagcacaaggggaccaucaucggcaagcagaacgacacgugcaccgcccgggccuccugcuggcucgagagcaucaaguccuucuucuacggccugaagaacaugcugagcgggaucuucggcaacguguucaucgggaucuuccucuucuucgccccguucaucaugcugauccuguucuucauguucggcuggcgcauccucuucugcuucaagugcugccggcgcacccgggggcuguucaaguaccgccaccugaaggacgacgaggaggucggcuaccgcaagaucaucgagcggcugaacaacaagaagggcaagaacaagcuccuggacggggagcgccuggcggaccggaagaucgccgagcuguucuccaccaagacccacaucggc

SEQ ID NO: 12443 - RNA, 1932 nt, Artificial Sequence
  derived and/or modified CDS sequence (opt1) from CCHFV(SPU 18/88)__KJ682810.1__Gc
uuccuggacagcaucgugaagggcaagaagaaccuccugaacuccaccagccuggagaccucccucagcaucgaggcccccuggggcgccaucaacguccaguccacguucaagccgaccgugagcgcggccaacaucgcccuguccuggagcuccguggagcaccgcgggaacaagauccuggucagcgggcgguccgagagcaucaugaagcucgaggagcgcaccggcaucuccugggaccuggggguggaggacgccagcgaguccaagcugcucaccgugagcgucauggaccugucccagauguacagccccguguucgaguaccuguccggcgaccgccagguggaggaguggcccaaggccacgugcaccggcgacugccccgagcggugcgggugcaccagcagcacgugccuccacaaggaguggccgcacucccggaacuggcgcugcaaccccaccuggugcuggggcgucgggaccggcugcacgugcugcgggcuggacgugaaggaccuguucaccgacuacauguucgugaaguggaaggucgacuacaucaagaccgaggcgaucgugugcguggagcucaccagccaggagcggcagugcucccugaucgaggccggcacccgcuucaaccugggccccgucaccaucacgcucagcgagccccggaacauccagcagaagcugccgcccgagaucgugacccugcacccccgcaucgaggagggguucuucgaccucaugcacauccagaaggugcuguccgccagcaccgucugcaagcugcaguccugcacccacggcgugcccggggaccuccagaucuaccacaucggcaaccugcugaagggcgacaaggugaacgggcaccucauccacaagaucgagccgcacuucaacacgagcuggauguccugggacggcugcgaccuggacuacuacugcaacaugggggacuggcccagcugcuccuacaccggcgucacccagcacaaccacgccgcguucgugaacaugcugaacaucgagaccgacuacacgaagaacuuccacuuccacagcaagcgggugaccgcccacggggacacgccccagcucgaccugaaggcccgccccaccuacggcgccggcgagaucaccguccugguggaggucgccgacauggagcuccacaccaagaagaucgagaucuccgggcugaaguucgcgagccugaccugcaccggcugcuacgccugcuccagcgggaucuccugcaaggugcggauccacguggacgagccggacgagcucacgguccacgucaagagcgaggaccccgacaucguggccgccuccagcagccugauggcccgcaagcuggaguucggcaccgacuccaccuucaaggcguucagcgccaugcccaagaccucccucugcuucuacaucguggagcgggaguacugcaagagcugcuccaaggaggacacgcagaagugcgugaacaccaagcuggagcagccccagagcauccugaucgagcacaaggggaccaucaucggcaagcagaacgacacgugcaccggcaaggccgggugcuggcucgaguccaucaagagcuucuucuacggccugaagaacaugcuguccgggaucuucggcaacguguucaucgggaucuuccucuuccuggccccguucaucaugcugauccucuucuucauguucggcuggcgcauccuguucugcuucaagugcugccggcgcacccggggccuguucaaguaccgccaccugaaggacgacgaggagaucggguaccggaagaucaucgagcgccucaagaacaagaagggcaagaacaagcugcuggacggggagcgccucgccgaccggaagaucgcggagcuguucagcaccaagacccacaucggc

SEQ ID NO: 12444 - RNA, 1932 nt, Artificial Sequence
  derived and/or modified CDS sequence (opt1) from CCHFV(SPU 431/85)__KJ682812.1__Gc
uuccuggacagcaucgugaagggccgcaagaaccuccugaacuccaccagccuggagaccucccucagcaucgaggcccccuggggcgccaucaacguccaguccacguucaagccgaccgugagcgcggccaacaucgcccuguccuggagcuccguggagcaccgggggaacaagauccuggucagcgggcgcuccgagagcaucaugaagcucgaggagcggaccggcaucuccugggaccuggggguggaggacgccagcgaguccaagcugcucaccgugagcgucauggaccugucccagauguacagccccguguucgaguaccuguccggcgaccgccagguggaggaguggcccaaggccacgugcaccggcgacugccccgagcggugcgggugcaccagcagcacgugccuccacaaggaguggccgcacucccgcaacuggcggugcaaccccaccuggugcuggggcgucgggaccggcugcacgugcugcgggcuggacgugaaggaccuguucaccgacuacauguucgugaaguggaaggucgaguacaucaagaccgaggcgaucgugugcguggagcucaccagccaggagcgccagugcucccugaucgaggccggcacccgguucaaccugggccccgucaccaucacgcucagcgagccccgcaacauccagcagaagcugccgcccgagaucaucacccugcacccccggaucgaggagggguucuucgaccucaugcacgugcagcgcgugcuguccgccagcaccgucugcaagcugcaguccugcacccacggcgugcccggggaccuccagguguaccacaucggcaaccugcugaagggcgacaaggucaacgggcaccucauccacaagaucgagccgcacuucaacacgagcuggauguccugggacggcugcgaccuggacuacuacugcaacaugggggacuggcccagcugcaccuacaccggcgugacccagcacaaccacgccgcguucgugaaccugcucaacaucgagacggacuacaccaagaacuuccacuuccacuccaagcgggucaccgcccacggggacacgccccagcuggaccugaaggcccgccccaccuacggcgccggcgaggugaccguccucguggagguggccgacauggagcugcacaccaagaagaucgagaucagcgggcugaaguucgcgucccugaccugcacgggcugcuacgccugcagcuccgggaucagcugcaaggucaagauccacguggacgagccggacgagcucaccgugcacgucaaguccgaggaccccgacaucguggccgccggcagcucccugauggcccggaagcucgaguucggggcggacagcaccuucaaggccuucagcgccaugcccaagaccucccugugcuucuacaucguggagcgcgaguacugcaagagcugcucccgggaggacacgcgcaagugcgucaacaccaagcuggaccggccccagagcauccucaucgagcacaagggcaccaucaucggcaagcagaacaacacgugcaccgccaaggccuccugcuggcuggagagcgugaaguccuucuucuacgggcugaagaacaugcucagcggcaucuucgggaacguguucaucggcaucuuccuguucaucgcgccguucguccugcucauccuguucuucauguucggguggcgcauccuguucugcuucaagugcugccggcgcacccgcggccuguucaaguaccggcaccucaaggacgacgaggagaccggcuaccgcaagaucaucgagcggcugaacaacaagaaggggaagaacaagcugcucgacggcgagcgccuggccgaccggaagaucgccgagcuguucuccaccaagagccacaucggg

SEQ ID NO: 12445 - RNA, 1932 nt, Artificial Sequence
  derived and/or modified CDS sequence (opt1) from CCHFV(SPU 48/90)__KJ682813.1__Gc
uuccgcgacagcaucgugaagggcaugaagaaccugcucaacuccaccagccuggagaccucccugagcaucgaggcccccuggggcgccaucaacguccaguccacguacaagccgaccgugagcaccgcgaacaucgcccucuccuggagcuccguggagcaccgggggaacaagauccuggucagcgggcgcuccgagagcaucaugaagcuggaggagcggaccggcaucuccugggaccucgggguggaggacgccagcgaguccaagcugcugacggugagcgucauggaccucucccagauguacagccccguguucgaguaccuguccggcgaccgccagguggaggaguggcccaaggcgaccugcaccggcgacugccccgagcggugcgggugcaccagcagcacgugccugcacaaggaguggccgcacucccgcaacuggcggugcaaccccaccuggugcuggggcgucgggaccggcugcacgugcugcgggcucgacgugaaggaccuguucaccgacuacauguucgugaaguggaaggucgaguacaucaagaccgaggccaucgugugcguggagcugaccagccaggagcgccagugcucccucaucgaggccggcacccgguucaaccugggccccgucacgaucacccugagcgagccccgcaacauccagcagaagcucccgcccgagaucaucacccugcacccccggaucgaggagggguucuucgaccugaugcacgugcagaaggugcucuccgccagcaccgucugcaagcugcaguccugcacgcacggcgugcccggggaccuccagguguaccacaucggcaaccuccugaagggcgacaaggucaacgggcaccugauccacaagaucgagccgcacuucaacaccagcuggauguccugggacggcugcgaccucgacuacuacugcaacaugggggacuggcccagcugcaccuacaccggcgugacgcagcacaaccgcgccuccuucgugaaccugcugaacaucgagaccgacuacaccaagaacuuccacuuccacagcaagcgggucaccgcccacggggacacgccccagcucgaccugaaggcgcgccccaccuacggcgccggcgagaucaccgugcuggucgagguggccgacauggagcuccacaccaagaagaucgagaucuccgggcugaaguucgccagccugacgugcaccggcugcuacgccugcuccagcgggaucuccugcaaggugcggauccacgucgacgagccggacgagcucaccgugcacgucaagagcgacgaccccgacgugguggcggccuccagcagccugauggcccgcaagcuggaguucggcaccgacuccacguucaaggccuucagcgccaugcccaagaccucccucugcuucuacaucguggagaaggaguacugcaagagcugcuccgaggaggacaccaagaagugcgucaacaccaagcuggagcagccccagagcauccugaucgagcacaaggggaccaucaucggcaagcagaacuccacgugcaccgcgaaggugagcugcuggcucgaguccgccaagagcuucuucuacggccugaaggacaugcuguccgggaucuucggcaacguguucaucgggaucuuccucuuccuggccccguucauccugcucauccuguucuucauguucggcuggcggauccugcugugcuucaagugcugccgccggacccgcggccucuucaaguaccggcaccugaaggacgacgaggagaccggguaccgccgcaucaucgagcggcugaacaacaagaagggcaagaacaagcuccuggacggggagcgccuggccgaccggcgcaucgccgagcuguucagcacgaagacccacaucggc

SEQ ID NO: 12446 - RNA, 1932 nt, Artificial Sequence
  derived and/or modified CDS sequence (opt1) from CCHFV(SPU 187/90)__KJ682814.1__Gc
uuccucgacagcaucgugaagggcaugaagaaccuccugaacuccaccagccuggagaccucccucagcaucgaggcccccuggggcgccaucaacgugcaguccacguacaagccgaccgugagcaccgcgaacaucgcccuguccuggagcuccguggagcaccgcgggaacaagauccuggucagcgggcgguccgagagcaucaugaagcucgaggagcgcaccggcaucuccugggaccuggggguggaggacgccagcgaguccaagcugcucacggugagcgucauggaccugucccagauguacagccccguguucgaguaccuguccggcgaccgccagguggaggaguggcccaaggcgaccugcaccggcgacugccccgagcggugcgggugcaccagcagcacgugccuccacaaggaguggccgcacucccggaacuggcgcugcaaccccaccuggugcuggggcgucgggaccggcugcacgugcugcgggcuggacgugaaggaccuguucaccgacuacauguucgugaaguggaaggucgaguacaucaagaccgaggccaucgugugcguggagcucaccagccaggagcggcagugcucccugaucgaggccggcacccgcuucaaccugggccccgucacgaucacccucagcgagccccggaacauccagcagaagcugccgcccgagaucaucacccugcacccccgcaucgaggagggguucuucgaccucaugcacgugcagaaggugcuguccgccagcaccgucugcaagcugcaguccugcacgcacggcgugcccggggaccuccagguguaccacaucggcaaccugcugaagggcgacaaggucaacgggcaccucauccacaagaucgagccgcacuucaacaccagcuggauguccugggacggcugcgaccuggacuacuacugcaacaugggggacuggcccagcugcaccuacaccggcgugacgcagcacaaccacgccuccuucgugaaccugcucaacaucgagaccgacuacaccaagaacuuccacuuccacagcaagcgggucaccgcccacggggacacgccccagcuggaccugaaggcgcgccccaccuacggcgccggcgagaucaccgugcucgucgagguggccgacauggagcugcacaccaagaagaucgagaucuccgggcugaaguucgccagccucacgugcaccggcugcuacgccugcuccagcgggaucuccugcaaggugcggauccacgucgacgagccggacgagcugaccgugcacgucaagagcgacgaccccgacgugguggcggccuccagcagccugauggcccgcaagcucgaguucggcaccgacuccaucuucaaggccuucagcgccaugcccaagacgucccugugcuucuacaucguggagcgggagcacugcaagagcugcuccgaggaggacaccaagaagugcgucaacaccaagcuggagcagccccagagcauccucaucgagcacaaggggaccaucaucggcaagcagaacuccacgugcaccgcgaagaccagcugcuggcuggaguccgucaagagcuucuucuacggccugaagaacaugcucuccgggaucuucggcaacguguucaucgggaucuuccuguuccuggccccguucauccuccugauccuguucuucauguucggcuggcgcauccuguucugcuucaagugcugccggcgcacccggggccucuucaaguaccgccaccugaaggacgacgaggagaccggguaccggcgcaucaucgagcgccugaacaacaagaagggcaagaacaagcuccuggacggggagcggcuggccgaccgccggaucgccgagcuguucagcacgaagacccacaucggc

SEQ ID NO: 12447 - RNA, 1932 nt, Artificial Sequence
  derived and/or modified CDS sequence (opt1) from CCHFV(Haskovo-V46/13)__KR092379.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcugaccucccaggagcggcagugcagccucaucgaggcgggcacgcgcuucaaccugggccccgugaccaucacccuguccgagccccggaacauccagcagaagcucccgcccgagaucaucacccugcaccccaagaucgaggagggguucuucgaccugaugcacgugcagaagguccucagcgccuccacggugugcaagcugcagagcugcacccacggcauccccggggaccugcagguguaccacaucggcaaccuccugaagggcgaccgcgucaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgugaaccugcugaacaucgagaccgacuacaccaagacguuccacuuccacagcaagcgggucaccgcgcacggggacaccccccagcucgaccugaaggcccgccccaccuacggcgccggcgagaucacggugcuggucgagguggccgacauggagcuccacaccaagaagguggagaucuccgggcugaaguucgccagccugaccugcaccggcugcuacgcgugcuccagcgggaucuccugcaagguccggauccacguggacgagccggacgagcucacggugcacgucaagagcuccgaccccgacgugguggccgccggcaccagccugauggcccgcaagcuggaguucgggaccgacuccaccuucaaggccuucagcgcgaugcccaagaccagccucugcuucuacaucgucgagcgggaguacugcaaguccugcagcgaggacgacacgcagaagugcguggacaccaagcuggagcagccccaguccauccugaucgagcacaagggcaccaucaucggcaagcagaacgacaccugcacggcccgcgccagcugcuggcucgaguccgugaagagcuucuucuacgggcugaagaacaugcugggcuccgucuucgggaacuuccucaucggcauccugcuguuccucgccccguucgugcugcuggugcuguucuucauguucggguggaagauccucuucugcuucaagugcugccggcgcacccggggccuguucaaguaccgccaccugaaggacgacgaggagaccggcuaccggcgcaucaucgagcgccucaacagcaagaaggggaagaaccggcugcuggacggcgagcgccucgccgaccggaagaucgcggagcuguucuccaccaagacgcacaucggg

SEQ ID NO: 12448 - RNA, 1932 nt, Artificial Sequence
  derived and/or modified CDS sequence (opt1) from CCHFV(24-R-2012)__KR814856.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcugaccucccaggagcggcagugcagccucaucgaggcgggcacgcgcuucaaccugggccccgugaccaucacccuguccgagccccggaacauccagcagaagcucccgcccgagaucaucacccugcaccccaagguggaggagggguucuucgaccugaugcacguccagaaggugcucagcgccuccacggugugcaagcugcagagcugcacccacggcauccccggggaccugcaggucuaccacaucggcaaccuccugaagggcgaccgcgugaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgucaaccugcugaacaucgagaccgacuacaccaagacguuccacuuccacagcaagcgggugaccgcgcacggggacaccccccagcucgaccugaaggcccgccccaccuacggcgccggcgagaucacgguccugguggagguggccgacauggagcuccacaccaagaaggucgagaucuccgggcugaaguucgccagccuggcgugcaccggcugcuacgccugcuccagcgggaucuccugcaaggugcggauccacguggacgagccggacgagcucaccguccacgugaagagcaacgaccccgacguggucgccgccuccacgagccugauggcccgcaagcuggaguucggcaccgacuccaccuucaaggcguucagcgccaugcccaagaccagccucugcuucuacaucguggagcgggaguacugcaaguccugcagcgaggaggacacccagaagugcguggacacgaagcuggagcagccccaguccauccugaucgagcacaaggggaccaucaucggcaagcagaacgacaccugcaccgccaaggccagcugcuggcucgaguccgucaagagcuucuucuacggccugaagaacaugcugggguccguguucggcaacuucuucaucgggauccuccuguuccuggccccguucgugcuccugguccuguucuucauguucggcuggaagauccuguucugcuucaagugcugccgccggacgcgcgggcuccugaaguaccggcugcucaaggacgacgaggagaccggcuaccgccggaucaucgagcgccugaacaacaagaagggcaagaaccgccugcucgacggggagcggcuggcggaccgcaagaucgccgagcuguucagcaccaagacccacaucggc

SEQ ID NO: 12449 - RNA, 1932 nt, Artificial Sequence
  derived and/or modified CDS sequence (opt1) from CCHFV(36-ST-2014)__KR814857.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucaucaaguggaaggucgaguacaucaagaccgaggccaucgugugcguggagcugaccucccaggagcggcagugcagccucaucgaggcgggcacgcgcuucaaccugggccccgucaccaucacccuguccgagccccggaacauccagcagaagcucccgcccgagaucaucacccugcaccccaagaucgaggagggguucuucgaccugaugcacgugcagaaggugcucagcgccuccacggucugcaagcugcagagcugcacccacggcauccccggggaccugcagaucuaccacaucggcaaccuccugaagggcgaccgccugaacgggcaccucauccacaagaucgagccgcacuucaacaccuccuggaugagcugggacggcugcgaccuggacuacuacugcaacaugggggacuggcccuccugcaccuacacgggcgugacccagcacaaccacgccgccuucgugaaccugcucaacaucgagaccgacuacaccaagacguuccacuuccacagcaagcgggucaccgcgcacggggacaccccccagcuggaccugaaggcccgccccaccuacggcgccggcgagaucacggugcucguggaggucgccgacauggagcugcacaccaagaagguggagaucuccgggcugaaguucgccagccucgcgugcaccggcugcuacgccugcuccagcgggaucuccugcaagguccggauccacguggacgagccggacgagcugaccgugcacgucaagagcuccgaccccgacgugguggccgccagcacgucccugauggcccgcaagcucgaguucggcaccgacagcaccuucaaggcguucagcgccaugcccaagaccucccugugcuucuacaucgucgagcgggaguacugcaagagcugcuccgaggacgacaccaagaagugcguggacacgaagcuggaccagccccagagcauccucaucgagcacaaggggaccaucaucggcaagcagaacgacaccugcaccgccaaggccuccugcuggcuggagagcgugaaguccuucuucuacggccugaagaacaugcucgggagcgucuucggcaacuucuucguggggauccugcuguuccucgccccguucgugcugcugguccuguucuucaugugcggcuggaaguuccucuucugcuucaagugcugccgccggacgcgcgggcuguucaaguaccggcaccugaaggacgacgaggagaccggcuaccgccggaucaucgagcgccucaacuccaagaagggcaagaaccgccugcuggacggggagcggcucgcggaccgcaagaucgccgagcuguucagcaccaagucccacaucggc

SEQ ID NO: 12450 - RNA, 1932 nt, Artificial Sequence
  derived and/or modified CDS sequence (opt1) from CCHFV(37-R-2013)__KR814858.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggacgacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcugaccucccaggagcggcagugcagccucaucgaggcgggcacgcgcuucaaccugggccccgugaccaucacccuguccgagccccggaacauccagcagaagcucccgcccgagaucaucacccugcaccccaagguggaggagggguucuucgaccugaugcacguccagaaggugcucagcgccuccacggugugcaagcugcagagcugcacccacggcauccccggggaccugcaggucuaccacaucggcaaccuccugaagggcgaccgcgugaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgucaaccugcugaacaucgagaccgacuacaccaagacguuccacuuccacagcaagcgggugaccgcgcacggggacaccccccagcucgaccugaaggcccgccccaccuacggcgccggcgagaucacgguccugguggagguggccgacauggagcuccacaccaagaaggucgagaucuccgggcugaaguucgccagccuggcgugcaccggcugcuacgccugcuccagcgggaucuccugcaaggugcggauccacguggacgagccggacgagcucaccguccacgugaagagcaacgaccccgacguggucgccgccuccacgagccugauggcccgcaagcuggaguucggcaccgacuccaccuucaaggcguucagcgccaugcccaagaccagccucugcuucuacaucguggagcgggaguacugcaaguccugcagcgaggaggacacccagaagugcguggacacgaagcuggagcagccccaguccauccugaucgagcacaaggggaccaucaucggcaagcagaacgucaccugcaccgccaaggccagcugcuggcucgaguccgugaagagcuucuucuacggccugaagaacaugcugggguccguguucggcaacuucuucaucgggauccuccuguuccuggccccguucguccuccuggugcuguucuucauguucggcuggaagauccuguucugcuucaagugcugccgccggacgcgcgggcuccugaaguaccggcugcucaaggacgacgaggagaccggcuaccgccggaucaucgagcgccugaacaacaagaagggcaagaaccgccugcucgacggggagcggcuggcggaccgcaagaucgccgagcuguucagcaccaagacccacaucggc

SEQ ID NO: 12451 - RNA, 1932 nt, Artificial Sequence
  derived and/or modified CDS sequence (opt1) from CCHFV(44-ST-2010)__KR814859.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucaucaaguggaaggucgaguacaucaagaccgaggccaucgugugcguggagcugaccucccaggagcggcagugcagccucaucgaggcgggcacgcgcuucaaccugggccccgucaccaucacccuguccgagccccggaacauccagcagaagcucccgcccgagaucaucacccugcaccccaagaucgaggagggguucuucgaccugaugcacgugcagaaggugcucagcgccuccacggucugcaagcugcagagcugcacccacggcauccccggggaccugcagaucuaccacaucggcaaccuccugaagggcgaccgccugaacgggcaccucauccacaagaucgagccgcacuucaacaccuccuggaugagcugggacggcugcgaccuggacuacuacugcaacaugggggacuggcccuccugcaccuacacgggcgugacccagcacaaccacgccgccuucgugaaccugcucaacaucgagaccgacuacaccaagacguuccacuuccacagcaagcgggucaccgcgcacggggacaccccccagcuggaccugaaggcccgccccaccuacggcgccggcgagaucacggugcucguggaggucgccgacauggagcugcacaccaagaagguggagaucuccgggcugaaguucgccagccucgcgugcaccggcugcuacgccugcuccagcgggaucuccugcaagguccggauccacguggacgagccggacgagcugaccgugcacgucaagagcuccgaccccgacgugguggccgccagcacgucccugauggcccgcaagcucgaguucggcaccgacagcaccuucaaggcguucagcgccaugcccaagaccucccugugcuucuacaucgucgagcgggaguacugcaagagcugcuccgaggacgacaccaagaagugcguggacacgaagcuggaccagccccagagcauccucaucgagcacaaggggaccaucaucggcaagcagaacgacaccugcaccgccaaggccuccugcuggcuggagagcgugaaguccuucuucuacggccugaagaacaugcucgggagcgucuucggcaacuucuucguggggauccugcuguuccucgccccguucgugcugcugguccuguucuucaugugcggcuggaagauccucuucugcuucaagugcugccgccggacgcgcgggcuguucaaguaccggcaccugaaggacgacgaggagaccggcuaccgccggaucaucgagcgccucaacuccaagaagggcaagaaccgccugcuggacggggagcggcucgcggaccgcaagaucgccgagcuguucagcaccaagucccacaucggc

SEQ ID NO: 12452 - RNA, 1932 nt, Artificial Sequence
  derived and/or modified CDS sequence (opt1) from CCHFV(46-ST-2012)__KR814860.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcugaccucccaggagcggcagugcagccucaucgaggcgggcacgcgcuucaaccugggccccgugaccaucacccuguccgagccccggaacauccagcagaagcucccgcccgagaucaucacccugcaccccaagguggaggagggguucuucgaccugaugcacguccagaaggugcucagcgccuccacggugugcaagcugcagagcugcacccacggcauccccggggaccugcaggucuaccacaucggcaaccuccugaagggcgaccgcaucaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgugaaccugcugaacaucgagaccgacuacaccaagacguuccacuuccacagcaagcgggucaccgcgcacggggacaccccccagcucgaccugaaggcccgccccaccuacggcgccggcgagaucacggugcuggucgagguggccgacauggagcuccacaccaagaagguggagaucuccgggcugaaguucgccagccuggcgugcaccggcugcuacgccugcuccagcgggaucuccugcaagguccggauccacguggacgagccggacgagcucaccgugcacgucaagagcuccgaccccgacgugguggccgccagcacgucccugauggcccgcaagcuggaguucggcaccgacagcaccuucaaggcguucagcgccaugcccaagaccucccucugcuucuacaucgucgagcgggaguacugcaagagcugcuccgaggaggacacccagaagugcguggacacgcgccuggagcagccccagagcauccugaucgagcacaaggggaccaucaucggcaagcagaacgacaccugcaccgccaaggccuccugcuggcucgagagcgugaaguccuucuucuacggccugaagaacaugcuggggagcgucuucggcaacuucuucaucgggauccuccuguuccuggccccguucgugcuccuggugcuguucuucauguucggcuggaagauccuguucugcuucaagugcugccggcgcacgcgggggcuccugaaguaccgccaccugaaggacgacgaggagaccggcuaccggcgcaucaucgagcgccucaacaacaagaagggcaagaaccggcugcuggacggggagcgccucgcggaccggaagaucgccgagcuguucuccaccaagacccacaucggc

SEQ ID NO: 12453 - RNA, 1932 nt, Artificial Sequence
  derived and/or modified CDS sequence (opt1) from CCHFV(47-ST-2013)__KR814861.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgagugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucaucaaguggaaggucgaguacaucaagaccgaggccaucgugugcguggagcugaccucccaggagcggcagugcagccucaucgaggcgggcacgcgcuucaaccugggccccgucaccaucacccuguccgagccccggaacauccagcagaagcucccgcccgagaucaucacccugcaccccaagaucgaggagggguucuucgaccugaugcacgugcagaaggugcucagcgccuccacggucugcaagcugcagagcugcacccacggcauccccggggaccugcagaucuaccacaucggcaaccuccugaagggcgaccgcgugaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgucaaccugcugaacaucgagaccgacuacaccaagacguuccacuuccacagcaagcgggugaccgcgcacggggacaccccccagcucgaccugaaggcccgccccaccuacggcgccggcgagaucacggugcuggucgagguggccgacauggagcuccacaccaagaaggucgagguguccgggcugaaguucgccagccuggcgugcaccggcugcuacgccugcuccagcgggaucuccugcaaggugcggauccacgucgacgagccggacgagcucaccgugcacgugaagagcuccgaccccgacgucguggccgccagcacgucccugauggcccgcaagcuggaguucggcaccgacagcaccuucaaggcguucagcgccaugcccaagaccucccucugcuucuacaucguggagcgggaguacugcaagagcugcuccgaggacgacaccaagaagugcgucgacacgaagcuggagcagccccagagcauccugaucgagcacaaggggaccaucaucggcaagcagaacgacaccugcaccgccaaggccuccugcuggcucgagagcgugaaguccuucuucuacggccugaagaacaugcuggggagcguguucggcaacuucuucgucgggauccuccuguuccuggccccguucgugcuccuggugcuguucuucauguucggcuggaagauccuguucugcuucaagugcugccgccggacgcgcgggcucuucaaguaccggcaccugaaggacgacgaggagaccggcuaccgccggaucaucgagcgccugaacuccaagaagggcaagaaccgccuccuggacggggagcggcuggcggaccgcaagaucgccgagcucuucagcaccaagacccacaucggc

SEQ ID NO: 12454 - RNA, 1932 nt, Artificial Sequence
  derived and/or modified CDS sequence (opt1) from CCHFV(52-R-2014)__KR814862.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggacgacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcugaccucccaggagcggcagugcagccucaucgaggcgggcacgcgcuucaaccugggccccgugaccaucacccuguccgagccccggaacauccagcagaagcucccgcccgagaucaucacccugcaccccaagguggaggagggguucuucgaccugaugcacguccagaaggugcucagcgccuccacggugugcaagcugcagagcugcacccacggcauccccggggaccugcaggucuaccacaucggcaaccuccugaagggcgaccgcgugaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgucaaccugcugaacaucgagaccgacuacaccaagacguuccacuuccacagcaagcgggugaccgcgcacggggacaccccccagcucgaccugaaggcccgccccaccuacggcgccggcgagaucacgguccugguggagguggccgacauggagcuccacaccaagaaggucgagaucuccgggcugaaguucgccagccuggcgugcaccggcugcuacgccugcuccagcgggaucuccugcaaggugcggauccacguggacgagccggacgagcucaccguccacgugaagagcaacgaccccgacguggucgccgccuccacgagccugauggcccgcaagcuggaguucggcaccgacuccaccuucaaggcguucagcgccaugcccaagaccagccucugcuucuacaucguggagcgggaguacugcaaguccugcagcgaggaggacacccagaagugcguggacacgaagcuggagcagccccaguccauccugaucgagcacaaggggaccaucaucggcaagcagaacgacaccugcaccgccaaggccggcugcuggcucgagagcgucaaguccuucuucuacgggcugaagaacaugcugggcagcguguucgggaacuucuucaucggcauccuccuguuccuggccccguucgugcuccugguccuguucuucauguucggguggaagauccuguucugcuucaagugcugccgccggacgcgcggccuccugaaguaccggcugcucaaggacgacgaggagaccggcuaccgccggaucaucgagcgccugaacaacaagaaggggaagaaccgccugcucgacggcgagcggcuggcggaccgcaagaucgccgagcuguucuccaccaagacccacaucggg

SEQ ID NO: 12455 - RNA, 1932 nt, Artificial Sequence
  derived and/or modified CDS sequence (opt1) from CCHFV(75-R-2012)__KR814863.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcugaccucccaggagcggcagugcagccucaucgaggcgggcacgcgcuucaaccugggccccgugaccaucacccuguccgagccccggaacauccagcagaagcucccgcccgagaucaucacccugcaccccaagguggaggagggguucuucgaccugaugcacguccagaaggugcucagcgccuccacggugugcaagcugcagagcugcacccacggcauccccggggaccugcaggucuaccacaucggcaaccuccugaagggcgaccgcgugaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgucaaccugcugaacaucgagaccgacuacaccaagacguuccacuuccacagcaagcgggugaccgcgcacggggacaccccccagcucgaccugaaggcccgccccaccuacggcgccggcgagaucacgguccugguggagguggccgacauggagcuccacaccaagaaggucgagaucuccgggcugaaguucgccagccuggcgugcaccggcugcuacgccugcuccagcgggaucuccugcaaggugcggauccacguggacgagccggacgagcucaccguccacgugaagagcuccgaccccgacguggucgccgccagcacgucccugauggcccgcaagcuggaguucggcaccgacagcaccuucaaggcguucagcgccaugcccaagaccucccucugcuucuacaucguggagcgggaguacugcaagagcugcuccgaggaggacacccagaagugcguggacacgaagcuggagcagccccagagcauccugaucgagcacaaggggaccaucaucggcaagcagaacgacaccugcaccgccaaggccuccugcuggcucgagagcgucaaguccuuccuguacggccugaagaacaugcucgggagcguguucggcaacuucuucaucgggauccugcuguuccucgccccguucgugcugcugguccuguucuucauguucggcuggaagauccucuucugcuucaagugcugccgccggacgcgcgggcugcugaaguaccggcuccugaaggacgacgaggagaccggcuaccgccggaucaucgagcgccugaacaacaagaagggcaagaaccgccuccuggacggggagcggcuggcggaccgcaagaucgccgagcucuucuccaccaagacccacaucggc

SEQ ID NO: 12456 - RNA, 1932 nt, Artificial Sequence
  derived and/or modified CDS sequence (opt1) from CCHFV(75-ST-2010)__KR814864.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcugaccucccaggagcggcagugcagccucaucgaggcgggcacgcgcuucaaccugggccccgugaccaucacccuguccgagccccggaacauccagcagaagcucccgcccgagaucaucacccugcaccccaagguggaggagggguucuucgaccugaugcacguccagaaggugcucagcgccuccacggugugcaagcugcagagcugcacccacggcauccccggggaccugcaggucuaccacaucggcaaccuccugaagggcgaccgcgugaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgucaaccugcugaacaucgagaccgacuacaccaagacguuccacuuccacagcaagcgggugaccgcgcacggggacaccccccagcucgaccugaaggcccgccccaccuacggcgccggcgagaucacgguccugguggagguggccgacauggagcuccacaccaagaaggucgagaucuccgggcugaaguucgccagccuggcgugcaccggcugcuacgccugcuccagcgggaucuccugcaaggugcggauccacguggacgagccggacgagcucaccguccacgugaagagcuccgaccccgacguggucgccgccagcacgucccugauggcccgcaagcuggaguucggcaccgacagcaccuucaaggcguucagcgccaugcccaagaccucccucugcuucuacaucguggagcgggaguacugcaagagcugcuccgaggaggacacccagaagugcguggacacgaagcuggagcagccccagagcauccugaucgagcacaaggggaccaucaucggcaagcagaacgacaccugcaccgccaaggccuccugcuggcucgagagcgucaaguccuucuucuacggccugaagaacaugcuggggagcguguucggcaacuucuucaucgggauccuccuguuccuggccccguucgugcuccugguccuguucuucauguucggcuggaagauccuguucugcuucaagugcugccgccgggcgcgcgggcuccugaaguaccggcaccugaaggacgacgaggagacgggcuaccgcaagaucaucgagcggcucaacaacaagaagggcaagaaccgccugcuggacggggagcgccucgccgaccggaagaucgccgagcuguucuccaccaagacccacaucggc

SEQ ID NO: 12457 - RNA, 1932 nt, Artificial Sequence
  derived and/or modified CDS sequence (opt1) from CCHFV(3756-ST-2007)__KR814866.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucaucaaguggaaggucgaguacaucaagaccgaggccaucgugugcguggagcugaccucccaggagcggcagugcagccucaucgaggcgggcacgcgcuucaaccugggccccgucaccaucacccuguccgagccccggaacauccagcagaagcucccgcccgagaucaucacccugcaccccaagaucgaggagggguucuucgaccugaugcacgugcagaaggugcucagcgccuccacggucugcaagcugcagagcugcacccacggcauccccggggaccugcagaucuaccacaucggcaaccuccugaagggcgaccgcgugaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgucaaccugcugaacaucgagaccgacuacaccaagacguuccacuuccacagcaagcgggugaccgcgcacggggacaccccccagcucgaccugaaggcccgccccaccuacggcgccggcgagaucacggugcuggucgagguggccgacauggagcuccacaccaagaaggucgagaucuccgggcugaaguucgccagccugaccugcaccggcugcuacgcgugcuccagcgggaucuccugcaaggugcggauccacguggacgagccggacgagcucacgguccacgugaagagcuccgaccccgacguggucgccgccagcaccucccugauggcccgcaagcuggaguucggcaccgacagcaccuucaaggccuucagcgcgaugcccaagaccucccucugcuucuacaucguggagcgggaguacugcaagagcugcuccgaggacgacacgaagaagugcguggacaccaagcuggagcagccccagagcauccugaucgagcacaaggggaccaucaucggcaagcagaacgacaccugcacggccaaggccuccugcuggcucgagagcgucaaguccuucuucuacggccugaagaacaugcuggggagcguguucggcuccuucuucguggggauccuccuguuccugaccccguucguccuccuggugcuguucuucauguucggcuggaagauccuguucugcuucaagugcugccgccggacccgcgggcucuucaaguaccggcaccugaaggacgacgaggagaccggcuaccgccggaucaucgagcgccugaacagcaagaagggcaagaaccgccuccuggacggggagcggcuggccgaccgcaagaucgccgagcucuucuccacgaagacccacaucggc

SEQ ID NO: 12458 - RNA, 1932 nt, Artificial Sequence
  derived and/or modified CDS sequence (opt1) from CCHFV(3809-ST-2007)__KR814867.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcugaccucccaggagcggcagugcagccucaucgaggcgggcacgcgcuucaaccugggccccgugaccaucacccuguccgagccccggaacauccagcagaagcucccgcccgagaucaucacccugcaccccaagguggaggagggguucuucgaccugaugcacguccagaaggugcucagcgccuccacggugugcaagcugcagagcugcacccacggcauccccggggaccugcaggucuaccacaucggcaaccuccugaagggcgaccgcgugaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgucaaccugcugaacaucgagaccgacuacaccaagacguuccacuuccacagcaagcgggugaccgcgcacggggacaccccccagcucgaccugaaggcccgccccaccuacggcgccggcgagaucacgguccugguggagguggccgacauggagcuccacaccaagaaggucgagaucuccgggcugaaguucgccagccuggcgugcaccggcugcuacgccugcuccagcgggaucuccugcaaggugcggauccacguggacgagccggacgagcucaccguccacgugaagagcuccgaccccgacguggucgccgccagcacgucccugauggcccgcaagcuggaguucggcaccgacagcaccuucaaggcguucagcgccaugcccaagaccucccucugcuucuacaucguggagaaggaguacugccggagcugcuccgaggaggacacccagaagugcguggacacgaagcuggagcagccccagagcauccugaucgagcacaaggggaccaucaucggcaagcagaacgacaccugcaccgccaaggccuccugcuggcucgagagcgucaaguccuucuucuacggccugaagaacaugcuggggagcguguucggcaacuucuucaucgggauccuccuguuccugacgccguucgugcuccugguccuguucuucauguucggcuggaagauccuguucugcuucaagugcugccgccggacccgcgggcuccugaaguaccggcaccugaaggacgacgaggagaccggcuaccgccggaucaucgagcgccucaacaacaagaagggcaagaaccgccugcuggacggggagcggcucgccgaccgcaagaucgcggagcuguucuccaccaagacgcacaucggc

SEQ ID NO: 12459 - RNA, 1932 nt, Artificial Sequence
  derived and/or modified CDS sequence (opt1) from CCHFV(3820-ST-2007)__KR814868.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucaucaaguggaaggucgaguacaucaagaccgaggccaucgugugcguggagcugaccucccaggagcggcagugcagccucaucgaggcgggcacgcgcuucaaccugggccccgucaccaucacccuguccgagccccggaacauccagcagaagcucccgcccgagaucaucacccugcaccccaagaucgaggagggguucuucgaccugaugcacgugcagaaggugcucagcgccuccacggucugcaagcugcagagcugcacccacggcauccccggggaccugcagaucuaccacaucggcaaccuccugaagggcgaccgcgugaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgucaaccugcugaacaucgagaccgacuacaccaagacguuccacuuccacagcaagcgggugaccgcgcacggggacaccccccagcucgaccugaaggcccgccccaccuacggcgccggcgagaucacggugcuggucgagguggccgacauggagcuccacaccaagaaggucgagaucuccgggcugaaguucgccagccugaccugcaccggcugcuacgcgugcuccagcgggaucuccugcaaggugcggauccacguggacgagccggacgagcucacgguccacgugaagagcuccgaccccgacguggucgccgccagcaccucccugauggcccgcaagcuggaguucggcaccgacagcaccuucaaggccuucagcgcgaugcccaagaccucccucugcuucuacaucguggagcgggaguacugcaagagcugcuccgaggacgacacgaagaagugcguggacaccaagcuggagcagccccagagcauccugaucgagcacaaggggaccaucaucggcaagcagaacgacaccugcacggccaaggccuccugcuggcucgagagcgucaaguccuucuucuacggccugaagaacaugcuggggagcguguucggcuccuucuucguggggauccuccuguuccuggccccguucguccuccuggugcuguucuucauguucggcuggaagauccuguucugcuucaagugcugccgccggacccgcgggcucuucaaguaccggcaccugaaggacgacgaggagaccggcuaccgccggaucaucgagcgccugaacagcaagaagggcaagaaccgccuccuggacggggagcggcuggccgaccgcaagaucgcggagcucuucuccaccaagacgcacaucggc

SEQ ID NO: 12460 - RNA, 1932 nt, Artificial Sequence
  derived and/or modified CDS sequence (opt1) from CCHFV(4495-ST-2008)__KR814869.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcaucagcugggaccuggggguggaggacgccuccgagagcaagcugcucaccguguccaucauggaccugagccagauguacucccccgucuucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcguggggaccggcugcacgugcugcggggucgacgugaaggaccuguucaccgaccacauguucgugaaguggaaggucgaguacaucaagaccgaggccaucgugugcguggagcugaccucccaggagcggcagugcagccucaucgaggcgggcacgcgcuucaaccugggccccgucaccaucacccuguccgagccccggaacauccagcagaagcucccgcccgagaucaucacccugcaccccaagguggaggagggguucuucgaccugaugcacgugcagaagguccucagcgccuccacggugugcaagcugcagagcugcacccacggcauccccggggaccugcagguguaccacaucggcaaccuccugaagggcgaccgcgucaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgugaaccugcugaacaucgagaccgacuacaccaagacguuccacuuccacagcaagcgggucaccgcgcacggggacaccccccagcucgaccugaaggcccgccccaccuacggcgccggcgagaucacggugcuggucgagguggccgacauggagcuccacaccaagaagguggagaucuccgggcugaaguucgccagccuggcgugcaccggcugcuacgccugcuccagcgggaucuccugcaagguccggauccacguggacgagccggacgagcucaccgugcacgucaagagcuccgaccccgacgugguggccgccagcacgucccugauggcccgcaagcuggaguucggcaccgacagcaccuucaaggcguucagcgccaugcccaagaccucccucugcuucuacaucgucgagcgggaguacugcaagagcugcuccgaggaggacacccagcgcugcguggacacgaagcuggagcagccccagagcauccugaucgagcacaaggggaccaucaucggcaagcagaacgacaccugcaccgccaaggccuccugcuggcucgagagcgugaaguccuucuucuacggccugaagaacaugcuggggagcgucuucggcaacuucuucaucgggauccuccuguuccuggccccguucgugcuccuggugcuguucuucauguucggcuggaagauccuguucugcuucaagugcugccggcgcgcgcgggggcuccugaaguaccgccaccugaaggacgacgaggagacgggcuaccggaagaucaucgagcgccucaacaacaagaagggcaagaaccgccugcuggacggggagcggcucgccgaccgcaagaucgccgagcuguucuccaccaagacccacaucggc

SEQ ID NO: 12461 - RNA, 1932 nt, Artificial Sequence
  derived and/or modified CDS sequence (opt1) from CCHFV(4691-ST-2009)__KR814871.1__Gc
uuccucgacagcaucgugaagggcaugaagaaccuccugaacuccaccagccuggagaccucccucagcaucgaggcccccuggggcgccaucaacguccaguccacguucaagccggcggugagcaccgccaacaucgcccuguccuggagcuccguggagcaccgcgggaacaagauccuggucaccgggcggagcgaguccaucaugaagcucgaggagcgcaccggcgugagcugggaccuggggguggaggacgccuccgagagcaagcugcucacggucuccaucauggaccugagccagauguacucccccguguucgaguaccugagcggcgaccgccagguggaggaguggcccaaggcgaccugcaccggcgacugccccgagcggugcgggugcaccuccagcacgugccuccacaaggaguggccgcacagccggaacuggcgcugcaaccccaccuggugcuggggcgucgggaccggcugcacgugcugcgggguggacgugaaggaccuguucaccgaccacauguucaucaaguggaaggucgaguacaucaagaccgaggccaucgugugcguggagcugaccucccaggagcggcagugcagccucaucgaggccggcacccgcuucaaccugggccccgucacgaucacccuguccgagccccggaacauccagcagaagcucccgcccgagaucaucacccugcaccccaagaucgaggagggguucuucgaccugaugcacgugcagaaggugcucagcgccuccaccgucugcaagcugcagagcugcacgcacggcauccccggggaccugcagaucuaccacaucggcaaccuccugaagggcgaccgcgugaacgggcaccugauccacaagaucgagccgcacuucaacaccuccuggaugagcugggacggcugcgaccucgacuacuacugcaacaugggggacuggcccuccugcaccuacaccggcgugacgcagcacaaccacgccgcguucgucaaccugcugaacaucgagaccgacuacaccaagaccuuccacuuccacagcaagcgggugacggcccacggggacacgccccagcucgaccugaaggcccgccccaccuacggcgccggcgagaucaccgugcuggucgagguggccgacauggagcuccacaccaagaaggucgagaucuccgggcugaaguucgcgagccuggccugcaccggcugcuacgccugcuccagcgggaucuccugcaaggugcggauccacguggacgagccggacgagcucaccguccacgucaagagcuccgaccccgacgugguggccgccagcaccucccugauggcgcgcaagcuggaguucggcacggacagcaccuucaaggccuucagcgccaugcccaagaccucccucugcuucuacaucguggagcgggaguacugcaagagcugcuccgaggacgacaccaagaagugcguggacaccaagcuggagcagccccagagcauccugaucgagcacaaggggacgaucaucggcaagcagaacgacacgugcaccgccaaggccuccugcuggcucgagagcgucaaguccuucuucuacggccugaagaacaugcuggggagcguguucggcaacuucuucguggggauccuccuguuccuggcgccguucguccuccuggugcuguucuucauguucggcuggaagauccuguucugcuucaagugcugccgccggacccgcggccucuucaaguaccggcaccugaaggacgacgaggagaccggguaccgccggaucaucgagcgccugaacuccaagaagggcaagaaccgccuccuggacggggagcggcuggccgaccgcaagaucgccgagcuguucagcaccaagacccacaucggc

SEQ ID NO: 12462 - RNA, 1932 nt, Artificial Sequence
  derived and/or modified CDS sequence (opt1) from CCHFV(4701-ST-2009)__KR814872.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucaucaaguggaaggucgaguacaucaagaccgaggccaucgugugcguggagcugaccucccaggagcggcagugcagccucaucgaggcgggcacgcgcuucaaccugggccccgucaccaucacccuguccgagccccggaacauccagcagaagcucccgcccgagaucaucacccugcaccccaagaucgaggagggguucuucgaccugaugcacgugcagaaggugcucagcgccuccacggucugcaagcugcagagcugcacccacggcauccccggggaccugcagaucuaccacaucggcaaccuccugaagggcgaccgcgugaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgucaaccugcugaacaucgagaccgacuacaccaagacguuccacuuccacagcaagcgggugaccgcgcacggggacaccccccagcucgaccugaaggcccgccccaccuacggcgccggcgagaucacggugcuggucgagguggccgacauggagcuccacaccaagaaggucgagaucuccgggcugaaguucgccagccugaccugcaccggcugcuacgcgugcuccagcgggaucuccugcaaggugcggauccacguggacgagccggacgagcucacgguccacgugaagagcuccgaccccgacguggucgccgccagcaccucccugauggcccgcaagcuggaguucggcaccgacagcaccuucaaggccuucagcgcgaugcccaagaccucccucugcuucuacaucguggagcgggaguacugcaagagcugcuccgaggacgacacgaagaagugcguggacaccaagcuggagcagccccagagcauccugaucgagcacaaggggaccaucaucggcaagcagaacgacaccugcacggccaaggccuccugcuggcucgagagcgucaaguccuucuucuacggccugaagaacaugcuggggagcguguucggcggguucuucgugggcauccuccuguuccuggccccguucguccuccuggugcuguucuucauguucggguggaagauccuguucugcuucaagugcugccgccggacccgcggccucuucaaguaccggcaccugaaggacgacgaggagaccggcuaccgccggaucaucgagcgccugaacuccaagaaggggaagaaccgccuccuggacggcgagcggcuggccgaccgcaagaucgcggagcucuucagcaccaagacgcacaucggg

SEQ ID NO: 12463 - RNA, 1932 nt, Artificial Sequence
  derived and/or modified CDS sequence (opt1) from CCHFV(Oman-199809166)__KR864901.1__Gc
uuccucgacagcaucgccaagggcaugaagaaccuccugaacuccaccagccuggagaccucccucagcaucgaggcccccuggggcgcgaucaacgugcaguccacguucaagccgaccgugagcaccgccaacaucgcccuguccuggagcuccguggagcaccgcgggaacaagauccuggugagcgggcgguccgagagcaucaugaagcucgaggagcgcaccggcaucuccugggaccugggggucgaggacgccagcgaguccaagcugcucacggugagcgugauggaccugucccagauguacagccccgucuucgaguaccuguccggcgaccgccagguggaggaguggcccaaggcgaccugcaccggcgacugccccgagcggugcgggugcaccagcagcacgugccuccacaaggaguggccgcacucccggaacuggcgcugcaaccccaccuggugcuggggcguggggaccggcugcacgugcugcgggcuggacgucaaggaccuguucaccgacuacauguucgugaaguggaagguggaguacaucaagaccgaggccaucgucugcguggagcucaccagccaggagcggcagugcucccugaucgaggccggcacccgcuucaaccugggccccgugacgaucacccucagcgagccccggaacauccagcagaagcugccgcccgagaucgucacccugcacccccgcaucgaggagggguucuucgaccucaugcacgugcagaaggugcuguccgccagcaccgucugcaagcugcaguccugcacgcacggcgugcccggggaccuccagguguaccacaucggcaaccugcugaagggcgacaaggucaacgggcaccucauccacaagguggagccgcacuucaacaccagcuggauguccugggacggcugcgaccuggacuacuacugcaacaugggggacuggcccagcugcaccuacaccggcgugacgcagcacaaccacgccgcguucgucaaccugcucaacaucgagaccgacuacaccaagaacuuccacuuccacuccaagcgggugaccgcccacggggacacgccccagcuggaccugaaggcccgccccaacuacggcgccggcgagaucaccguccucguggagguggccgacauggagcugcacaccaagaagaucgagaucagcgggcugaaguucgcgucccugaccugcacgggcugcuacgccugcagcuccgggaucagcugcaagguccggauccacguggacgagccggacgagcucaccgugcacgucaaguccgaggaccccgacaucguggccgccagcuccagccugauggcccgcaagcucgaguucggcaccgacagcaccuucaaggcguucuccgccaugcccaagacgagccugugcuucuacaucguggagcgggaguacugcaaguccugcagcaaggaggacacccagaagugcgucaacgccaagcuggagcgcccccaguccauccucaucgagcacaaggggaccaucaucggcaagcagaacgacacgugcaccgccaaggccagcugcuggcuggaguccgucaagagcuucuucuacggccugaagaacaugcucuccgggaucuucggcaacguguucaucgggaucuuccuguuccuggcgccguucauccuccugauccuguucuucauguucggcuggcggauccuguucugcuucaagugcugccgccggacccgcggccucuucaaguaccggcaccugaaggacgacgaggagaccggguaccgcaagaucaucgagcgccugaacaacaagaagggcaagaacaagcuccuggacggggagcggcuggccgaccgcaagaucgccgagcuguucagcaccaagacccacaucggc

SEQ ID NO: 12464 - RNA, 1932 nt, Artificial Sequence
  derived and/or modified CDS sequence (opt1) from CCHFV(200406546-Turkey)__KR864902.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccaucgagcaccgcggcaacaagauccuggugaccgggcggagcgaguccaucaugaagcucgaggagcgcacgggcgucagcugggaccuggggguggaggacgccuccgagagcaagcugcucaccguguccaucauggaccugagccagauguacucccccgucuucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcguggggaccggcugcacgugcugcggggucgacgugaaggaccuguucaccgaccacauguucgugaaguggaaggucgaguacaucaagaccgaggccaucgugugcguggagcugaccucccaggagcggcagugcagccucaucgaggcgggcacgcgcuucaaccugggccccgucaccaucacccuguccgagccccggaacauccagcagaagcucccgcccgagaucaucacccugcaccccaagguggaggagggguucuucgaccugaugcacgugcagaagguccucagcgccuccacggugugcaagcugcagagcugcacccacggcauccccggggaccugcagguguaccacaucggcaaccuccugaagggcgaccgcgucaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgugaaccugcugaacaucgagaccgacuacaccaagacguuccacuuccacagcaagcgggucaccgcgcacggggacaccccccagcucgaccugaaggcccgccccaccuacggcgccggcgagaucacggugcuggucgagguggccgacauggagcuccacaccaagaagguggagaucuccgggcugaaguucgccagccuggcgugcaccggcugcuacgccugcuccagcgggaucuccugcaagguccggauccacguggacgagccggacgagcucaccgugcacgucaagagcuccgaccccgacgugguggccgccagcacgucccugaccgcccgcaagcuggaguucggcaccgacagcaccuucaaggcguucagcgccaugcccaagaccucccucugcuucuacaucgucgagaaggaguacugcaagagcugcaacgaggacgacacgcagaagugcguggacaccaagcuggagcagccccaguccauccugaucgagcacaaggggaccaucaucggcaagcagaacgacaccugcacggccaaggccagcugcuggcucgaguccgugaagagcuucuucuacggccugaagaacaugcugggguccgucuucggcaacuucuucaucgggauccuccuguuccuggccccguucgugcuccuggugcuguucuucauguucggcuggaagauccuguucugcuucaagugcugccggcgcacccgggggcucuucaaguaccgccaccugaaggacgacgaggagaccggcuacaagcggaucaucgagcgccugaacaacaagaagggcaagaaccggcuccuggacggggagcgccuggcggaccgcaagaucgccgagcucuucagcaccaagacgcacaucggc

SEQ ID NO: 12465 - RNA, 1932 nt, Artificial Sequence
  derived and/or modified CDS sequence (opt1) from CCHFV(1-CR/HU-2015)__KU161584.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcugaccucccaggagcggcagugcagccucaucgaggcgggcacgcgcuucaaccugggccccgugaccaucacccuguccgagccccggaacauccagcagaagcucccgcccgagaucaucacccugcaccccaagaucgaggagggguucuucgaccugaugcacgugcagaagguccucagcgccuccacggugugcaagcugcagagcugcacccacggcauccccggggaccugcagguguaccacaucggcaaccuccugaagggcgaccgcgucaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgugaaccugcugaacaucgagaccgacuacaccaagacguuccacuuccacagcaagcgggucaccgcgcacggggacaccccccagcucgaccugaaggcccgccccaccuacggcgccggcgagaucacggugcuggucgagguggccgacauggagcuccacaccaagaagguggagaucuccgggcugaaguucgccagccuggcgugcaccggcugcuacgccugcuccagcgggaucuccugcaagguccggauccacguggacgagccggacgagcucaccgugcacgucaagagcuccgaccccgacgugguggccgccagcacgucccugauggcccgcaagcuggaguucggcaccgacagcaccuucaaggcguucagcgccaugcccaagaccucccucugcuucuacaucgucgagcgggaguacugcaagagcugcuccgaggacgacaccaagaagugcguggacacgaagcuggagcagccccagagcauccugaucgagcacaaggggaccaucaucggcaagcagaacgacaccugcaccgccaaggccuccugcuggcucgagagcgugaaguccuucuucuacggccugaagaacaugcuggggagcgucuucggcaacuucuucaucgggauccuccuguuccuggccccguucgugcuccuggugcuguucuucauguucggcuggaagauccuguucugcuucaagugcugccgccggacgcgcgggcucuucaaguaccggcaccugaaggacgacgaggagaccggcuaccgccggaucaucgagcgccugaacaacaagaagggcaagaaccgccuccuggacggggagcggcuggcggaccgcaagaucgccgagcucuucuccaccaagacccacaucggc

SEQ ID NO: 12466 - RNA, 1932 nt, Artificial Sequence
  derived and/or modified CDS sequence (opt1) from CCHFV(Gaib)__KX013445.1__Gc
uucagcgacuccaucgugaagggcaugaagaaccugcucaacagcaccucccuggagaccagccuguccaucgaggcccccuggggcgccaucaacguccagagcacguucaagccgaccguguccaccgcgaacaucgcccucagcugguccagcaucgagcaccgcgggaacaagauccugguguccgggcggagcgaguccaucaugaagcuggaggagcgcaccggcaucagcugggaccucggggucgaggacgccuccgagagccggcugcugacgguguccgugauggaccucagccagauguacucccccgucuucgaguaccugagcggcgaccgccagguggaggaguggcccaaggcgaccugcaccggcgacugccccgagcggugcgggugcaccagcuccacgugccugcacaaggaguggccgcacagccgcaacuggcggugcaaccccaccuggugcuggggcguggggaccggcugcacgugcugcgggcucgacgucaaggaccuguucaccgacuacauguucgugaaguggaagguggaguacaucaagaccgaggccaucgucugcguggagcugaccucccaggagcgccagugcagccucaucgaggccggcacccgguucaaccugggccccgugacgaucacccuguccgagccccgcaacauccagcagaagcucccgcccgagaucaucacccugcacccccggaucgaggagggguucuucgaccugaugcacguccagaaggugcucagcgccuccaccgugugcaagcugcagagcugcacgcacggcguccccggggaccuccagguguaccacaucggcaaccugcugaagggcgacaaggugaacgggcaccugauccacaagaucgagccgcacuucaacaccuccuggaugagcugggacggcugcgaccucgacuacuacugcaacaugggggacuggcccuccugcaccuacaccggcgucacgcagcacaaccacgccgccuucgugaaccugcugaacaucgagaccgacuacaccaagaacuuccacuuccacagcaagcgcgugaccgcgcacggggacacgccccagcucgaccugaaggcccggcccaccuacggcgccggcgagaucaccguccugguggaggucgccgacauggagcuccacaccaagaagaucgagaucuccgggcugaaguucgccagccugacgugcaccggcugcuacgcgugcuccagcgggaucuccugcaaggugcgcauccacguggacgagccggacgagcucaccguccacgucaagagcgaggaccccgacaucguggccgccuccagcagccugauggcccggaagcuggaguucggcaccgacuccacguucaaggccuucagcgcgaugcccaagaccucccucugcuucuacaucguggagcgcgaguacugcaagagcugcucccgggaggacacccagaagugcgugagcaccaagcuggagcagccccaguccauccugaucgagcacaaggggaccaucaucggcaagcagaacaacacgugcaccaccaagaccacgugcuggcucgagagcgugaaguccuucuucuacggccugaagaacaugcugagcuccaucuucgggaacgucuucgugggcaucuucagcuuccucgccccguucauccugcugauccucuucuucauguucggguggcgcauccuguucugcuucaagugcugccggcgcacccggggccuguucaaguaccgccaccugaaggacgacgaggagaccggguaccgccggaucaucgagcgccucaacaacaagaagggcaaguccaagcugcuggacggcgagcggcucgccgaccgcaagaucgccgagcuguucagcaccaagacgcacaucggg

SEQ ID NO: 12467 - RNA, 1932 nt, Artificial Sequence
  derived and/or modified CDS sequence (opt1) from CCHFV(Hodzha)__KX013448.1__Gc
uuccucgacagcaucgugaagggcaagaagaaccuccugaacuccaccagccuggagaccucccucagcaucgaggcccccuggggcgccaucaacguccaguccacguacaagccgaccgugagcaccgcgaacaucgcccuguccuggagcuccguggagcaccgcgggaacaagauccuggucagcgggcgguccgagagcaucaugaagcucgaggagcgcaccggcaucuccugggaccuggggguggaggacgccagcgaguccaagcugcucacggugagcgucauggaccugucccagauguacagccccguguucgaguaccuguccggcgaccgccagguggaggaguggcccaaggcgaccugcaccggcgacugcagcgagcggugcgggugcaccagcuccacgugccuccacaaggaguggccccacagccggaacuggcgcugcaacccgaccuggugcuggggcgucgggaccggcugcacgugcugcgggcuggacgugaaggaccuguucaccgacuacauguucgugaaguggaaggucgacuacaucaagaccgaggccaucgugugcguggagcucaccucccaggagcggcagugcagccuggucgaggccggcacccgcuucaaccugggccccgugacgaucacccucuccgagccccggaacauccagcagaagcugcccccggagaucaucacccugcacccccgcaucgaggagggguucuucgaccucaugcacgugcagaagguccugagcgccuccaccgugugcaagcugcagagcugcacgcacggcgugcccggggaccuccaggucuaccacaucggcaaccugcugaagggcgacaaggugaacgggcaccucauccacaagaucgagccccacuucaacaccuccuggaugagcugggacggcugcgaccuggacuacuacugcaacaugggggacuggccguccugcaccuacaccggcgugacgcagcacaaccacgccagcuucgucaaccugcucaacaucgagaccgacuacaccaaguccuuccacuuccacagcaagcgggugaccgcccacggggacacgccccagcuggaccugaaggcgcgccccaccuacggcgccggcgagaucaccguccucguggagguggccgacauggagcugcacaccaagaagaucgagaucacggggcugaaguucgccucccugaccugcaccggcugcuacgccugcagcuccgggaucagcugcaagguccggauccacguggacgagcccgacgagcucaccgugcacgucaaguccgacgacccggacgugguggcggccagcagcucccugauggcccgcaagcucgaguucggcacggacagcaccuucaaggccuucuccgccaugcccaagaccagccugugcuucuacaucgucgagcgggaguacugcaaguccugcagcaaggaggacacccagaagugcgugaacaccaagcuggagcagccccaguccauccucaucgagcagaaggggacgaucaucggcaagcagaacaacacgugcaccgcgaaggccagcugcuggcuggaguccgucaagagcuucuucuacggccugaagaacaugcucuccgggaucuucggcaacguguucguggggaucuuccuguuccuggcccccuucauccuccugauccuguucuucauguucggcuggcgcauccuguucugcuucaagugcugccggcgcacccggggccucuucaaguacaagcaccugaaggacgacgaggagaccggguaccgccggaucaucgagcgccugaacaacaagaagggcaagaacaagcuccuggacggggagcgccuggccgaccggcgcaucgccgagcuguucagcaccaagacccacaucggc

SEQ ID NO: 12468 - RNA, 1932 nt, Artificial Sequence
  derived and/or modified CDS sequence (opt1) from CCHFV(IbAn7620)__KX013451.1__Gc
uuccuggacagcaucgccaagggcaugaagaacccccucaacuccaccagccuggagaccucccugagcaucgaggccccguggggcgcgaucgacgugcaguccacguacaagcccaccgucagcaccgccaacaucgcccucuccuggagcuccguggagcaccgcgggaacaagauccuggugagcgggcgguccgagagcaucaugaagcuggaggagcgcaccggcaucuccugggaccucggggucgaggacgccagcgaguccaagcugcugacggugagcgugauggaccucucccagauguacagccccgucuucgaguaccuguccggcgaccgccagguggaggaguggcccaaggcgaccugcaccggcgacugcccggagcggugcgggugcaccagcagcacgugccugcacaaggaguggccccacucccggaacuggcgcugcaaccccaccuggugcuggggcguggggaccggcugcacgugcugcgggcucgacgucaaggaccuguucaccgacuacauguucgugaaguggaagguggaguacaucaagaccgaggccaucgucugcguggagcugaccagccaggagcggcagugcucccucaucgaggccggcacccgcuucaaccugggccccgugacgaucacccugagcgagccgcggaacauccagcagaagcucccgcccgagaucaucacccugcacccccgcaucgaggagggguucuucgaccugaugcacguccagaaggugcucuccgccagcaccgugugcaagcugcaguccugcacgcacggcguccccggggaccuccagguguaccacaucggcaaccugcugaagggcgacaaggugaacgggcaccugauccacaagaucgagccccacuucaacaccagcuggauguccugggacggcugcgaccucgacuacuacugcaacaugggggacuggcccagcugcaccuacaccggcgucacgcagcacaaccacgccuccuucgugaaccugcugaacaucgagaccgacuacaccaagaacuuccacuuccacagcaagcgggugaccgcgcacggggacacgccccagcucgaccugaaggcccgcccgaccuacggcgccggcgagaucaccguccugguggaggucgccaacauggagcuccacaccaagaagaucgagaucuccgggcugaaguucgccagccugacgugcaccggcugcuacgcgugcuccagcgggaucuccugcaaggugcggauccacguggacgagcccgacgagcucaccguccacgucaagagcgacgaccccgacgugguggccgccuccagcagccugauggcccgcaagcuggaguucggcaccgacuccacguucaaggccuucagcgcgaugcccaagaccucccucugcuucuacaucguggagcgggagcacugcaagagcugcuccgaggaggacaccaagaagugcgugaacaccaagcuggagcagccgcagagcauccugaucgagcacaaggggaccaucaucggcaagcagaacuccacgugcaccgccaaggccagcugcuggcucgaguccgucaagagcuucuucuacggccugaagaacaugcuguccgggaucuucggcaacguguucauggggaucuuccucuuccuggcccccuucauccugcucauccuguucuucauguucggcuggcgcauccuguucugcuucaagugcugccggcgcacccgggggcuguucaaguaccgccaccucaaggacgacgaggagaccggcuaccggcgcaucaucgagcgccugaacaacaagaagggcaagaacaagcugcucgacggggagcggcuggccgaccgccggaucgcggagcuguucagcacgaagacccacaucggc

SEQ ID NO: 12469 - RNA, 1932 nt, Artificial Sequence
  derived and/or modified CDS sequence (opt1) from CCHFV(K128_76)__KX013454.1__Gc
uuccaggacagcaucgugaagggcaugaagaaccugcucaacuccaccagccuggagaccucccugagcaucgaggcccccuggggcgccaucaacguccaguccacguacaagccggcggugagcgccgccaacaucgcccucuccuggagcuccguggagcaccgcgggagcaagauccuggucuccgggcggagcgaguccaucaugaagcuggaggagcgcaccggcaucagcugggaccucgggguggaggacgccuccgagagcaagcugcugaccguguccgucauggaccucagccagauguacucccccguguucgaguaccugagcggcgaccgccagguggaggaguggcccaaggcgaccugcacgggcgacugccccgagcggugcgggugcaccagcuccacgugccugcacaaggaguggccgcacagccggaacuggcgcugcaaccccaccuggugcuggggcgucgggaccggcugcacgugcugcgggcucgacgugaaggaccuguucaccgacuacauguucgugaaguggaaggucgaguacaucaagaccgaggccaucgugugcguggagcugaccucccaggagcggcagugcagccucaucgaggccggcacccgcuucaaccugggccccgucaccaucacccuguccgagccccggaacauccagcagaagcucccgcccgagaucaucacgcugcacccccgcaucgaggagggguucuucgaccugaugcacgugcagaaggugcucagcgccuccaccgucugcaagcugcagagcugcacccacggcgugcccggggaccuccagguguaccacaucggcaaccugcugaagggcgaccgggucaacgggcaccugauccacaagaucgagccgcacuucaacaccuccuggaugagcugggacggcugcgaccucgacuacuacugcaacaugggggacuggcccuccugcacguacaccggcgugacccagcacaaccacgcgagcuucgugaaccugcugaacaucgagaccgacuacacgaaguccuuccacuuccacagcaagcgcgucaccgcccacggggacacgccccagcucgaccugaaggcccggcccaacuacggcgccggcgagaucaccgugcuggucgagguggccgacauggagcuccacaccaagaagaucgagaucuccgggcugaaguucgcgagccugaccugcaccggcugcuacgccugcuccagcgggaucuccugcaaggugcgcauccacgucgacgagccggacgagcucaccgugcacgucaagagcgacgaccccgacgugguggccgccagcuccagccugauggcccggaagcuggaguucggcacggacuccaccuucaaggcguucagcgccaugcccaagaccucccucugcuucuacaucguggagcgcgaguacugcaagagcugcuccaaggaggacacccagaagugcgucaacacgaagcuggagcagccccagagcauccugaucgagcacaaggggaccaucaucggcaagcagaacaacacgugcaccgccaagaccuccugcuggcucgagagcgugaaguccuucuucuacggccugaagaacaugcugagcgggaucuucggcaacguguucgucgggaucuuccucuuccuggccccguucauccugcucauccuguucuucauguucggcuggcggauccuguucugcuucaagugcugccgccggacccgcgggcuguuccgguacaagcaccucgagaacgacgaggagaccggcuaccgccgcaucaucgagcggcugaacaacaagaagggcaagaacaagcugcucgacggggagcgccuggccgaccggcgcaucgcggagcuguucuccaccaagacccacaucggc

SEQ ID NO: 12470 - RNA, 1932 nt, Artificial Sequence
  derived and/or modified CDS sequence (opt1) from CCHFV(K168_40)__KX013457.1__Gc
uuccucgacggcaucgugaaggggaugaagaaccuccugaacagcaccucccuggagaccagccucuccaucgaggcccccuggggcgccaucaacguccagagcacguacaagccgaccguguccgcggccaacaucgcccugagcugguccagcguggagcaccgcgggaacaagauccuggucuccggccggagcgaguccaucaugaagcucgaggagcgcaccgggaucagcugggaccugggcguggaggacgccuccgagagcaagcugcucaccguguccgucauggaccugagccagauguacucccccguguucgaguaccugagcggcgaccgccagguggaggaguggcccaaggccacgugcaccggggacugccccgagcggugcggcugcaccuccagcacgugccuccacaaggaguggccgcacagccggaacuggcgcugcaaccccaccuggugcuggggcgucgggaccgggugcacgugcugcggccuggacgugaaggaccuguucaccgacuacauguucgugaaguggaaggucgaguacaucaagaccgaggcgaucgugugcguggagcucaccucccaggagcggcagugcagccugaucgaggccggcacccgcuucaaccuggggcccgucaccaucacgcucuccgagccccggaacauccagcagaagcugccgcccgagaucaucacccugcacccccgcaucgaggagggcuucuucgaccucaugcacgugcagaaggugcugagcgccuccaccgucugcaagcugcagagcugcacccacggggugcccggcgaccuccagguguaccacaucggcaaccugcugaagggggacaaggucaacggccaccucauccacaagaucgagccgcacuucaacacguccuggaugagcugggacgggugcgaccuggacuacuacugcaacaugggcgacuggcccuccugcaccuacaccggggugacccagcacaaccacgccagcuucaucaaccugcucaacaucgagacggacuacaccaaguccuuccacuuccacagcaagcgggugaccgcgcacggcgacacgccccagcuggaccugaaggcccgccccaacuacggcgccggggagaucaccguccucguggaggucgccgacauggagcugcacaccaagaagaucgagaucuccggccugaaguucgccagccugaccugcaccgggugcuacgcgugcuccagcggcaucuccugcaaggugcggauccacguggacgagccggacgagcucacgguccacgucaagagcgacgaccccgacgugguggccgccuccagcagccugauggcccgcaagcucgaguucgggaccgacuccaccuucaaggccuucagcgcgaugcccaagaccucccugugcuucuacaucguggagcgggaguacugcaagagcugcuccaaggaggacacgcagaagugcgugaacaccaagcuggagcacccccagagcauccucaucgagcacaagggcaccaucaucggcaagcagaacaacacgugcaccgccaagaccuccugcuggcuggagagcgucaaguccuucuucuacgggcugaagaacaugcucagcggcaucuucgggaacguguucgugggcaucuuccuguuccuggccccguucauccuccugauccuguucuucauguucggguggcgcauccuguucugcuucaagugcugccggcgcacccggggccucuuccgcuacaagcaccuggaggacgacgaggagaccggcuaccggcgcaucaucgagcgccugaacaacaagaaggggaagaacaagcuccuggacggcgagcggcuggccgaccgccggaucgccgagcuguucuccaccaagacgcacaucggg

SEQ ID NO: 12471 - RNA, 1932 nt, Artificial Sequence
  derived and/or modified CDS sequence (opt1) from CCHFV(K168_125)__KX013460.1__Gc
uuccucgacagcaucgugaagggcaagaagaaccuccugaacuccaccagccuggagaccucccucagcaucgaggcccccuggggcgccaucaacguccaguccacguacaagccgaccgugagcgcggccaacaucgcccuguccuggagcuccguggagcaccgcgggaacaagauccuggucagcgggcgguccgagagcaucaugaagcucgaggagcgcaccggcaucuccugggaccuggggguggaggacgccagcgaguccaagcugcucaccgugagcgucauggaccugucccagauguacagccccguguucgaguaccuguccggcgaccgccagguggaggaguggcccaaggccacgugcaccggcgacugccccgagcggugcgggugcaccagcagcacgugccuccacaaggaguggccgcacucccggaacuggcgcugcaaccccaccuggugcuggggcgucgggaccggcugcacgugcugcgggcuggacgugaaggaccuguucaccgacuacauguucgugaaguggaaggucgaguacaucaagaccgaggcgaucgugugcguggagcucaccagccaggagcggcagugcucccugaucgaggccggcacccgcuucaaccugggccccgucaccaucacgcucagcgagccccggaacauccagcagaagcugccgcccgagaucaucacccugcacccccgcaucgaggagggguucuucgaccucaugcacgugcagaaggugcuguccgccagcaccgucugcaagcugcaguccugcacccacggcgugcccggggaccuccagguguaccacaucggcaaccugcugaagggcgacaaggucaacgggcaccucauccacaagaucgagccgcacuucaacacgagcuggauguccugggacggcugcgaccuggacuacuacugcaacaugggggacuggcccagcugcaccuacaccggcgugacccagcacaaccacgccuccuucaucaaccugcucaacaucgagacggacuacaccaagagcuuccacuuccacuccaagcgggugaccgcgcacggggacacgccccagcuggaccugaaggcccgccccaacuacggcgccggcgagaucaccguccucguggaggucgccgacauggagcugcacaccaagaagaucgagaucagcgggcugaaguucgccucccugaccugcaccggcugcuacgcgugcagcuccgggaucagcugcaaggugcggauccacguggacgagccggacgagcucacgguccacgugaaguccgacgaccccgacguggucgccgccagcagcucccugauggcccgcaagcucgaguucggcaccgacagcaccuucaaggccuucuccgcgaugcccaagaccagccugugcuucuacaucguggagcgggaguacugcaaguccugcagcaaggaggacacgcagaagugcgugaacaccaagcuggagcacccccaguccauccucaucgagcacaaggggaccaucaucggcaagcagaacaacacgugcaccgccaagaccagcugcuggcuggaguccgucaagagcuucuucuacggccugaagaacaugcucuccgggaucuucggcaacguguucguggggaucuuccuguuccuggccccguucauccuccugauccuguucuucauguucggcuggcgcauccuguucugcuucaagugcugccggcgcacccggggccucuuccgcuacaagcaccuggaggacgacgaggagaccggguaccggcgcaucaucgagcgccugaacaacaagaagggcaagaacaagcuccuggacggggagcggcuggccgaccgccggaucgccgagcuguucagcaccaagacgcacaucggc

SEQ ID NO: 12472 - RNA, 1932 nt, Artificial Sequence
  derived and/or modified CDS sequence (opt1) from CCHFV(K229_194)__KX013463.1__Gc
uuccuggacagcaucgugaagggcaagaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucaucaaguggaaggucgaguacaucaagaccgaggccaucgugugcguggagcugaccucccaggagcggcagugcagccucaucgaggcgggcacgcgcuucaaccugggccccgucaccaucacccuguccgagccccggaacauccagcagaagcucccgcccgagaucaucacccugcaccccaagaucgaggagggguucuucgaccugaugcacgugcagaaggugcucagcgccuccacggucugcaagcugcagagcugcacccacggcauccccggggaccugcagaucuaccacaucggcaaccuccugaagggcgaccgccugaacgggcaccucauccacaagaucgagccgcacuucaacaccuccuggaugagcugggacggcugcgaccuggacuacuacugcaacaugggggacuggcccuccugcaccuacacgggcgugacccagcacaaccacgccgccuucgugaaccugcucaacaucgagaccgacuacaccaagacguuccacuuccacagcaagcgggucaccgcgcacggggacaccccccagcuggaccugaaggcccgccccaccuacggcgccggcgagaucacggugcucguggaggucgccgacauggagcugcacaccaagaagguggagaucuccgggcugaaguucgccagccucgcgugcaccggcugcuacuccugcagcuccgggaucagcugcaagguccggauccacguggacgagccggacgagcugaccgugcacgucaaguccagcgaccccgacgugguggccgccuccacgagccugauggcccgcaagcucgaguucggcaccgacagcaccuucaaggccuucuccgcgaugcccaagaccagccugugcuucuacaucgucgagcgggaguacugcaaguccugcagcgaggacgacaccaagaagugcguggacacgaagcuggagcagccccaguccauccucaucgagcacaaggggaccaucaucggcaagcagaacgacaccugcaccgccaaggccagcugcuggcuggaguccgugaagagcuucuucuacggccugaagaacaugcucggguccgucuucggcaacuucuucguggggauccugcuguuccucgccccguucgugcugcugguccuguucuucauguucggcuggaagauccucuucugcuucaagugcugccgccggacgcgcgggcuguucaaguaccggcaccugaaggacgacgaggagaccggcuaccgcaagaucaucgagcggcucaacagcaagaagggcaagaaccgccugcuggacggggagcgccucgccgaccggaagaucgcggagcuguucuccaccaagacccacaucggc

SEQ ID NO: 12473 - RNA, 1932 nt, Artificial Sequence
  derived and/or modified CDS sequence (opt1) from CCHFV(K229_243)__KX013466.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcugaccucccaggagcggcagugcagccucaucgaggcgggcacgcgcuucaaccugggccccgugaccaucacccuguccgagccccggaacauccagcagaagcucccgcccgagaucaucacccugcaccccaagguggaggagggguucuucgaccugaugcacguccagaaggugcucagcgccuccacggugugcaagcugcagagcugcacccacggcauccccggggaccugcaggucuaccacaucggcaaccuccugaagggcgaccgcgugaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgucaaccugcugaacaucgagaccgacuacaccaagacguuccacuuccacagcaagcgggugaccgcgcacggggacaccccccagcucgaccugaaggcccgccccaccuacggcgccggcgagaucacgguccugguggagguggccgacauggagcuccacaccaagaaggucgagaucuccgggcugaaguucgccagccuggcgugcaccggcugcuacgccugcuccagcgggaucuccugcaaggugcggauccacguggacgagccggacgagcucaccguccacgugaagagcuccgaccccgacguggucgccgccagcacgucccugauggcccgcaagcuggaguucggcaccgacagcaccuucaaggcguucagcgccaugcccaagaccucccucugcuucuacaucguggagaaggaguacugcaagagcugcuccgaggaggacacccagaagugcguggacacgaagcuggagcagccccagagcauccugaucgagcacaaggggaccaucaucggcaagcagaacgacaccugcaccgccaaggccuccugcuggcucgagagcgucaaguccuucuucuacggccugaagaacaugcuggggagcguguucggcaacuucuucaucgggauccuccuguuccugacgccguucgugcuccugguccuguucuucauguucggcuggaagauccuguucugcuucaagugcugccggcgcacccgggggcuccugaaguaccgccaccugaaggacgacgaggagaccggcuaccggcgcaucaucgagcggcucaacaacaagaagggcaagaaccgccugcuggacggggagcgccucgccgaccggaagaucgcggagcuguucuccaccaagacgcacaucggc

SEQ ID NO: 12474 - RNA, 1932 nt, Artificial Sequence
  derived and/or modified CDS sequence (opt1) from CCHFV(K315_14)__KX013469.1__Gc
uuccuggacagcaucgugaagggcaugaagaagcuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucaucaaguggaaggucgaguacaucaagaccgaggccaucgugugcguggagcugaccucccaggagcggcagugcagccucaucgaggcgggcacgcgcuucaaccugggccccgucaccaucacccuguccgagccccggaacauccagcagaagcucccgcccgagaucaucacccugcaccccaagaucgaggagggguucuucgaccugaugcacgugcagaaggugcucagcgccuccacggucugcaagcugcagagcugcacccacggcauccccggggaccugcagaucuaccacaucggcaaccuccugaagggcgaccgcgugaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgucaaccugcugaacaucgagaccgacuacaccaagacguuccacuuccacagcaagcgggugaccgcgcacggggacaccccccagcucgaccugaaggcccgccccaccuacggcgccggcgagaucacggugcuggucgagguggccgacauggagcuccacaccaagaaggucgagaucuccgggcugaaguucgccagccugaccugcaccggcugcuacgcgugcuccagcgggaucuccugcaaggugcggauccacguggacgagccggacgagcucacgguccacgugaagagcuccgaccccgacguggucgccgccagcaccucccugauggcccgcaagcuggaguucggcaccgacagcaccuucaaggccuucagcgcgaugcccaagaccucccucugcuucuacaucguggagcgggaguacugcaagagcugcuccgaggacgacacgaagaagugcguggacaccaagcuggagcagccccagagcauccugaucgagcacaaggggaccaucaucggcaagcagaacgacaccugcacggccaaggccuccugcuggcucgagagcgucaaguccuucuucuacggccugaagaacaugcuggggagcguguucggcuccuucuucguggggauccuccuguuccuggccccguucguccuccuggugcuguucuucauguucggcuggaagauccuguucugcuucaagugcugccgccggacccgcgggcucuucaaguaccggcaccugaaggacgacgaggagaccggcuaccgccggaucaucgagcgccugaacagcaagaagggcaagaaccgccuccuggacggggagcggcuggccgaccgcaagaucgcggagcucuucuccaccaagacgcacaucggc

SEQ ID NO: 12475 - RNA, 1932 nt, Artificial Sequence
  derived and/or modified CDS sequence (opt1) from CCHFV(K323_27)__KX013472.1__Gc
uuccuggacagcaucgccaagggcaugaagaaccuccugaacuccaccagccuggagaccucccucagcaucgaggcccccuggggggcgaucaacgugcaguccacguucaagccgaccgucagcaccgccaacaucgcccuguccuggagcuccguggagcaccgcggcaacaagauccuggugaccgggcggagcgaguccaucaugaagcucgaggagcgcacgggcgucagcugggaccuggggguggaggacgccuccgagagcaagcugcucaccguguccaucauggaccugagccagauguacucccccgucuucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcguggggaccggcugcacgugcugcggggucgacgugaaggaccuguucaccgaccacauguucaucaaguggaagguggaguacaucaagaccgaggcgaucgucugcguggagcugaccggccaggagcggcagugcucccucaucgaggccggcacgcgcuucaaccuggggcccgugaccaucacccugagcgagccccggaacauccagcagaagcucccgcccgagaucaucacccugcaccccaagaucgaggagggcuucuucgaccugaugcacguccagaaggugcucuccgccagcacggugugcaagcugcaguccugcacccacgggauccccggcgaccugcagaucuaccacaucggcaaccuccugaagggggaccgcgucaacggccaccugauccacaagaucgagccgcacuucaacaccagcuggauguccugggacgggugcgaccucgacuacuacugcaacaugggcgacuggcccagcugcaccuacacgggggugacccagcacaaccacgccgcguucgugaaccugcugaacaucgagaccgacuacaccaagacguuccacuuccacuccaagcgggucaccgcccacggcgacaccccccagcucgaccugaaggcccgccccaccuacggcgccggggagaucacggugcugguggaggucgccgacauggagcuccacaccaagaagguggagaucagcggccugaaguucgcgucccugaccugcaccgggugcuacgccugcagcuccggcaucagcugcaagguccggauccacguggacgagccggacgagcucacggugcacgucaaguccagcgaccccgacgugguggccgccuccaccagccugauggcccgcaagcuggaguucgggaccgacuccaccuucaaggcguucagcgccaugcccaagaccagccucugcuucuacaucgucgagcgggaguacugcaaguccugcagcgaggacgacacgaagaagugcguggacaccaagcuggagcagccccaguccauccugaucgagcacaagggcaccaucaucggcaagcagaacgacaccugcacggccaaggccagcugcuggcucgaguccgugaagagcuucuucuacgggcugaagaacaugcugggcuccgucuucgggagcuucuucgugggcauccuccuguuccuggccccguucgugcuccugguccuguucuucauguucggguggaagauccuguucugcuucaagugcugccgccggacccgcggccucuucaaguaccggcaccugaacgacgacgaggagaccggcuaccgccggaucaucgagcgccugaacuccaagaaggggaagaaccgccuccuggacggcgagcggcuggcggaccgcaagaucgccgagcucuucagcaccaagacgcacaucggg

SEQ ID NO: 12476 - RNA, 1932 nt, Artificial Sequence
  derived and/or modified CDS sequence (opt1) from CCHFV(K340_6)__KX013475.1__Gc
agccuggacuccaucgugaagggcaugaagaaccuccugaacagcaccucccuggagaccagccucuccaucgaggcccccuggggggccaucaacguccagagcacguucaagccgaccguguccaccgcgaacaucgcccugagcugguccagcguggagcaccgcggcaacaagauccuggucaccgggcgguccgagagcaucaugaagcucgaggagcgcacgggcguguccugggaccuggggguggaggacgccagcgaguccaagcugcucaccgucagcaucauggaccugucccagauguacagccccguguucgaguaccuguccggcgaccggcagguggaggaguggcccaaggccaccugcaccggcgacugccccgagcgcugcgggugcacgagcagcaccugccuccacaaggaguggccgcacucccggaacuggcgcugcaaccccaccuggugcuggggcgucgggaccggcugcacgugcugcgggguggacgugaaggaccuguucaccgaccacauguucaucaaguggaaggucgaguacaucaagaccgaggccaucgugugcguggagcugaccagccaggagcggcagugcucccucaucgaggcgggcacgcgcuucaaccugggccccgucaccaucacccugagcgagccccggaacauccagcagaagcucccgcccgagaucaucacccugcaccccaagaucgaggagggguucuucgaccugaugcacgugcagaaggugcucuccgccagcacggucugcaagcugcaguccugcacccacggcauccccggggaccugcagaucuaccacaucggcaaccuccugaagggcgaccgcgugaacgggcaccugauccacaagaucgagccgcacuucaacaccagcuggauguccugggacggcugcgaccucgacuacuacugcaacaugggggacuggcccagcugcaccuacacgggcgugacccagcacaaccacgccgccuucgucaaccugcugaacaucgagaccgacuacaccaagacguuccacuuccacuccaagcgggugaccgcgcacggggacaccccccagcucgaccugaaggcccgccccaccuacggcgccggcgagaucacggugcuggucgaggugaccgacauggagcuccacaccaagaaggucgagaucagcgggcugaaguucgccucccugaccugcacgggcugcuacgccugcagcuccgggaucagcugcaaggugcggauccacguggacgagccggacgagcucaccguccacgugaaguccagcgaccccgacguggucgcggccuccaccagccugauggcccgcaagcuggaguucggcaccgacagcaccuucaaggccuucuccgccaugcccaagacgagccucugcuucuacaucguggagcgggaguacugcaaguccugcagcgaggacgacaccaagaagugcguggacaccaagcuggagcagccccaguccauccugaucgagcacaaggggaccaucaucggcaagcagaacgacacgugcaccgcgaaggccagcugcuggcucgaguccgucaagagcuucuucuacggccugaagaacaugcugggguccguguucggcagcuucuucguggggauccuccuguuccuggccccguucguccuccuggugcuguucuucauguucggcuggaagauccuguucugcuucaagugcugccgccggacccgcgggcucuucaaguaccggcacuucaaggacgacgaggagaccggcuaccgccggaucaucgagcgccugaacuccaagaagggcaagaaccgccugcucgacggggagcggcuggccgaccgcaagaucgccgagcuguucagcacgaagacccacaucggc

SEQ ID NO: 12477 - RNA, 1932 nt, Artificial Sequence
  derived and/or modified CDS sequence (opt1) from CCHFV(Mamon)__KX013478.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcugaccucccaggagcggcagugcagccucaucgaggcgggcacgcgcuucaaccugggccccgugaccaucacccuguccgagccccggaacauccagcagaagcucccgcccgagaucaucacccugcaccccaagguggaggagggguucuucgaccugaugcacguccagaaggugcucagcgccuccacggugugcaagcugcagagcugcacccacggcauccccggggaccugcaggucuaccacaucggcaaccuccugaagggcgaccgcgugaacgggcaccugauccacaagaucgagccgcacuucaacaccuccuggaugagcugggacggcugcgaccucgacuacuacugcaacaugggggacuggcccuccugcaccuacacgggcgugacccagcacaaccacgccgccuucgucaaccugcugaacaucgagaccgacuacaccaagacguuccacuuccacagcaagcgggugaccgcgcacggggacaccccccagcucgaccugaaggcccgccccaccuacggcgccggcgagaucacgguccugguggagguggccgacauggagcuccacaccaagaaggucgagaucuccgggcugaaguucgccagccuggcgugcaccggcugcuacgccugcuccagcgggaucuccugcaaggugcggauccacguggacgagccggacgagcucaccguccacgugaagagcuccgaccccgacguggucgccgccagcacgucccugauggcccgcaagcuggaguucggcaccgacagcaccuucaaggcguucagcgccaugcccaagaccucccucugcuucuacaucguggagcgggaguacugcaagagcugcuccgaggaggacacccagaagugcguggacacgaagcuggagcagccccagagcauccugaucgagcacaaggggaccaucaucggcaagcagaacgacaccugcaccgccaagacguccugcuggcucgagagcgucaaguccuucuucuacggccugaagaacaugcuggggagcguguucggcaacuucuucaucgggauccuccuguuccuggccccguucgugcuccugguccuguucuucauguucggcuggaagauccuguucugcuucaagugcugccgccggacccgcgggcuccugaaguaccggcaccugaaggacgacgaggagaccggcuaccgccggaucaucgagcgccucaacaacaagaagggcaagaaccgccugcuggacggggagcggcucgccgaccgcaagaucgcggagcuguucuccaccaagacgcacaucggc

SEQ ID NO: 12478 - RNA, 1932 nt, Artificial Sequence
  derived and/or modified CDS sequence (opt1) from CCHFV(Min)__KX013481.1__Gc
uuccuggacagcaucgugaagggcaccaagaaccuccugaacuccaccagccuggagacgucccucagcaucgaggcccccuggggcgccaucaacguccaguccaccuucaagccgaccgugagcaccgcgaacaucgcccuguccuggagcuccguggagcaccgcgggaacaagauccuggucacggggcggagcgaguccaucaugaagcucgaggagcgcaccggcgugagcugggaccuggggguggaggacgccuccgagagcaagcugcucaccgucuccaucauggaccugagccagauguacucccccguguucgaguaccugagcggcgaccgccagguggaggaguggcccaaggcgaccugcacgggcgacugccccgagcggugcgggugcaccuccagcacgugccuccacaaggaguggccgcacagccggaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcugaccucccaggagcggcagugcagccucaucgaggccggcacccgcuucaaccugggccccgugaccaucacccuguccgagccccggaacauccagcagaagcucccgcccgagaucaucacgcugcaccccaagguggaggagggguucuucgaccugaugcacguccagaaggugcucagcgccuccaccgugugcaagcugcagagcugcacccacggcauccccggggaccugcaggucuaccacaucggcaaccuccugaagggcgaccgcaucaacgggcaccugauccacaagaucgagccgcacuucaacaccuccuggaugagcugggacggcugcgaccucgacuacuacugcaacaugggggacuggcccuccugcacguacaccggcgugacccagcacaaccacgccgccuucgugaaccugcugaacaucgagaccgacuacacgaagaccuuccacuuccacagcaagcgggucaccgcgcacggggacacgccccagcucgaccugaaggcccgccccaccuacggcgccggcgagaucaccgugcuggucgagguggccgacauggagcuccacaccaagaagguggagaucuccgggcugaaguucgccagccuggcgugcaccggcugcuacgccugcuccagcgggaucuccugcaagguccggauccacguggacgagccggacgagcucacggugcacgucaagagcuccgaccccgacgugguggccgccagcaccucccugauggcccgcaagcuggaguucggcaccgacagcaccuucaaggcguucagcgccaugcccaagaccucccucugcuucuacaucgucgagcgggaguacugcaagagcugcuccgaggaggacacgcagaagugcguggacaccaagcuggagcagccccagagcauccugaucgagcacaaggggaccaucaucggcaagcagaacgacacgugcaccgccaaggccuccugcuggcucgagagcgugaaguccuucuucuacggccugaagaacaugcuggggagcgucuucggcaacuucuucaucgggauccuccuguuccuggccccguucgugcuccuggugcuguucuucauguucggcuggaagauccuguucugcuucaagugcugccgccggacccgcgggcuccugaaguaccggcaccugaaggacgacgaggagaccggcuaccgccggaucaucgagcgccucaacaacaagaagggcaagaaccgccugcuggacggggagcggcucgcggaccgcaagaucgccgagcuguucuccaccaagacgcacaucggc

SEQ ID NO: 12479 - RNA, 1932 nt, Artificial Sequence
  derived and/or modified CDS sequence (opt1) from CCHFV(Nakiwogo)__KX013484.1__Gc
uaccuggacagcaucgccaagggcaugaagucccuccugaacagcaccaaccuggagaccucccucagcaucgaggcccccuggggcgcgaucaacgugcaguccacguucaagccgaccgugagcgccgccaacaucgcccuguccuggagcuccguggagcaccgcgggaacaagauccuggugagcgggcgguccgagagcaucaugaagcucgaggagcgcaccggcaucuccuggagccugggggucgaggacgccuccgagagcaagacccugacgguguccgugauggaccucagccagauguacucccccgucuucgaguaccugagcggcgaccgccagguggaggaguggcccaaggcgaccugcaccggcgacugccccgagcggugcgggugcaccagcuccacgugccugcacaaggaguggccgcacagccggaacuggcgcugcaaccccaccuggugcuggggcguggggaccggcugcacgugcugcgggcucgacguccgggaccuguucaccgacuacaugauggugaaguggaagguggaguacgucaagaccgaggccaucaugugcguggagcugaccucccaggagcgccagugcagccucaucgaggccggcacccgguucaaccugggccccgugacgaucacccuguccgagccccgcaacguccagcagcggcucccgagcgagaucgugacccugcaccccaagaucgaggagggguucuucgaccugaugcacgugcagaagguccucuucugcaagcacucccugcaggccaccagcugcacgcacggcgugcccggggaccuccagguguaccacgucggcaaccuccugaagggcgacaaggugaacgggcacuccauccacaagaucgagagccacuucaacaccuccuggaugagcugggacggcugcgaccuggacuacuucugcaacaugggggacuggcccuccugcaccuacaccggcgugacgcagcacaaccgcgcggccuucgucaacaugcucaacaucgagaccgacuacaccaagaccuuccacuuccacagcaagcgggugacggcccacggggacaccccgcagcuggaccugaaggcccgccccaccuacggcgccggcgaggucaccgugcucguggaggucgcggaccuggagcugcacacgaagaagaucgagguguccgggcucaaguucgccagccugaccugcuccggcugcuacgccugcagcuccgggaucagcugcaaggugcggauccacgucaacgagcccgacgaguucaccgugcacgucaagagcaacgaccccgacgugguggccgccggcuccagccugauggcgcgcaagaucgagcucggggccgacuccaccuucaaggccuucagcuccaugccgaagaacagccugugcuucuacaucguggagcgggacuacugcuccagcugcacggacgacgacacccagaagugcgucaacaccaagcuggagcacccccaguccauccucaucgagcacaagggcaccaucaucggcaagcagaacgacacgugccccaccaagaccagcugcuggcuggaguccgucaagagcuucuucuacgggcugaagaacaugcucggcgggaucuucggcaacguguuccuggggaucuuccuguuccucgcccccuucgcccugcugauccucuucuucuucuucggcuggcgccugcuguucugccugaagugcugccggcgcacccggggccuccugaaguacaagcagcugaaggacgaggaggaggcgggguacaagaagaucaucgagcgccucaacgacaagaagggcaagucccgccuguucgacggggagcggcuggccgaccgcaagaucgccgagcuguucagcaccaagacgcacaucggc

SEQ ID NO: 12480 - RNA, 1932 nt, Artificial Sequence
  derived and/or modified CDS sequence (opt1) from CCHFV(Saf)__KX013487.1__Gc
uucagcgacuccaucgugaagggcaugaagaaccugcucaacagcaccucccuggagaccagccuguccaucgaggcccccuggggggccaucaacguccagagcacguucaagccgaccguguccaccgcgaacaucgcccucagcugguccagcguggagcaccgcggcaacaagauccuggucaccgggcgguccgagagcaucaugaagcuggaggagcgcacgggcguguccugggaccucgggguggaggacgccagcgaguccaagcugcugaccgucagcaucauggaccucucccagauguacagccccguguucgaguaccuguccggcgaccggcagguggaggaguggcccaaggccaccugcaccggcgacugccccgagcgcugcgggugcacgagcagcaccugccugcacaaggaguggccgcacucccggaacuggcgcugcaaccccaccuggugcuggggcgucgggaccggcugcacgugcugcgggguggacgugaaggaccucuucaccgaccacauguucgucaaguggaagguggaguacaucaagaccgaggccaucgugugcgucgagcugaccagccaggagcggcagugcucccugaucgaggcgggcacgcgcuucaaccucggccccgugaccaucacccugagcgagccccggaacauccagcagaagcugccgcccgagaucaucacccuccaccccaagguggaggagggguucuucgaccugaugcacguccagaaggugcuguccgccagcacggugugcaagcuccaguccugcacccacggcauccccggggaccugcaggucuaccacaucggcaaccugcucaagggcgaccgcgugaacgggcaccugauccacaagaucgagccgcacuucaacaccagcuggauguccugggacggcugcgaccuggacuacuacugcaacaugggggacuggcccagcugcaccuacacgggcgugacccagcacaaccacgccgccuucgucaaccuccugaacaucgagaccgacuacaugaagaccuuccacuuccacuccaagcgggugacggcgcacggggacaccccccagcuggaccucaaggcccgccccaccuacggcgccggcgagaucaccguccugguggagguggccgacauggagcugcacacgaagaaggucgagaucagcgggcucaaguucgugucccuggccugcaccggcugcuacgcgugcagcuccgggaucagcugcaaggugcggauccacgucgacgagccggacgagcugaccgugcacgugaaguccagcgaccccgacgucguggccgccuccaccagccucauggcccgcaagcuggaguucggcacggacagcaccuucaaggccuucuccgcgaugcccaagaccagccugugcuucuacaucguggagcgggaguacugcaaguccugcagcgaggaggacacccagaagugcgucgacaccaagcucgagcagccccaguccauccugaucgagcacaaggggacgaucaucggcaagcagaacgacaccugcaccgccaaggccagcugcuggcuggaguccgugaagagcuucuucuacggccucaagaacaugcugggguccguguucggcaacuucuucaucgggauccugcucuuccuggccccguucguccugcucgugcuguucuucauguucggcuggaagauccuguucugcuucaagugcugccgccggacccgcgggcugcucaaguaccggcaccugaaggacgacgaggagacgggcuaccgccggaucaucgagcgccugaacaacaagaagggcaagaaccgccuccuggacggggagcggcuggccgaccgcaagaucgcggagcucuucagcaccaagacccacaucggc

SEQ ID NO: 12481 - RNA, 1932 nt, Artificial Sequence
  derived and/or modified CDS sequence (opt1) from CCHFV(Ast199)__KX056051.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucaucaaguggaaggucgaguacaucaagaccgaggccaucgugugcguggagcugaccucccaggagcggcagugcagccucaucgaggcgggcacgcgcuucaaccugggccccgucaccaucacccuguccgagccccggaacauccagcagaagcucccgcccgagaucaucacccugcaccccaagaucgaggagggguucuucgaccugaugcacgugcagaaggugcucagcgccuccacggucugcaagcugcagagcugcacccacggcauccccggggaccugcagaucuaccacaucggcaaccuccugaagggcgaccgccugaacgggcaccucauccacaagaucgagccgcacuucaacaccuccuggaugagcugggacggcugcgaccuggacuacuacugcaacaugggggacuggcccuccugcaccuacacgggcgugacccagcacaaccacgccgccuucgugaaccugcucaacaucgagaccgacuacaccaagacguuccacuuccacagcaagcgggucaccgcgcacggggacaccccccagcuggaccugaaggcccgccccaccuacggcgccggcgagaucacggugcucguggaggucgccgacauggagcugcacaccaagaagguggaggucuccgggcugaaguucgccagccucgcgugcaccggcugcuacgccugcuccagcgggaucuccugcaaggugcggauccacguggacgagccggacgagcugaccguccacgugaagagcuccgaccccgacguggucgccgccagcacgucccugauggcccgcaagcucgaguucggcaccgacagcaccuucaaggcguucagcgccaugcccaagaccucccugugcuucuacaucguggagcgggaguacugcaagagcugcuccgaggacgacaccaagaagugcguggacacgaagcuggagcagccccagagcauccucaucgagcacaaggggaccaucaucggcaagcagaacgacaccugcaccgccaaggccuccugcuggcuggagagcgucaaguccuucuucuacggccugaagaacaugcucgggagcguguucggcaacuucuucguggggauccugcuguuccucgccccguucguccugcuggugcuguucuucaucuucggcuggaagauccucuucugcuucaagugcugccgccggacgcgcgggcuguucaaguaccggcaccugaaggacgacgaggagaccggcuaccgcaagaucaucgagcggcucaacuccaagaagggcaagaaccgccugcuggacggggagcgccucgcggaccggaagaucgccgagcuguucagcaccaagacccacaucggc

SEQ ID NO: 12482 - RNA, 1932 nt, Artificial Sequence
  derived and/or modified CDS sequence (opt1) from CCHFV(Ast149)__KX056054.1__Gc
uuccuggacagcaucgugaagggcaugaagaaccuccugaacuccaccagccuggagaccucccucagcaucgaggcccccuggggggccaucaacguccaguccacguucaagccgaccgugagcaccgcgaacaucgcccuguccuggagcuccguggagcaccgcggcaacaagauccuggucaccgggcggagcgaguccaucaugaagcucgaggagcgcacgggcgugagcugggaccuggggguggaggacgccuccgagagcaagcugcucaccgucuccaucauggaccugagccagauguacucccccguguucgaguaccugagcggcgaccggcagguggaggaguggcccaaggccaccugcaccggcgacugccccgagcgcugcgggugcacguccagcaccugccuccacaaggaguggccgcacagccggaacuggcgcugcaaccccaccuggugcuggggcgucgggaccggcugcacgugcugcgggguggacgugaaggaccuguucaccgaccacauguucaucaaguggaaggucgaguacaucaagaccgaggccaucgugugcguggagcugaccucccaggagcggcagugcagccucaucgaggcgggcacgcgcuucaaccugggccccgucaccaucacccuguccgagccccggaacauccagcagaagcucccgcccgagaucaucacccugcaccccaagaucgaggagggguucuucgaccugaugcacgugcagaaggugcucagcgccuccacggucugcaagcugcagagcugcacccacggcauccccggggaccugcagaucuaccacaucggcaaccuccugaagggcgaccgccugaacgggcaccucauccacaagaucgagccgcacuucaacaccuccuggaugagcugggacggcugcgaccuggacuacuacugcaacaugggggacuggcccuccugcaccuacacgggcgugacccagcacaaccacgccgccuucgugaaccugcucaacaucgagaccgacuacaccaagacguuccacuuccacagcaagcgggucaccgcgcacggggacaccccccagcuggaccugaaggcccgccccaccuacggcgccggcgagaucacggugcucguggaggucgccgacauggagcugcacaccaagaagguggaggucuccgggcugaaguucgccagccucgcgugcaccggcugcuacgccugcuccagcgggaucuccugcaaggugcggauccacguggacgagccggacgagcugaccguccacgugaagagcuccgaccccgacguggucgccgccagcacgucccugauggcccgcaagcucgaguucggcaccgacagcaccuucaaggcguucagcgccaugcccaagaccucccugugcuucuacaucguggagcgggaguacugcaagagcugcuccgaggacgacaccaagaagugcguggacacgaagcuggagcagccccagagcauccucaucgagcacaaggggaccaucaucggcaagcagaacgacaccugcaccgccaaggccuccugcuggcuggagagcgucaaguccuucuucuacggccugaagaacaugcucgggagcguguucggcaacuucuucguggggauccugcuguuccucgccccguucguccugcuggcgcuguucuucaucuucggcuggaagauccucuucugcuucaagugcugccgccggacgcgcgggcuguucaaguaccggcaccugaaggacgacgaggagaccggcuaccgcaagaucaucgagcggcucaacuccaagaagggcaagaaccgccugcuggacggggagcgccucgccgaccggaagaucgccgagcuguucagcaccaagacccacaucggc

SEQ ID NO: 12483 - RNA, 1932 nt, Artificial Sequence
  derived and/or modified CDS sequence (opt1) from CCHFV(Ast137)__KX056057.1__Gc
uuccuggacagcaucgugaagggcaccaagaaccuccugaacuccaccagccuggagacgucccucagcaucgaggcccccuggggcgccaucaacguccaguccaccuucaagccgaccgugagcaccgcgaacaucgcccuguccuggagcuccguggagcaccgcgggaacaagauccuggucacggggcggagcgaguccaucaugaagcucgaggagcgcaccggcgugagcugggaccuggggguggaggacgccuccgagagcaagcugcucaccgucuccaucauggaccugagccagauguacucccccguguucgaguaccugagcggcgaccgccagguggaggaguggcccaaggcgaccugcacgggcgacugccccgagcggugcgggugcaccuccagcacgugccuccacaaggaguggccgcacagccggaacuggcgcugcaaccccaccuggugcuggggcgucgggaccggcugcacgugcugcgggguggacgugaaggaccuguucaccgaccacauguucaucaaguggaaggucgaguacaucaagaccgaggccaucgugugcguggagcugaccucccaggagcggcagugcagccucaucgaggccggcacccgcuucaaccugggccccgucaccaucacccuguccgagccccggaacauccagcagaagcucccgcccgagaucaucacgcugcaccccaagaucgaggagggguucuucgaccugaugcacgugcagaaggugcucagcgccuccaccgucugcaagcugcagagcugcacccacggcauccccggggaccugcagaucuaccacaucggcaaccuccugaagggcgaccgccugaacgggcaccucauccacaagaucgagccgcacuucaacaccuccuggaugagcugggacggcugcgaccuggacuacuacugcaacaugggggacuggcccuccugcacguacaccggcgugacccagcacaaccacgccgccuucgugaaccugcucaacaucgagaccgacuacacgaagaccuuccacuuccacagcaagcgggucaccgcgcacggggacacgccccagcuggaccugaaggcccgccccaccuacggcgccggcgagaucaccgugcucguggaggucgccgacauggagcugcacaccaagaagguggaggucuccgggcugaaguucgccagccucgcgugcaccggcugcuacgccugcuccagcgggaucuccugcaaggugcggauccacguggacgagccggacgagcugacgguccacgucaagagcuccgaccccgacgugguggccgccagcaccucccugauggcccgcaagcucgaguucggcaccgacagcaccuucaaggcguucagcgccaugcccaagaccucccugugcuucuacaucguggagcgggaguacugcaagagcugcuccgaggacgacacgaagaagugcguggacaccaagcuggagcagccccagagcauccucaucgagcacaaggggaccaucaucggcaagcagaacgacacgugcaccgccaaggccuccugcuggcuggagagcgucaaguccuucuucuacggccugaagaacaugcucgggagcguguucggcaacuucuucguggggauccugcuguuccucgccccguucguccugcuggugcuguucuucaucuucggcuggaagauccucuucugcuucaagugcugccgccggacccgcgggcuguucaaguaccggcaccugaaggacgacgaggagaccggcuaccgcaagaucaucgagcggcucaacuccaagaagggcaagaaccgccugcuggacggggagcgccucgcggaccggaagaucgccgagcuguucagcaccaagacgcacaucggc

SEQ ID NO: 12484 - RNA, 1932 nt, Artificial Sequence
  derived and/or modified CDS sequence (opt1) from CCHFV(Ast133)__KX056060.1__Gc
uucagcgacuccaucgugaagggcaugaagaaccugcucaacagcaccucccuggagaccagccuguccaucgaggcccccuggggggccaucaacguccagagcacguucaagccgaccguguccaccgcgaacaucgcccucagcugguccagcguggagcaccgcggcaacaagauccuggucaccgggcgguccgagagcaucaugaagcuggaggagcgcacgggcguguccugggaccucgggguggaggacgccagcgaguccaagcugcugaccgucagcaucauggaccucucccagauguacagccccguguucgaguaccuguccggcgaccggcagguggaggaguggcccaaggccaccugcaccggcgacugccccgagcgcugcgggugcacgagcagcaccugccugcacaaggaguggccgcacucccggaacuggcgcugcaaccccaccuggugcuggggcgucgggaccggcugcacgugcugcgggguggacgugaaggaccucuucaccgaccacauguucaucaaguggaaggucgaguacaucaagaccgaggccaucgugugcguggagcugaccagccaggagcggcagugcucccugaucgaggcgggcacgcgcuucaaccucggccccgucaccaucacccugagcgagccccggaacauccagcagaagcugccgcccgagaucaucacccuccaccccaagaucgaggagggguucuucgaccugaugcacgugcagaaggugcuguccgccagcacggucugcaagcuccaguccugcacccacggcauccccggggaccugcagaucuaccacaucggcaaccugcucaagggcgaccgcgugaacgggcaccugauccacaagaucgagccgcacuucaacaccagcuggauguccugggacggcugcgaccuggacuacuacugcaacaugggggacuggcccagcugcaccuacacgggcgugacccagcacaaccacgccgccuucgucaaccuccugaacaucgagaccgacuacaccaagacguuccacuuccacuccaagcgggugaccgcgcacggggacaccccccagcuggaccucaaggcccgccccaccuacggcgccggcgagaucacggugcuggucgagguggccgacauggagcugcacaccaagaaggucgagaucagcgggcucaaguucgccucccugaccugcaccggcugcuacgcgugcagcuccgggaucagcugcaaggugcggauccacguggacgagccggacgagcugacgguccacgugaaguccagcgaccccgacguggucgccgccuccaccagccucauggcccgcaagcuggaguucggcaccgacagcaccuucaaggccuucuccgcgaugcccaagaccagccugugcuucuacaucguggagcgggaguacugcaaguccugcagcgaggacgacacgaagaagugcguggacaccaagcucgagcagccccaguccauccugaucgagcacaaggggaccaucaucggcaagcagaacgacaccugcacggccaaggccagcugcuggcuggaguccgucaagagcuucuucuacggccucaagaacaugcugggguccguguucggcagcuucuucguggggauccugcucuuccuggccccguucguccugcucgugcuguucuucauguucggcuggaagauccuguucugcuucaagugcugccgccggacccgcgggcuguucaaguaccggcaccucaaggacgacgaggagaccggcuaccgccggaucaucgagcgccugaacuccaagaagggcaagaaccgccugcucgacggggagcggcuggccgaccgcaagaucgcggagcuguucagcuccaagacccacaucggc

SEQ ID NO: 12485 - RNA, 1932 nt, Artificial Sequence
  derived and/or modified CDS sequence (opt1) from CCHFV(SK/2015/human)__KX458183.1__Gc
uuccuggacagcaucgugcgcggcaugaagaaccuccugaacuccaccagccuggagaccucccucagcaucgaggcccccuggggggccaucaacguccaguccacguacaagccgaccgugagcaccgcgaacaucgcccuguccuggagcuccguggagcaccggggcaacaagauccuggucagcgggcgcuccgagagcaucaugaagcucgaggagcggaccggcguguccugggaccuggggguggaggacgccagcgaguccaagcugcucacggucagcgugauggaccugucccagauguacagccccguguucgaguaccuguccggcgaccgccaggucgaggaguggcccaaggccaccugcaccggcgacugccccgagcggugcgggugcaccacgagcaccugccuccacaaggaguggccgcacagccgcaacuggcggugcaaccccaccuggugcuggggcguggggaccggcugcacgugcugcgggcuggacgugaaggaccuguucaccgacuacauguucgucaaguggaagguggaguacaucaagaccgaggccaucgugugcgucgagcucaccucccagggccgccagugcagccugaucgaggcgggcacgcgguucaaccugggguccgugaccaucacccucagcgagccccgcaacauccagcacaagcugcccccggagaucaucacccugcacccccggaucgaggagggcuucuucgaccucaugcacgugcagaagguccuguccgccagcacggugugcaagcugcaguccugcacccacggggugcccggcgaccuccaggucuaccacaucggcaaccugcugaagggggacaaggugaacggccaccucauccacaagaucgagccccacuucaacaccagcuggauguccugggacgggugcgaccuggacuacuacugcaacaugggcgacuggccgagcugcaccuacacgggggugacccagcacaaccacgccuccuucgucaaccugcucaacaucgagaccgacuacaccaagaacuuccacuuccacagcaagcgcgugacggcccacggcgacaccccccagcuggaccugaaggcgcggcccaccuacggcgccggggagaucaccguccucguggagguggccgacauggagcugcacacgaagaagaucgagaucuccggccugaaguucgccagccucaccugcaccgggugcuacgccugcuccagcggcaucuccugcaagguccgcauccacguggacgagcccgacgagcugaccgugcacgucaagagcgacgacccggacgugguggcggccuccagcagccugauggcccggaagcucgaguucgggacggacuccaccuucaaggccuucagcgccaugcccaagaccucccugugcuucuacaucgucgagcgcgaguacugcaagagcugcuccaaggaggacacccagaagugcgugaacaccaagcuggagcagccccagagcauccucaucgagcaccggggcacgaucaucggcaagcagaacaacaccugcaucgcgaaggccuccugcuggcuggagagcgugaaguccuucuucuacgggcugaagaacaugcucagcggcaucuucgggaaccuguuccugggcaucuuccucuuccuggcccccuucauccugcugauccucuucuucauguucggguggcgcauccuguucugcuucaagugcugccggcgcacccggggccuguucaaguaccgccaccucaaggacgacgaggagaccggcuaccgccggaucaucgagcgccugaacaacaagaaggggaagaacaagcugcucgacggcgagcggcuggccgaccgccggaucgccgagcuguucuccacgaagacccacaucggg

SEQ ID NO: 12486 - RNA, 1932 nt, Artificial Sequence
  derived and/or modified CDS sequence (opt1) from CCHFV(YL16070)__KY354081.1__Gc
uuccuggacagcaucgccaagggcaugaagucccuccugaacagcaccucccuggagaccagccucuccaucgaggcccccuggggcgcgaucaacgugcagagcacguucaagccgaccgucuccgccgccaacaucgcccugagcugguccagcguggagcaccgcgggaacaagauccugguguccgggcggagcgaguccaucaugaagcucgaggagcgcaccggcgucagcuggaaccuggggguggaggacgccuccgagagcaagacccugacgguguccgucauggaccucagccagauguacucccccguguucgaguaccugagcggcgaccgccagguggaggaguggcccaaggcgaccugcaccggcgacugccccgagcggugcgggugcaccagcuccacgugccugcacaaggaguggccgcacagccggaacuggcgcugcaaccccaccuggugcuggggcgucgggaccggcugcacgugcugcgggcucgacgugaaggacuucuucaccgacuacaugcuggugaaguggaaggucgaguacaucaagaccgaggccaucgugugcguggagcugaccucccaggagcggcagugcagccucaucgaggccggcacccgcuucaaccugggccccgucacgaucacccuguccgagccccggaacgugcagcagcgccucccgcccgagaucgugacccugcaccccaagaucgaggagggguucuucgaccugaugcacguccagaagauccucagcgccuccaccgugugcaagcugcagagcugcacgcacggcgugcccggggacuuccaggucuaccacgugggcaaccugcuccggggcgacaaggugaacgggcacuccauccacaagaucgagccgcacuucaacaccagcuggauguccugggacggcugcgaccuggacuacuucugcaacaugggggacuggcccagcugcaccuacaccggcgucacgcagcacaaccgcgcggccuucaucaacaugcugaacaucgagaccgacuacaccaagaccuuccacuuccacuccaagcgggugacggcccacggggacacgccccagcucgaccugaaggcccgccccgccuacggcgcgggcgaggucaccgugcugguggaggucgccgaccucgagcugcacaccaagaagcuggaggugagcgggcucaagaucgccucccugaccugcagcggcugcuacgccugcuccagcgggaucuccugcaaggugcggauccacgucaacgagccggacgaguucaccgugcacgugcgcagcagcgaccccgacgucguggccgcgggcuccagccugauggcccggaagaucgaguucggggccgacuccaccuucaaggccuucagcuccaugcccaaggacagccucugcuucuacaucguggagaaggacuacugcuccagcugcaccgacgacgacacgcagaagugcgucaacaccaagcuggaccacccccaguccauccugaucgagcacaagggcaccaucaucggcaagcagaacgacacgugcagcaccaagaccuccugcuggcucaagagcuucaagggguucuucuacggccugaagaacaugcuguccgggaucuucggcaacguguuccucgggauccugcuguuccucgccccguucgugcugcugaucuucuucuucuucuucggcuggcgccuccuguucugccugaagugcugcaagaagaccaagggccugcucaaguacaagcaccugaaggacaaggaggaggcgggguacaagaagaucaucgagcggcugaacggcaagaagggcaagagccagcuguucgacggggagcgccucgccaaccggaagaucgccgagcuguucuccaccaagauccacaucggc

SEQ ID NO: 12487 - RNA, 1932 nt, Artificial Sequence
  derived and/or modified CDS sequence (opt1) from CCHFV(Oman_812956)__KY362518.1__Gc
uucuucgacagcaucgccaagggcaugaagaaccugcucaacuccaccagccuggagaccucccugagcaucgaggcccccuggggcgcgaucaacgugcaguccacguucaagccgaccgugagcaccgccaacaucgcccucuccuggagcuccguggagcaccgcgggaacaagauccuggugagcgggcgguccgagagcaucaugaagcuggaggagcgcaccggcaucuccugggaccucggggucgaggacgccagcgaguccaagcugcugacggugagcgugauggaccucucccagauguacagccccgucuucgaguaccuguccggcgaccgccagguggaggaguggcccaaggcgaccugcaccggcgacugccccgagcggugcgggugcaccagcagcacgugccugcacaaggaguggccgcacucccggaacuggcgcugcaaccccaccuggugcuggggcguggggaccggcugcacgugcugcgggcucgacgucaaggaccuguucaccgacuacauguucgugaaguggaagguggaguacaucaagaccgaggccaucgucugcguggagcugaccagccaggagcggcagugcucccucaucgaggccggcacccgcuucaaccugggccccgugacgaucacccugagcgagccccggaacauccagcagaagcucccgcccgagaucgucacccugcacccccgcaucgaggagggguucuucgaccugaugcacgugcagaaggugcucuccgccagcaccgucugcaagcugcaguccugcacgcacggcgugcccggggaccuccagguguaccacaucggcaaccugcugaagggcgacaaggucaacgggcaccugauccacaagguggagccgcacuucaacaccagcuggauguccugggacggcugcgaccucgacuacuacugcaacaugggggacuggcccagcugcaccuacaccggcgugacgcagcacaaccacgccgcguucgucaaccugcugaacaucgagaccgacuacaccaagaacuuccacuuccacuccaagcgggugaccgcccacggggacacgccccagcucgaccugaaggcccgccccaacuacggcgccggcgagaucaccguccugguggagguggccgacauggagcuccacaccaagaagaucgagaucagcgggcugaaguucgcgucccugaccugcacgggcugcuacgccugcagcuccgggaucagcugcaagguccggauccacguggacgagccggacgagcucaccgugcacgucaaguccgaggaccccgacaucguggccgccagcuccagccugauggcccgcaagcuggaguucggcaccgacagcaccuucaaggcguucuccgccaugcccaagacgagccucugcuucuacaucguggagcgggaguacugcaaguccugcagcaaggaggacacccagaagugcgucaacgccaagcuggagcgcccccaguccauccugaucgagcacaaggggaccaucaucggcaagcagaacgacacgugcaccgccaaggccagcugcuggcucgaguccgucaagagcuucuucuacggccugaagaacaugcuguccgggaucuucggcaacguguucaucgggaucuuccucuuccuggcgccguucauccugcucauccuguucuucauguucggcuggcggauccuguucugcuucaagugcugccgccggacccgcgggcuguucaaguaccggcaccucaaggacgacgaggagaccggcuaccgcaagaucaucgagcgccugaacaacaagaagggcaagaacaagcugcucgacggggagcggcuggccgaccgcaagaucgccgagcuguucagcaccaagacccacaucggc

SEQ ID NO: 12488 - RNA, 1932 nt, Artificial Sequence
  derived and/or modified CDS sequence (opt1) from CCHFV(UCCR4405)__KY484029.1__Gc
uuccucgacagcaccgugaagggcaugaagaaccuccugaacuccaccagccuggagacgucccucagcaucgaggcccccuggggcgccaucaacguccaguccaccuucaagccgaccgugagcaccgcgaacaucgcccuguccuggagcuccguggagcaccgcgggaacaagauccuggucacggggcggagcgaguccaucaugaagcucgaggagcgcaccggcgugagcugggaccuggggguggaggacgccuccgagagcaagcugcucaccgucuccaucauggaccugagccagauguacucccccguguucgaguaccugagcggcgaccgccagguggaggaguggcccaaggcgaccugcacgggcgacugccccgagcggugcgggugcaccuccagcacgugccuccacaaggaguggccgcacagccggaacuggcgcugcaaccccaccuggugcuggggcgucgggaccggcugcacgugcugcgggguggacgugaaggaccuguucaccgaccacauguucgucaaguggaagguggaguacaucaagaccgaggccaucgugugcgucgagcugaccucccaggagcggcagugcagccucaucgaggccggcacccgcuucaaccugggccccgugaccaucacccuguccgagccccggaacauccagcagaagcucccgcccgagaucaucacgcugcaccccaagaucgaggagggguucuucgaccugaugcacgugcagaagguccucagcgccuccaccgugugcaagcugcagagcugcacccacggcauccccggggaccugcagaucuaccacaucggcaaccuccugaagggcgaccgcgugaacgggcaccugauccacaagaucgagccgcacuucaacaccuccuggaugagcugggacggcugcgaccucgacuacuacugcaacauggggaacuggcccuccugcacguacaccggcgucacccagcacaaccacgccgccuucgugaaccugcugaacaucgagaccgacuacacgaagaccuuccacuuccacagcaagcgggugaccgcgcacggggacacgccccagcucgaccugaaggcccgccccaccuacggcgccggcgagaucaccguccugguggaggucgccgacauggagcuccacaccaagaagguggagaucuccgggcugaaguucgccagccuggugugcaccggcugcuacgcgugcuccagcgggaucuccugcaagguccggauccacguggacgagccggacgagcucacggugcacgucaagagcuccgaccccgacgugguggccgccagcaccucccugauggcccgcaagcuggaguucggcaccgacagcaucuucaaggccuucagcgcgaugcccaagaccucccucugcuucuacaucgucgagcgggaguacugcaagagcugcuccgaggacgacaccaagaagugcguggacacgaagcuggagcagccccagagcauccugaucgagcacaaggggaccaucaucggcaagcagaacgacacgugcaccgccaaggccuccugcuggcucgagagcgugaaguccuucuucuacggccugaagaacaugcuggggagcgucuucggcaacuucuucguggggauccuccuguuccuggccccguucgugcuccugguccuguucuucauguucggcuggaagauccuguucugcuucaagugcugccgccggacccgcggccucuucaaguaccggcaccugaaggacgacgaggagaccggguaccgccggaucaucgagcgccugaacuccaagaagggcaagaaccgccuccuggacggggagcggcuggccgaccgcaagaucgcggagcuguucagcaccaagacccacaucggc

SEQ ID NO: 12489 - RNA, 1932 nt, Artificial Sequence
  derived and/or modified CDS sequence (opt1) from CCHFV(UCCR4401)__KY484035.1__Gc
uuccuggacagcaccgccaagggcaugaagaaccuccugaacuccaccagccuggagacgucccucagcaucgaggcccccuggggggcgaucaacgugcaguccaccuacaagccgaccgucagcaccgccaacaucgcccuguccuggagcuccguggagcaccgcggcaacaagauccuggugagcgggcgguccgagagcaucaugaagcucgaggagcgcacgggcaucuccugggaccugggggucgaggacgccagcgaguccaagcugcucaccgugagcgugauggaccugucccagauguacagccccgucuucgaguaccuguccggcgaccggcagguggaggaguggcccaaggccaccugcaccggcgacugccccgagcgcugcgggugcacgagcagcaccugccuccacaaggaguggccgcacucccggaacuggcgcugcaaccccaccuggugcuggggcguggggaccggcugcacgugcugcgggcuggacgucaaggaccuguucaccgacuacauguucgugaaguggaagguggaguacaucaagaccgaggcgaucgucugcguggagcucaccagccaggagcggcagugcucccugaucgaggccggcacgcgcuucaaccugggccccgugaccaucacccucagcgagccccggaacauccagcagaagcugccgcccgagaucaucacccugcacccccgcaucgaggagggguucuucgaccucaugcacguccagaaggugcuguccgccagcacggugugcaagcugcaguccugcacccacggcguccccggggaccuccagguguaccacaucggcaaccugcugaagggcgacaaggugaacgggcaccucauccacaagaucgagccgcacuucaacaccagcuggauguccugggacggcugcgaccuggacuacuacugcaacaugggggacuggcccagcugcaccuacacgggcgucacccagcacaaccacgccuccuucgugaaccugcucaacaucgagaccgacuacaccaagaacuuccacuuccacagcaagcgggugacggcgcacggggacaccccccagcuggaccugaaggcccgccccaccuacggcgccggcgagaucaccguccucguggaggucgccgacauggagcugcacacgaagaagaucgagaucuccgggcugaaguucgccagccucgcgugcaccggcugcuacgccugcuccagcgggaucuccugcaaggugcggauccacguggacgagccggacgagcugaccguccacgugaagagcgacgaccccgacguggucgccgccuccagcagccugauggcccgcaagcucgaguucggcaccgacuccacguucaaggcguucagcgccaugcccaagaccucccugugcuucuacaucguggagcgggagcacugcaagagcugcuccgaggaggacaccaagaagugcgugaacaccaagcuggagcagccccagagcauccucaucgagcacaaggggaccaucaucggcaagcagaacuccacgugcaccgccaaggccagcugcuggcuggaguccgucaagagcuucuucuacggccugaagaacaugcucuccgggaucuucggcaacguguucauggggaucuuccuguuccuggccccguucauccuccugauccuguucuucauguucggcuggcgcauccuguucugcuucaagugcugccggcgcacccgggggcucuucaaguaccgccaccugaaggacgacgaggagaccggcuaccggcgcaucaucgagaagcugaacaacaagaagggcaagaacaagcuccuggacggggagcgccuggcggaccggcgcaucgccgagcucuucagcacgaagacccacaucggc

SEQ ID NO: 12490 - RNA, 1932 nt, Artificial Sequence
  derived and/or modified CDS sequence (opt1) from CCHFV(UCCR4448)__KY484042.1__Gc
uuccucgacagcaucgugaagggcaugaagaaccuccugaacuccaccagccuggagaccucccucagcaucgaggcccccuggggcgccaucaacgugcaguccacguacaagccgaccgugagcaccgcgaacaucgcccuguccuggagcuccguggagcaccgcgggaacaagauccuggucagcgggcgguccgagagcaucaugaagcucgaggagaagaccggcaucuccugggaccuggggguggaggacgccagcgaguccaagcugcucacggugagcgucauggaccugucccagauguacagccccguguucgaguaccuguccggcgaccgccagguggaggaguggcccaaggcgaccugcaccggcgacugccccgagcggugcgggugcaccagcagcacgugccuccacaaggaguggccgcacucccgcaacuggcggugcaaccccaccuggugcuggggcgucgggaccggcugcacgugcugcgggcuggacgugaaggaccuguucaccgacuacauguucgugaaguggaaggucgaguacaucaagaccgaggccaucgugugcguggagcucaccagccaggagcgccagugcucccugaucgaggccggcacccgguucaaccugggccccgucacgaucacccucagcgagccccgcaacauccagcagaagcugccgcccgagaucaucacccugcacccccggaucgaggagggguucuucgaccucaugcacgugcagaaggugcuguccgccagcaccgucugcaagcugcaguccugcacgcacggcgugcccggggaccuccagguguaccacaucggcaaccugcugaagggcgacaaggucaacgggcaccucauccacaagaucgagccgcacuucaacaccagcuggauguccugggacggcugcgaccuggacuacuacugcaacaugggggacuggcccagcugcaccuacaccggcgugacgcagcacaaccacgccuccuucgugaaccugcucaacaucgagaccgacuacaccaagaacuuccacuuccacagcaagcgcgucaccgcccacggggacacgccccagcuggaccugaaggcgcggcccaccuacggcgccggcgagaucaccgugcucgucgagguggccgacauggagcugcacaccaagaagaucgagaucuccgggcugaaguucgccagccucacgugcaccggcugcuacgccugcuccagcgggaucuccugcaaggugcgcauccacgucgacgagccggacgagcugaccgugcacgucaagagcgacgaccccgacgugguggcggccuccagcagccugauggcccggaagcucgaguucggcaccgacuccacguucaaggccuucagcgccaugcccaagaccucccugugcuucuacaucguggagcgcgagcacugcaagagcugcuccgaggaggacaccaagaagugcgucaacaccaagcuggagcagccccagagcauccucaucgagcacaaggggaccaucaucggcaagcagaacuccacgugcaccgcgaaggccagcugcuggcuggaguccgucaagagcuucuucuacggccugaagaacaugcucuccgggaucuucggcaacguguucaucgggaucuuccuguuccuggccccguucauccuccugauccuguucuucauguucggcuggaagauccuguucugcuucaagugcugccggcgcacccggggccucuucaaguaccgccaccugaaggacgacgaggagaccggguaccggcgcaucaucgagcggcugaacaacaagaagggcaagaacaagcuccuggacggggagauccuggccgaccgccgcaucgccgagcuguucagcacgaagacccacaucggc

SEQ ID NO: 12491 - RNA, 1932 nt, Artificial Sequence
  derived and/or modified CDS sequence (opt1) from CCHFV(U2-2-002/U-6415)__AY900144.1__Gc
uuccaggacagcaucgugaagggcaugaagaaccugcucaacuccaccagccuggagaccucccugagcaucgaggcccccuggggcgccaucaacguccaguccacguacaagccgaccgugagcgcggccaacaucgcccucuccuggagcuccguggagcaccgcgggaacaagauccuggucagcgggcgguccgagagcaucaugaagcuggaggagcgcaccggcaucuccugggaccucgggguggaggacgccagcgaguccaagcugcugaccgugagcgucauggaccucucccagauguacagccccguguucgaguaccuguccggcgaccgccagguggaggaguggcccaaggccacgugcaccggcgacugccccgagcggugcgggugcaccagcagcacgugccugcacaaggaguggccgcacucccggaacuggcgcugcaaccccaccuggugcuggggcgucgggaccggcugcacgugcugcgggcucgacgugaaggaccuguucaccgacuacauguucgugaaguggaaggucgaguacaucaagaccgaggcgaucgugugcguggagcugaccagccaggagcggcagugcucccucaucgaggccggcacccgcuucaaccugggccccgucaccaucacgcugagcgagccccggaacauccagcagaagcucccgcccgagaucaucacccugcacccccgcaucgaggagggguucuucgaccugaugcacgugcagaaggugcucuccgccagcaccgucugcaagcugcaguccugcacccacggcgugcccggggaccuccagguguaccacaucggcaaccugcugaagggcgacaaggucaacgggcaccugauccacaagaucgagccgcacuucaacacgagcuggauguccugggacggcugcgaccucgacuacuacugcaacaugggggacuggcccagcugcaccuacaccggcgugacccagcacaaccacgccuccuucgugaaccugcugaacaucgagacggacuacaccaagagcuuccacuuccacuccaagcgggucaccgcgcacggggacacgccccagcucgaccugaaggcccgccccagcuacggcgccggcgagaucaccgugcuggucgagguggccgacauggagcuccacaccaagaagaucgagaucuccgggcugaaguucgccagccugaccugcaccggcugcuacgcgugcuccagcgggaucuccugcaaggugcggauccacgucgacgagccggacgaguucacggugcacgucaagagcgacgaccccgacgugguggccgccagcuccagccucauggcccgcaagcuggaguucggcaccgacuccaccuucaaggccuucagcgcgaugcccaagaccucccugugcuucuacaucguggagcgggaguacugcaagagcugcuccgaggaggacacgcagaagugcgucaacaccaagcucgagcagccccagagcauccugaucgagcacaaggggaccaucaucggcaagcagaacaacacgugcaccgccaaggccuccugcuggcuggagagcgugaaguccuucuucuacggccucaagaacaugcugagcgggaucuucggcaacguguucgucgggaucuuccuguuccucgccccguucauccugcugauccucuucuucauguucggcuggcgcauccuguucugcuucaagugcugccggcgcacccgggggcuguuccgcuacaagcaccuggagaacgacgaggagaccggcuaccggcgcaucaucgagcgccucaacaacaagaagggcaagaacaagcugcuggacggggagcggcucgccgaccgccggaucgcggagcuguucuccaccaagacccacaucggc

SEQ ID NO: 12492 - RNA, 1932 nt, Artificial Sequence
  derived and/or modified CDS sequence (opt1) from CCHFV(SPU 45/88)__KJ682809.1__Gc
uuccuggacagcaucgugaagggcaagaagaaccuccugaacuccaccagccuggagaccucccucagcaucgaggcccccuggggcgccaucaacguccaguccacguucaagccgaccgugagcgcggccaacaucgcccuguccuggagcuccguggagcaccgcgggaacaagauccuggucagcgggcgguccgagagcaucaugaagcucgaggagcgcaccggcaucuccugggaccuggggguggaggacgccagcgaguccaagcugcucaccgugagcgucauggaccugucccagauguacagccccguguucgaguaccuguccggcgaccgccagguggaggaguggcccaaggccacgugcaccggcgacugccccgagcggugcgggugcaccagcagcacgugccuccacaaggaguggccgcacucccggaacuggcgcugcaaccccaccuggugcuggggcgucgggaccggcugcacgugcugcgggcuggacgugaaggaccuguucaccgacuacauguucgugaaguggaaggucgacuacaucaagaccgaggcgaucgugugcguggagcucaccagccaggagcggcagugcucccugaucgaggccggcacccgcuucaaccugggccccgucaccaucacgcucagcgagccccggaacauccagcagaagcugccgcccgagaucgugacccugcacccccgcaucgaggagggguucuucgaccucaugcacgugcagaacguccuguccgccagcaccgugugcaagcugcaguccugcacccacggcgugcccggggaccuccagaucuaccacaucggcaaccugcugaagggcgacaaggucaacgggcaccucauccacaagaucgagccgcacuucaacacgagcuggauguccugggacggcugcgaccuggacuacuacugcaacaugggggacuggcccagcugcuccuacaccggcgugacccagcacaaccacgccgcguucgugaacaugcugaacaucgagaccgacuacacgaagaacuuccacuuccacagcaagcgggucaccgcccacggggacacgccccagcucgaccugaaggcccgccccaccuacggcgccggcgagaucaccgugcuggucgagguggccgacauggagcuccacaccaagaagaucgagaucuccgggcugaaguucgcgagccugaccugcaccggcugcuacgccugcuccagcgggaucuccugcaaggugcggauccacgucgacgagccggacgagcucacggugcacgucaagagcgaggaccccgacaucguggccgccuccagcagccugauggcccgcaagcuggaguucggcaccgacuccaccuucaaggcguucagcgccaugcccaagaccucccucugcuucuacaucguggagcgggaguacugcaagagcugcuccaaggaggacacgcagaagugcgugaacaccaagcuggagcagccccagagcauccugaucgagcacaaggggaccaucaucggcaagcagaacgacacgugcaccgccaaggccuccugcuggcucgagagcgucaaguccuucuucuacggccugaagaacaugcugagcgggaucuucggcaacguguucaucgggauccuccuguuccuggccccguucaucaugcucauccuguucuucauguucggcuggcgcauccuguucugcuucaagugcugccggcgcacccgggggcuguucaaguaccgccaccucaaggacgacgaggagaucggcuaccggaagaucaucgagcgccugaacaacaagaagggcaagaacaagcugcucgacggggagcgccuggcggaccggaagaucgccgagcuguucuccaccaagacccacaucggc

SEQ ID NO: 12493 - RNA, 1932 nt, Artificial Sequence
  derived and/or modified CDS sequence (opt1) from CCHFV(SR3)__AJ538199.1__Gc
uuccuggacagcaucgugaagggcaugaagaaccuccugaacuccaccagccuggagaccucccucagcaucgaggcccccuggggcgccaucaacguccaguccacguacaagccgaccgugagcaccgcgaacaucgcccuguccuggagcuccguggagcaccgcgggaacaagguccuggugagcgggcgguccgagagcaucaugaagcucgaggagcgcaccggcaucuccugggaccuggggguggaggacgccagcgaguccaagcugcucacggucagcgugauggaccugucccagauguacagccccguguucgaguaccuguccggcgaccggcaggucgaggaguggcccaaggcgaccugcaccggcgacugccccgagcgcugcgggugcaccagcagcacgugccuccacaaggaguggccgcacucccggaacuggcgcugcaaccccaccuggugcuggggcguggggaccggcugcacgugcugcgggcuggacgugaaggaccuguucaccgacuacauguucgucaaguggaagguggaguacaucaagaccgaggccaucgugugcgucgagcucaccagccaggagcggcagugcucccugaucgaggccggcacccgcuucaaccugggcagcgugacgaucacccucuccgagccccggaacauccagcagaagcugcccccggagaucaucacccugcaccccaagaucgaggagggguucuucgaccucaugcacgugcagaagguccugagcgccuccaccgugugcaagcugcagagcugcacgcacggcgugcccggggaccuccaggucuaccacaucggcaaccugcugaagggcgaccgcgugaacgggcaccucauccacaagaucgagcagcacuucaacaccuccuggaugagcugggacggcugcgaccuggacuacuacugcaacaugggggacuggcccuccugcaccuacaccggcgugacgcagcacaaccacgccagcuucgucaaccugcucaacaucgagaccgacuacaccaagaccuuccacuuccacuccaagcgggugacggcccacggggacaccccgcagcuggaccugaaggcgcgccccaccuacggcgccggcgagaucaccguccucguggagguggccgacauggagcugcacacgaagaagaucgagaucagcgggcugaaguucgccggccugaccugcaccgggugcuacgccugcuccagcggcaucuccugcaagguccggauccacguggacgagcccgacgagcucaccgugcacgucaagagcgacgaccccgacgugguggcggccuccagcagccugauggcccgcaagcucgaguucgggacggacuccaccuucaaggccuucagcgccaugccgaagaccucccugugcuucuacaucgucgagcgggaguacugcaagagcugcaacaaggaggacacccagaagugcgugaacaccaagcuggagcagccccaguccauccucaucgagcacaagggcacgaucaucggcaagcagaacaacacgugcaccgcgaaggccagcugcuggcuggaguccgucaagagcuucuucuacgggcugaagaacaugcucggcgggaucuucggcaacguguucaucgggaucuucaccuuccugacccccuucauccugcucauccuguucuucauguucggcuggcgcauccuguucugcuucaagugcugccggcgcacccggggccuguucaaguaccgccaccucaaggacgacgaggagaccggguaccggaagaucaucgagcgccugaacaacaagaagggcaagaaccgccugcucgacggggagcggcuggccgaccgcaagaucgccgagcuguucuccaccaagacgcacaucggc

SEQ ID NO: 12494 - RNA, 4656 nt, Artificial Sequence
  derived and/or modified CDS sequence (opt1) from DUGV(ArD44313)__NC_004158.1__GP
augagcaagcgcgugcugaucaucgccgucgugguguaccucgucuucaccacccagaaccagaucaccggcaaccacaccaccaucaacuccagcucccccagcaccacggaggccuccagcaccccgaccgugucccggacgccccagaccaccaccaccagcacggcgguguccaccaccaucaccgccacgaccacccccaccgccagcuggacgacccagucccaguacuucaacaagaccacccagcaccacuggcgcgaggagacgaugaucagccggaaccccaccguccuggaccgccagucccgggccagcuccgugcgcgagcugcucaacaccaaguuccugaugcugcucggguucaucccgaagggcgaggugaaccaccuggagaacgccugcaaccgggaggggaagaacugcaccgagcugauccucaaggagcgcaucgcgcgguucuucagcgagacggagaaggaguccugcuacaacaccuaccuggagaagcaccuccgcagcgucucccccgaggugagccucacccccuaccgggugcugggccugcgcgaggacauccuccugaaggagaucgaccggcgcaucauccgguucgagaccgacagccagcgcgucacgugccuguccgccagccuccugaagcccgacguguucauccgggagcagcgcaucgacgccaagccguccaacgggcccaagaucgugcccgucgacagcguggccugcaugaaccuggaggcgaacguggacguccgguccaacaagcucgugauccagagccugaugaccaccgugaagaucucccugaagaacugcaaggucguggugaacagccgccagugcauccaccagcagaccggcuccggcgucaucaaggugcccaaguucgagaagcagcagggcgggacguggagcuccuacaucgccggggucuacaccgccaccaucgaccuccuggacgagaacaaccagaacugcaagcuguucaccgagugcaucgugaagggccgggagcucgugaaggggcagagcgagcugaaguccuucaacaucgagguccugcucccgcgcgugaugaagacccgccggaagcugcuggccgugacggacggcagcaccgagugcaacuccggcacccagcucaucgaggggaaguccaucgagguccacaagcaggacaucggcgggcccggcaagaagcugaccaucugcaacggcacgagcgugcuggacgugccccucgacgaggggcacggcugcuacaccaucaacgucaucaccagcaagcgcgccugccggcccaagaacuccaagcugcagugcagcaucgacaaggagcugaagccgugcgacagcgggaagugccucuccaucagccagaagggcgcggggcacaucaaggugucccgcggcaagaccauccugaucacggagugcaaggagcacugccagauccccgugcccaccggcaagggggacaucauggucgacugcagcggcgggcggcagcacuaccuggaggugaacaucguggacauccacugccccaacaccaaguuccucggcgggaucaugcuguacuucugccgcauguccagccggccgaccgucgcccugcuccugggcaucuggaucggcugcggguacauccugacgugcaucuucuccuuccuccuguaccaccugauccuguucuucgccaacugcaucaagcagugccgcaagaagggcgagcggcucggggagaucugcgugaagugcgagcagcagaccgugaaccugauggaccaggagcugcacgaccucaacugcaacuucaaccugugccccuacugcugcaaccgcaugagcgacgagggcaugucccggcacgucgggaagugccccaagcgccuggagcggcucaacgagaucgagcuguaccugaccaccagcgagugccucugccuguccgugugcuaccagcugcucaucagcgugggcaucuuccugaagcgcacgaccuggcuggucgugcuccuggugcugcucggccuggccaucucccccguccagggggccccgaccgaggugagcaacgugaagcaggacggcgacuacuccaucugcuacuucaucuucgggugccuggucaccgcggcccuccugcugaaggugaagcggacgaacagcaacggcaucguggucgugguggacuccuucggccgcugccccuacugcaacgaguucaccgacagccucuucgaggagguccugcacgacacccugugcagccucugcgugugccccuucugcgagaagcaggcccuggaccuggugacccucgaggagcacgucaaggagugcuacaagguggccacgcggaaggacaucuucaagauccuggggcgcaaguucaccaacgcccuggugcggcgcgagaagcuguucaccaccggccugcagcuguucaucaacaagacgaacgucgugguguucgcgcucaucaugugcuuccugcugcuccugaccgggcacaacgccuccgccuucgacagcggcgaccugcccgacggggucugggaggaguccagccagcucgugaaguccugcacccaguucugcuacaucgaggaggacgugugcuacugcccggccgaggacggcgucggccgcaagcugcuguucuucaacgggcuccagaacagcgugaagcggcuguccgacagccacaagcugcucaccuccgugagcaucgacgcccccuggggccgcaucaacgucgaguccacguggaagcccacccuggcggccagcaacaucgccauguccuggagcuccaccgacaucaagggggagaaggugauccugagcggccgguccaccagcaucaucaagcucaaggagaagacgggggugauguggaagcuggucggcuccggccuggccagcgagaagaagaagccguuccgcuuccccaucauggacuucgcccagguguacaacagcgucuuccaguacaucaccggggaccggcuccuguccgaguggcccaaggcggugugcaccggcgacugcccccaccgcugcgggugccagaccagcacgugcauggccaaggagugccacacccaggagugcguguccacccacaugguccugggcaucgggaccggcugcacgugcugcggcauggacguggagcggccguucaacaaguaccucggggugaaguggagcaccgaguaccugcgcaccgagguccuggugugcguggaggucaccgaggaggagcggcacugcgagaucguggaggccggcacccgcuucaacaucgggcccaucacgaucaccaucuccgacccccagaacaucggcagcaagcuccccgagucccugaugaccgugcaggagaucgacgacagcaacuucgucgacaucaugcacguggggaacgugaucuccgccgacaacagcugccggcugcaguccugcacccacggcagcgcggucacgacccgcuucaccgcccucaccgcccugaucaaggacgaccacuccagcggccugaaccucgccgugcuggacccgaaggugaacuccagcuggcuguccugggaggggugcgacauggacuacuacugcaacgucggcgacuggcccacgugcaccuacaccgggguggugacccagaagcuccgggaguuccugaagcuggaccagcaccgcaagcggcuccacacgacccugagcuucucccugaagaagaaccucagcaagcgcagccacaccuccguccggcuggagggcaagaccgugacgcgcauggaggugaaggucaccgcccugaucgagguggacggcauggagcuccacagcaagaccauccggcuguccgggauccgccugaccggccucaagugcagcgggugcuucuccugcacgagcggcaucuccugcagcgugaacgcgaagcugaccucccccgacgaguucacccugcaccuccggagcaccucccccaacgucgugguggccgagacgagcaucaucgcccgcaaggggccguccgccaccaccagccgcuucaaggucuucuccgugcgggacaccaagaagaucugcuucgagguggucgagcgcgaguacugcaaggacugcacgcccgacgagcugacgaccugcaccggcguggagcuggagcccaccaaggacauccuccuggagcaccggggcaccaucgugcagcaccagaacgacacgugcaagagcaagaucgacugcugguccaacagcaucuccagcuucgccagcgggaucggcgacuucuucaagcacuacaucggguccaucgcggucggcgugcuggggaccgugcuccccuucgcccugcugauccucuucuucaucuacggcgacaagaugcuguggccguucaaggucuucugccgccccugccggcgcugcugccggaagaacgagggcuacaacaagcuggccgaggaggaggagcugcgcgacaucauccggaaguucagcaaguccggggagcucaucaacaaggacgccaaggacaagcgcacccuggcgcggcuguucaugagcgacaaccccaagcucaagaaggagaagaagcuguccgagaucgccuga

SEQ ID NO: 12495 - RNA, 4656 nt, Artificial Sequence
  derived and/or modified CDS sequence (opt1) from DUGV(IbAr1792)__KU925456.1__GP
augagcaagcgggugcugaucaucgccgucguggugugccucgucuucaccacccagaaccagaucgccggcaaccacaccaccgcgaacuccgggagccccuccaccaaggaggccagcuccaugccgaccgugagcgacacgccccagaccaccaccacguccaccgccgugagcaccaccaucacggccaccaccacccccacggccuccuggaccacccagagccaguacuucaacaagaccacgcagcaccacuggcgggaggagaccauggucucccgcaaccccaccgugcugaaccggcagcgccgggcgagcuccgugaaggagcugcucaacaccaaguuccugaugcugcucggcuucaucccgaagggggaggucaaccaccuggagaacgccugcaaccgcgagggcaagaacugcacggagcugauccucaaggagcggaucgcccgcuucuucagcgagaccgagaaggaguccugcuacaacaccuaccuggagaagcaccugugcagcgugucccccgaggugagccucacccccuaccggguccuggggcugcgcgaggacauccuccugaagaagaucgaccggcgcaucauccgguucgaggccgacucccagcgcgugacgugccugagcgcgagccuccugaagcccgacguguucauccgggagcagcgcaucgacgccaagccguccaacggccccaagaucguccccguggacagcgugcggugcaucaaccuggaggccaacgucgacgugcgcuccaacaagcucgugauccagagccugaugaccaccgucaagaucucccugaagaacugcaaggugguggucaacagccggcagugcauccaccagcagaccggcuccggggugaucaagguccccaaguucgagaagcagcagggcgggacguggagcuccuacaucgccggcguguacaccgccaccaucgaccuccuggacgagaagaaccagaacugcaagcuguucaccgagugcaucgugaaggggcgcgagcucgucaagggccagagcgagcugaaguccuucaacaucgaggugcugcucccgcgggugaugaagacgcgccgcaagcugcuggcggucaccgacggcagcaccgagugcaacuccgggacccagcucaucgagggcaagagcaucgaggugcacaagcaggacaucgggggccccggcaagaagcugaccaucugcaacgggacguccgugcuggacgucccccucgacgagggccacgggugcuacaccaucaacgugaucaccagcaagcgggccugccgccccaagaacuccaagcugcagugcagcaucgacaaggagcugaagccgugcgacuccggcaagugccucagcaucagccagaagggggccggccacaucaaggugucccggggcaagaccauccugaucacggagugcaaggagcacugccagauccccguccccaccgggaagggcgacaucaugguggacugcagcgggggccgccagcacuaccuggaggugaacaucgucgacauccacugccccaacaccaaguuccucgggggcaucaugcuguacuucugccggauguccagccgcccgaccguggcccugcuccugggcaucuggaucgggugcggcuacauccugacgugcaucuucuccuuccuccuguaccaccugauccuguucuucgccaacugcaucaagcagugccggaagaagggggagcgccucggcgagaucugcgugaagugcgagcagcagaccgucaaccugauggaccaggagcugcacgaccucaacugcaacuucaaccugugccccuacugcugcaaccggaugagcgacgaggggaugucccgccacgugggcaagugccccaagcggcuggagcgccucaacgagaucgagcuguaccugaacuacaagcgggugcccagcugccuccgcugcaugcuguccaccagcaucuccgucggcaucuuccugaagcggaccacguggcucguggugcugcugguccuccuggggcuggcgaucagcccggugcagggcgcccccgccgagguguccaacgucaagcaggacggggacuacagcaucugcuacuucaucuucggcugccucgugaccgccgcccugcugcucaaggugaagcgcaccaacuccaacggcaucgucgugguggucgacagcuucgggcggugccccuacugcaacgaguucaccgacucccuguucgaggaggugcugcacgacacgcucugcagccugugcgugugccccuucugcgagaagcaggcgcuggaccucgucacccuggaggagcacgugaaggagugcuacaaggugaccacccgcaaggacaucuucaagauccugggccggaaguucacgaacgcccucguccgccgcgagaagcuguucaccaccgggcugcagcuguucaucaacaagaccaacgugguggucuucgcccugaucaugugcuuccugcuccugcugacgggccacaacgccagcgccuucgacuccggggaccucccggacggcaucugggaggagagcucccagcuggucaagagcugcacccaguucugcuacaucgaggaggacgugugcuacugccccgcggagaacggcguggggcggaagcuccucuucuucaacggccugcagaacuccgugaagcgccugagcgacucccacaagcuccugaccagcguguccaucgacgcccccuggggcgccaucaacgucgagagcaccuggaagccgacgcuggccgcguccaacaucgccaugagcugguccagcaccgacaucaagggggagaaggugauccucuccgggcggagcaccuccaucaucaagcugaaggagaagaccggcgugaugugggagcugggcagcgagcucgccuccgagaagaagaagcugcuggucagcaucauggacuucgcccagguguacaacagcgucuuccaguacaucacgggggaccgccuccuguccgaguggcccaaggccgugugcaccggcgacugcccccaccggugcgggugccagaccagcacgugcauggcgaaggaguggccccacacccgcaacuggcggugcaacccgaccuggugcuggggcaucgggaccggcugcacgugcugcggcauggacguggagcgccccuucaacaaguaccugggggucaagugguccaccgaguaccuccggaccgaggugcuggugugcgucgaggugaccgacgaggagcgccacugcgagaucguggaggccggcacccgguucaacaucgggcccaucaccaucacgaucagcgacccccagaacaucggcuccaagcugccggagagccucaugaccguccaggagaucgacgacuccaacuucguggacaucaugcacguggggaacgucaucagcgccgacaacuccugccgccugcagagcugcacccacggcuccgccggcgacuaccagaucuacagcaccgacucccugaucaaggacgaccacagcuccgggcucaaccuggccgugcuggaccccaaggugaacagcuccuggcucagcugggagggcugcgacauggacuacuacugcaacgucggggacuggcccacgugcaccuacaccggcguggugacccagaacuccgagagcuucagcaaccugaucaacaucgagaaggacuacacgcagcgguuccacuuccacuccaagcgcaucagcgcgaagggccacacccugcagcucgaccugaaggcccggcccaaccaggacgggggcgaggucaccgcccugaucgagguggacgggauggagcuccacuccaagaccauccgccugagcggcauccggcugacggggcucaagugcuccggcugcuucagcugcaccuccggcaucagcugcuccgugaacgccaagcugaccagcccggacgaguucacccugcaccuccgcuccacgagccccaacgucgugguggccgagaccuccaucaucgcgcggaaggggcccagcgccaccaccuccaaguucaaggucuucagcgugcgcgacacgaagaagaucugcuucgagguggucgagcgggaguacugcaaggacugcucccccgacgagcugacgaccugcaccggcguggagcuggagccgcccaaggacauccuccuggagcaccgcgggaccaucgugcagcaccagaacgacacgugcaagagcaagaucgacugcugguccaacagcaucagcuccuucgccagcggcaucggggacuucuucaagcacuacaucggcuccaucgccgucggcauccuggggaccgugcuccccuucgcgcugcugauccucuucuucaucuacggcgacaagaugcuguggcccuucaagguguucugccgcccgugccggcgcugcugccggaagaacgagggguacaacaagcuggccgaggaggaggagcuccgcgacaucauccggaaguucagcaaguccggcgagcugaucaacaaggacgccaaggacaagcgcacccuggcccgccucuucaugagcgacaaccccaagcugaagaaggagaagaagcuguccgagaucgccuga

SEQ ID NO: 12496 - RNA, 4884 nt, Artificial Sequence
  derived and/or modified CDS sequence (opt1) from NSDV(Jilin)__NC_034391.1__GP
auggugagccuggagaagggccucauccugcugcuccugaugcacaucgccaucgccuccaccgggggcagccuggggcuccccggccugaacggggaggaccacaccgacgacccggaggucggcggcgacgggcccacggaggaguacaccgaggacgaccccgaguccaccaccgugagcauccccacgaccccgcccgugcugggccaggggaccgaggagguccccgcgaccuccggcgaggccgaggccggguacagcacgaccgacgugcccgacaccguguccgagaaggucgaggacgagcaggacaccacgccgagcacccaggugacccccgaccagcccgagcaguccaccacgagccuccccgacccguggaccgccaucuccacccgcaucggccgggagcugcugagcguggaguccgacaccaccaagagcucccucgucaccgugggccacccccagcagcccaucuuccuggacgggcagcccguggaggaggucacccacccggugaacgagcgcgacgugaccgaggcccugcggaaguacgacaagaugaagaagcuccugagccagcgcauccuguccaagaugggcauggcgcgggacuucacggacgaggagcucgacgucuggugccacgagcgcuucgacaacugcagcuccaacgacaucgagaaccggauccgcgacuucuuccugaucagcgaccagaccgagugcuucgacgaggugcuggugaagcggcucugcgagagcaccaaccccaucgucggggagcccuggcaggucgccggcaucaaggaggagaucgugcgccgggagaugggccgccggaucuuccgcuucuucacccccacgcugaaggugaccugcguguccgggagccugaacccguccgaccaguucgugcgguucuacgaccccgucaucgagcgcaccagcggccccaccauccagaacuacgacuccaugcacugccucaacaucgagaacgggcuggccaagcccagcaagauggugguccugaacgugcucaugacgaccguggagguccggcuggaguccugccgcgccuucaucaacgcgcaccagugcaucuacacccagcacgccgacggccaggugauggugccgaccuucgucgaccacagcgggacgcggcgcaccaucggcgccuacaccauguccuucaaccugaccgacgagcggaaccgcgccugcaucauccgcaccacgugcguggugaagggcaaggaggucaagaaggggcagagccagcuccggggcuuccccaccuccauccgccuguucaagagcgugaccgggaagcggcgccugauggccgaggagggcgacuggaccgacugcggguccggcacgcagcucgacaugaccauggcggugagcguccacaacgacaagaagggcgggcccggcaagaagcugaccaucugcaacgggaccacgguguccgacagcacccugaacgagggccucgggugcuacaccaucaacaaggugaucaccggcaaggccugcaaggucggcaacuccacggggagcugcgaggugcagaccgagcugcagaagugcgagaccggcaagugcauccuggugaagcagaaguccaagggggucgugaagcucaagcggggcaagaccgugaucaucacggagugccagggcagcugccuguucgccaucccccaggacaccggggacaucaccaucgacugcagcggcgggcgccagcacuaccuggagaucaacaucgucgacauccacugcccgggcaaggacaaguggaagggguucaugcucuacaucugccggguguccagccgcccccugaucgcccugaccuucggccucuggcuggccgcgggcuaccugaucacgugccucguguccuucaucaucuacaacgccguccugcugcugagcaucgccaucaagaaggugcggcaggggcgcgagaagaagggcgaccucugcaucaagugcgagcagcacugcaugaaccuguacgaccaggagcugcacgagcucaacugcuccuucaaccugugccccuacugcgccaaccggcugagcgacgaggggcucccgcgccacgugccccggugccccaagaaguccgagcgccuggaggagaucgagcuguacaucaacuacacccggguccccugcauccuccgcuggauccugagcaccuccguccaggugggcaccgccgugaagcggcugagcugguucuccgugcucgugacgcuguucauccugaccaucagcccgguccagggguucccccucgaguccccgcccaucggcgcggccaccgacagccgcaucauguacggcguggugggguucauguucgcccugaucaugaugcugaaccucaagaagucccacuacggcagcaucuuccacgucaucgacggguucggccggugcaaccugugcgacacccgcaucgacucccugauggaggagacggcccacgaccucugcugcauguucgacugcugccccuacugccaccgcgugagcgagagcaacgggucccacugcuuccacgugcggaucugcgucgccaaggagaucagcaagaagaugcugaaggcgggcggccgccuguucaccaacaagcucgugucccgggaggggaccuucgccaaccgcauccagcugcuguaccggcgcagcaagguggucuccacccucguggugacgguccugcugcuccuggugcugcucaagcccaccaccgccuucgacagcggcccccugcccgacgggaccugggaggaggaggagaagcuggugcggaacugcggccaggagugcauccucgaccagggggagugccugugcccgggcgagcaccgcgccggccggaagcugcuguuccugaacgggcugcaggacgcggcccgccggaugacggagucccaccgccuccugaccagcgucuccaucgacgcccccuggggcgccaucaacaucgagagcaccuucaagcccgugcuggccgcguccaacaucgaccucagcuggaacuccgccgaggagcagggggacaagaucauccugagcggccgguccaccggcaucaucaagcugcaggagcgcaccgggcucauguggaagaugagcuccgagaaggccagcgaguccaagaaccugcuggugagcgucauggacuucagccagcucuacaacuccaucuuccaguacaucacgggcgaccggagccuguccgaguggcccaaggccgugugcaccggggacugcccggaccgcugcggcugccagaccagcacgugcuaccacaaggaguggccccacacgcggaacuggcgcugcaaccccaccuggugcugggggaucggcaccggcugcacgugcugcgggauggacgucgagcgguacuucaacaaguacuucggcgugaagugggcccuggaguacgugcgcaccgacgucguggugugcgucgagcucaccaacgaggagcggcacugcgaccuggugcaggcggggucccgcuucagcaucggccccguguccgucacccugagcgacccgcagaacguggugaaccgccucuccagcaacaucaugaccauccaggagaucgccgacaacgggauccuggaccugaugcacgucuccaaggugaucagcgccgagaacgccugcaagcuccaguccugcacgcacggcagccccggcgaccugcagauccugcacaccgacaaccucaucaagggggacauguccggcgggaucaaccuggcccaccuggacccccaggugaacaccagcuggauguccugggagggcugcgaccucgacuacuacugcaccgucggggacuggcccagcugcacguacaccggcgugaacuccaucaacaccgacagcuucaccaaccugaucaacacggagaccgacuacaccggcaaguuccacuuccacagcaagcggaucuccgcgcgcgacgacacccugcagauggaccucaaggcccggccgaacagcgggggcggggagaugacggugcuggucgaggugaacggccuggagcuccacuccaagcgcaucagccugaagggccugcggcucaccaaccugaagugcgacgggugcuucgccugcucccagggccugaccugcaccaucacggccaagcucgagagccccgacgaguucaccauccaccuccgcuccaccagccgggacguggucguggcggagaccuccgugacggcccgcaaggucgagaccggggcccggagcggcuuccgcgccuucgccgugcgggacgugaagaagcugugccucgaggucguggagaaggacuacugccccuccugcaccguggaggaccugaagaucugcgucgacgugagccuggagccgcccaaggacauccucaucgagcacaaggggaccaucauccagcacuacaacaaguccugcgacgagggcuacaacugcugggugggcagcgucuccggguucuucgugggcgugaaggacuucuucgagaagaaccucgggggcguccugaucgggcuggugagcacgauccugccccuggugcucaccguccuguucuucaucuacggcaagaagcuguucugccucugccgccugugccacaagaagugcugccggggcuccgggcgcggccgggacggguacagccgccugucccaggaggaggagaucaaggagaucaucaagaaguucagccggaacggcgagcugcucgggaagggcgagaacgacaagcgcaccguggcgcggauguucauggacggccagagcaccaagaaggccaucaaggagguggccuga

SEQ ID NO: 12497 - RNA, 4884 nt, Artificial Sequence
  derived and/or modified CDS sequence (opt1) from NSDV(708)__EU697952.1__GP
auggugagccuggagaagggcuucuucuuccuccugcugcuccacaucgucaccgccuccaccgggggcccgcccgggcugcccggccccaacgggaaggaccagacggacggccccgagggcgggggcgacgggccgaccgaggaguacaccgaggacgacuucgagagcaccacguucuccauccccaccaccccgcccgugagcgagcaggacgccaaggagguguccgcgaccagcgaggaggccgaggucgaggacuccacgcugaucgugcccaagaccaugagcgagaaggugggcgacgagcaguccaccaccagcaacaugcaggucacgaccucccagcccgagcagagcaccaccgggaugcccggccccuggauggccuccagcaucaagaucggccgcgagcuccuguccguggagagcgacacgaccaaguccagccuggugaccgucggguacccgcagcagcccaucuuccucgacggccagcccguggaggaggugacccaccccgucuccgagcgggacguggccgaggcccugcgcaaguacgacaagaugaagaagcugcucagccagcggauccugagcaagauggggauggcgcgcgacuucacggacgacgagcuggacgccuggugccacgagcgguucgacaacugcuccagcaacgacaucgagaaccgcaucaaggacuucuuccucaucuccgaccagaccgagugcuucgacgaggugcuggucaagcggcugugcgagagcaccaacccgaucaucggcgagcccuggcaggucgccggcaucaaggaggagguggugcgccgggagauggggcgccggaucuuccgcuucuucacccccacgcucaaggugaccugcguguccggcagccugaaccccuccgaccaguucguccgguucuacaacccggugaucgagcgcaccagcgggcccaccauccagaacuacgacuccaugcacugccugaacaucgagaacggccucaucaagcccagcaagguggucauccugaacgugcugaugacgaccgucgaggugcggcucgaguccugccgcgccuucgugaacgcgcaccagugcaucuacacccagcacgccgacgggcagguccgggugcccaccuucguggaccacagcggcacgaagcgcaccaucggcgccuacaccauguccuucaaccugaccgacgagcggaacaaggccugcaucauccgcacgaccugcgucgugaaggggaaggaggugaagaagggccagagccagcugcggggguucccgaccuccauccgccucuucaagagcgucaccggcaagcgccggcugauggccgaggagggggacuggaccgacugcggcuccggcacgcagcuggacaugaccaccgcggugagcgugcacaacgaccgcaagggcgggcccgggaagaagcucaccaucugcaacggcacgaccgucuccgacagcacccugaacgaggggcugggcugcuacaccaucaacaaggugaugacgggcaaggccugcaagguggggaacagcaccggcuccugcgagguccagcccgagcuccagaagugcgagaccgggaagugcauccuggugaagcagaagaacaagggcguggucaagcugaagcggggcaagaccgugaucaucacggagugccaggggagcugccucuucgccaucccccaggacaccggcgacaucaccaucgacugcuccgggggccgccagcacuaccuggaggugaacaucgucgacauccacugcccggggaaggacaaguggaagggcuucaugcuguacaugugccgggugagcucccgcccccucaucgcccugaccuucggccuguggcucgccgcgggguaccugaucacgugccuggugagcuucaucaucuacaacgccguccuccugcuguccaucgccaucaagaaggugcggcagggccgcgagcggaagggggaccucugcaucaagugcgagcagcacugcaugaaccuguacgaccaggagcugcacgagcugaacugcagcuucaaccucugccccuacugcgccaaccgccuguccgacgagggccugccgcggcacgugccccgcugccccaagaagaccgagcggcucgaggagaucgagcuguacaucaacuacacccgcguccccugcauccugcgguggauccucagcaccuccguccagguggggacggccgugaagcgccugagcugguucuccgugcuggugauccucuucguccugaccaucagcccggugcagggcuucccccuggagaacacccccaucggcuccaccacggacagccggaucaucuacgggguggucggcuucaucuucgcgcucaucaugaugcugaaccugaagaagucccacuacgggagcaucuuccacgugaucgacggcuucgggcgcugcaaccucugcgacacccggaucgacagccugauggaggagaccgcccacgaccugugcugcaucuucgacugcugccccuacugccaccgcguguccgagagcaacggcucccacugcuuccacguccgcaugugcguggccaaggagaucagcaagaagaugcucaaggccgccggccggcuguucaccaacaagcuggugucccgcgaggggaucuucgcgaaccggguccagcuccuguaccgccggagcaaggugguguccacguucgucgugaccgugcugcuccugcuggucuuccuccgcccggccaccgccuucgacagcggcccccugcccgacgggaccugggaggaggaggagcggcuggugcgcaacugcggccaggagugcgugcucgaccaggacgagugccugugccccggggagaaccgggccggccgccggcugcuguuccugaacggccugcaggacgcgguccgccggaugacggagucccaccgccuccugaccagcguguccaucgacgccccguggggcgccaucaacaucgagagcaccuucaagcccguccuggccgccuccaacaucgaccucagcuggaacuccgcggaggagcagggggacaagaucauccugagcgggcgguccaccggcaucaucaagcugcaggagcgcacgggccucauguggcggaugagcuccgagaaggccagcgagagcaagaaccugcugguguccgugauggacuucagccagcucuacaacuccaucuuccaguacaucaccggggaccgcagccuguccgaguggcccaaggccgucugcaccggcgacugccccgaccggugcgggugccagaccagcacgugcuaccacaaggaguggccgcacacccgcaacuggcggugcaaccccaccuggugcuggggcaucgggaccggcugcacgugcugcggcauggacguggagaaguacuucaacaaguacuucggggugaagugggcccuggaguacguccgcaccgacgugguggucugcguggagcucaccaacgaggagcgccacugcgaccuggugcaggccggcucccgguucagcaucgggcccgucuccgugacccugagcgacccccagaacguggucaaccgccucuccagcaacaucaugaccauccaggagaucgcggacaacggcauccuggaccugaugcacguguccaaggugaucagcgccgagaacgccugcaagcuccaguccugcacgcacgggagcccgggcgaccugcagauccugcacaccgacaaccucaucaagggcgacauguccgggggcaucaaccuggcccaccuggacccccaggucaacaccagcuggauguccugggaggggugcgaccucgacuacuacugcaccgugggcgacuggcccagcugcacguacaccggggugaacagcaucaacaccgacuccuucaccaaccugaucaacacggagaccgacuacaccagcaaguuccacuuccacuccaagcggaucagcgcccgcgacgacacccugcagauggaccucaaggcgcggcccaacacgggcggcggggagaugaccguccugguggaggugaacggccuggagcuccacuccaagcgcaucaaccugaaggggcugcggcucaccaaccugaagugcgacggcugcuucgccugcagccagggccugaccugcacggucaucgccaagcucguguccccggacgaguucaccauccaccuccgcagcaccucccgggacguggucguggccgagaccagcaucacggcgcgcaagguggacaccggggcccgguccagcuuccgcgccuucgccguccgggacgugaagaagcugugccucgagguggucgagaaggacuacugccccuccugcaccguggacgaccugaagaugugcguggacgucagccuggagcccccgaaggacauccucaucgagcacaagggcaccaucauccagcacuacaacaaguccugcgacgagggguacaacugcugggugggcagcguguccggguucuucgucggcgugaaggacuucuucgagaagaaccugggcggggugcugaucggccucgucgggacgauccugccccuggugcucaccauccuguucuucaucuacggcaagaagcuguucuaccucugccgccugugccacaagaagugcugcaaggggagcggccggggccgcgacggguacucccggaucagccgcgaggaggagaucaaggagaucaucaagaaguucagccggaacggcgagcugcucgggaagggcgagaacgacaagcgcaccguggcccgcauguucauggacgggcaguccaccaagaaggcgaucaaggaggucgccuga

SEQ ID NO: 12498 - RNA, 4875 nt, Artificial Sequence
  derived and/or modified CDS sequence (opt1) from NSDV(779)__HQ286599.1__GP
auggcccugguggccaagggccucauccugaugcugcuccuguacauguucaaggcgagcgaggucaaccuggagcuccccuccuggaacagcaccgaggggaccgaguacgccgacgagcugccgacggagccgcccuccgaggaggagcccaagcuggccgccgugagcaccgugaccaccccggccccgcccaaggaguccacggaggacaccaucgagagccccgacggcggggagaccauggcgcccaccacgcccgcccccgucaccgacuccgccagcaagcucgaggaggagcccggcaccacccagcaggcccaguccacgcagaugcagaacagccaggcgccgaucgggaugcccgaggccugguccaccagccccucccgcgugggccggaagccccugagcgccuccccggacgugagcgagcccgaccagaacaccgaggcccagacccacccgcccgucuuccuggacggccgccccguggaggaggaggagcacuccguggggacgcgggacgucgccagcgaccuccgcgaguacaaccagaugaagcagcugcugucccagcggauccucgcgaagaugggcauggccguggacuucaccgacgacgagcuggacaccuggugcuaccgccgguacagcaacugcagcuccaacgacaucgagagccgcauccgggacuucuuccugaucaccgaccgcuccgagugcuucgacgaggugcucgucaagcggcugugcgagacgaccagccccaucaucgaccgcgccuggaagaucgccgggcugaaggaggagguggugcuccgggagaugggccgccggaucuuccgcuucuucacccccgcccugaaggugaccugcauguccgggagccugaaccccuccaaccaguucgugcgguucuacaacccgacgcucgagcgcaccagcggccccaccauccagaacuacgacggcaugcacugccugaacaucgagaacgggcugaucaagcccuccaagguggucgugaucaacgugcucaugaccacggucgacauccggcuggagagcugccgcgcguucaucaacgcccagcagugcaccuacacccagcacgccgacggccuggugcgggugcccaccuucgucgggccgcacggcgagaagcgcaucaucggcgccuacacgauguccuucaaccucaccgacgagaagaacaaggccugcaccaucaagaccacgugcguggucaaggggaaggaggugaagaagggccagagccagcugcgcggguuccccaccaccauccggcuguucaaguccgugaccggcaagcgccggcucaugagcaacgaggaggaguggaccgagugcggguccggcacgcagcugaacauggcgaccgccgucagcgugcacaacgacaagcugggcgggcccggcaagaagcucaccaucugcaacgggaccacgguguccgacaucgcccugaacgagggccuggggugcuacaccaucaacaagaucaucaccggcaaggucugcaagaccggcaacacgaccgggagcugcgaggugcagccggagcuccagaagugcgagaccggcaagugcauccugaucaagcagaagaacaaggggguggucaagcugaagcgcggcaagaccgugaucaucacggagugccagggguccugccucuucgccaucccccaggacaccggcgacaucaccaucgacugcagcggcgggcggcagcacuaccuggagaucaacaucguggacauccacugccccggcaaggacaaguggaagggguucaugcuguacaucugccgcgucagcucccggccccucguggcccugaccuucggcaucuggcugacggcgggcuaccucaucacgugccuggccagcuucauccuguacaacgccauccugcucaucuccaucgccaucaagaagcugaagcagaagcgcgagaagaagggggaccugugcaucaagugcgagcagcacugcaugaaccucuacgaccaggagcugcacgagcugaacugcagcuucaaccucugcccguacugcgcgaaccggcuguccgacgacggccugccccgccacgugccccggugccccaagcgcggggagcggcucgaggagaucgagcuguacaucaacuacacccgcgucccgugccugcuccggugggcccugagcaccuccguccaggugggcaccgucaucaagcgccugagcugguucggggugcuccugacccuguucuuccucaccaucucccccgugcagggcuucccccuggagaacccgcccaucggcaccgccacggacagcaacaucaucuacgggcuggccggcuucaucuucgcccucguccugaugcugaaccucaagaagacccacuacggguccguguuccacgugaucgacggccuggggcugugcagccucugcgacacccggaucgacucccugauggaggagaccgcgcacgagcugugcugcgccuucgacugcugccccuacugccaccaggucagcgaguccaacggcagccacugcuuccacaugcgcaucugcguguccaaggagaucagcaagaagaugcucaaggccgccggcaagcuguucacgaacaagcuggugagccgggagggguucuucgccaacaagauccagcuccuguaccagcgcuccaaggucgugagcacccugauccucaccgugcugcugcuccugaucauccugaagcccgcggccgccuucgacuccggcccccucccggacgggaccugggaggaggaggagagccugauccgcuccugcgaccaggagugcguccuggagcaggacgagugccucugccccggcgagcaccgggccgggcgccggcugcuguuccucagcggccugcaggacgccgcgcgccggaugacggagucccaccgccugcucaccagcguguccaucgacgcccccuggggcgccaucaacaucgagagcaccuucaagccccugcuggccgcguccaacaucgaccucagcuggaacuccgccgaggagcagggggacaagaucgugcugagcggccgguccaccgggaucaucaagcugcaggagcgcacgggccucauguggaagaugagcuccgagaaggccagcgaguccaagaaccugcuggucagcaucauggacuucagccagcucuacaacuccaucuuccaguacaucaccggggaccggagccuguccgaguggccgaaggccgugugcaccggcgagugccccgaccgcugcggcugccagaccagcacgugcuaccacaaggaguggccccacacccggaacuggcgcugcaaccccaccuggugcugggggaucggcaccgggugcacgugcugcggcauggacguggagcgguacuucaacaaguacuucggcgucaagugggcccuggaguacgugcgcaccgacguggucgugugcguggagcucaccaacgaggagcggcacugcgaccugguccaggcggggucccgcuucagcaucggcccgguguccgugacccugagcgacccccagaacgucgugaaccggcucuccagcuccaucaugaccauccaggagaucagcgacaacgggauccuggacgugaugcacgucuccaaggugaucagcgccgagaacgccugcaagcugcaguccugcacgcacggcagccccggggaccuccagauccugcacaccgacaaccugaucaagggcgagauguccagcggcaucaaccucgcccaccuggacccccaggugaacaccuccuggaugagcugggaggggugcgaccuggacuacuucugcaccgucggcgacuggcccagcugcacguacaccggggugaacuccaucaacaccgacagcuucaccaaccucaucaacacggagaccgacuacaccuccaaguuccacuuccacagcaagcgcaucuccgcccggggcgacacccugcagauggaccugaaggcgcgccccaacgucgggggcggcgagaugacggugcucguggaggucaacgggcuggagcugcacagcaagaagaucucccucaagggccugaagcugagcaaccucaagugcuccgggugcuucgccugcagccccggccuguccugcaccgugaucgcccggcuggagagcccggacgaguucaccauccaccuccgcuccaccagccgcgacguggucguggccgagacguccgugaccgcccggaaggcggagaccggggccaagagcuccuuccgcgccuucgccgucaaggacgugaaggagaucugccuggagguggucgagaaggaguacugccccagcugcuccaucgaggaccugaagaucugcaucagcgugacccucgagccgcccaaggacauccugaucgagcacaagggcacgaucgugcagcacuacaacaagagcugcgacgagggcuacaacugcuggaucggguccgucagcggcuucuucgugggggugaaggacuucuucgagaagaacuucggcuccgucaucaucggcaucgugagcaccgugcugccccucauccugaccguccuguucuucguguacgggcggcgccuguucugccucugccggcugugccacaagaagugcugccgcggcuccagccgggggcgcgacggcuacucccggcugagccaggaggaggagaucaaggagaucaucaagaaguucaaccgcaacggggagcuccugggccggggcgagaacgacaagcgcaccguggcgcggauguucauggacucccagagcgcccgcaaggccgucaaggagguggccuga

SEQ ID NO: 12499 - RNA, 4302 nt, Artificial Sequence
  derived and/or modified CDS sequence (opt1) from BUNV__NC_001926.1__GP
augcgcauccugauccuccugcuggccgugacccagcucgccgucagcucccccgugaucacccggugcuuccacggcgggcagcugaucgcggagcgcaagagccagacguccaucagcgaguucugcaucaaggacgacguguccaugcucaagagcgagaucgucuacaccaagaacgacaccggcaucuucgggcacuccaagguguuccggcacuggaccaucacggacuggaaggccugcaacccgguggucaccgccggcgggagcaucaacgugaucgagguggacaagaaccugaaccuggucacccgcaacuacgugugcaccggcgacugcacgaucaccguggaccggaagaacgcccagaucaucuuccagaccgacaagcugaaccacuucgaggucaccggcacgaccaucuccaccgggugguucaagagcaaggccuccgugacccucgaccgcacgugcgagcacaucaaggugagcugcggcaagaagacccugcaguuccacgcgugcuucaagcagcacauguccugcguccgguuccugcaccgcagcauccuccccggguccauggccaucagcaucugccagaacaucgagcugaucaucaucaccauccuggcccucugcaucuucaucaucaugaucauccugaccaagacguacaucugcuacgugcugauccccguguucaugcccaucgccuucgcguacggcugggccuacaaccgguccugcaagaagugcacgugcugcgggcucgccuaccacccguucaccaacugcggcagcuacugcgucugcggcuccaaguucgagaccagcgaccgcaugcggaugcaccgcgagagcgggcugugccagggcuucaagucccugcggguggcccgccggcucugcaagagcaagggguccagccugaucaucuccauccugcucagcgugcugauccuguccuucgucacccccaucgagggcacccucaccaacuaccccaccgaccagaaguacacgcuggacgagaucgccgacgugcugcaggcgaagacccacgaggacagcaccaaguacuacaucauccucuacaccucccuguucggcgccgggcugacgaucaucuucgccggcguggcccucgggcugaccaucauccuggagguccucaccaagaucaacgugaucuucugcaacgagugcaacauguaccacagcaagaaguccaucaaguacgucggcgacuucaccaacaagugcggguucugcacgugcggccugcuggaggaccccgagggcguggugguccacaaggccaagaaguccugcaccuacagcuaccagaucaacugggugcgcgggaucaugaucuucguggcguuccucuucgucauccagaacaccaucaucaugguggccgccgaggaggacugcuggaagaacgaggagcugaaggaggacugcgugggcccgcugaucgcccccaaggacugcaccgacaaggaccacaagaccuaccucagcgaggccucccugcuggcgacggccaagaagaucacccaggucgacgccgagaacguggagauccucgggaagaccauggagagcgccauccgggugaucgagcgccagaagaccuaccaccggaugcaccuccuggaggccgucuuccugaacaagcacugcgacuacuacaagauguucgagcacaacuccggcuacagccaggugaaguggcgcaugaugaucaagacgcagcacuucgacaucugcgcgcugcaggccaacucccccuucugcgcccagugcaucgccgacaacagcugcgcgcaggggagcugggaguucgacacccacaugaacuccaccuacagcuccaagguggacaacuucaagcacgacuucagccuguuccugcggaucuucgaggccgccuuccccggcaccgccuacguccaccuccugacgaacaucaaggagaagaagccguaccaggccguguccaugaucgagaagaucaagaagaaguuccccaacaacaagcugcucaucggcuaccuggacuucgggaaguaccugcucggccugagccacgcguccaccuacgagcugcagcagcgccagcucgacaagcuguaccagcccaccgagcugacccgcagcgggggccagcagacgucccucgccaacagcguggucgggcaggccaccaaggagugcaagaaguacaaggacguguccugccugagcccccgguucggcaucccgcuggaggaccucaucuccugcugcgaccagcccaacuacaacaucuacaagaagcccaagaagguguacaaggcccacgacaaggaggagaccuggugcaucaacgaccagcacugccuggucgacuucgugcccgccgaggcggacaccguggagaagcugaagccgaugaagugcuggcucgucgaccccggcaagaacgacgacguguacagcaucgccaucaagacgugccgcguggucgacaagggggugugcaccgugaacucccagaaguggaacaucaucaagugcgacagcggcccccuguacuacuccgaccacauccccggggaggacaccggcaacgacaucggccacuacugcgucagcgccgggugcaagaccgaccgguacccgaucaaccccgacguggugacggacugcgucugggaguucaccagccgcaagucccaguacaucggcaagaucagcaugcagucccuggaggacuacgagaaggcccucaccgaccggcugacccacacgcuggagaccuacagcuucgcgccccucgagaaccugccccacaucaagccgguguacaaguacaucaccgcccaggggguggagaacuccgacggcaucgagggggccuucaucaccgccagcauccccgccgcgggcggcacguccaucggguacaacguccgcagcaaggacggcuucccccugcucgaccugaucguguucgugaaguccgccgucaucaagagcaccuacaaccacaucuacgacaccgggccgaccaucuccaucaacacgaagcacgacgagcacugcaccggccagugccccagcaacaucgagcacgaggccaacuggcugaccuucucccaggagcggaccagccgcugggggugcgaggaguucggcugccucgccgugaacacgggcugcguguucggguccugccaggacgucauccggcccgagaccaagguguaccgcaaggccguggacgaggucgugauccugaccgugugcaucaccuaccccggccacaccuucugcacggagaucaacgcgaucgagccgaagaucaccgaggagaucgagcugcaguucaagaccgucgacaccaagacgcuccccuacaucguggccgugaacaaccacaagcuguacagcgggcagaucaacgaccugggcaccuucgggcagaugugcggcaacguccagaagaccaacuccagcauccucggcaccgggacgcccaaguucgacuacacgugccacggcgccucccggaaggacaucaucgugcgccggugcuacaacaacaacuucgacagcugcaagcugcugaaggaggagacccagcucaucuucaacgacgaccacgacaccaucaccgucuacaacaccaaccaccugaucggggagcuggccaucaagcucauccugggcgacauccaguacaagcuguucaccgagacccucgaccugcagaucgacgccaagugcguggggugccccgacugcuucgagagcuacuccugcaacuuccagaucgugagcaacaucgacacgaucugcucccuggagggcccgugcgacaccuuccacaaccgcaucagcaucaaggcgaugcagcagaacuacgccgucaagcucuccugccagaaggacccccggcccagcggcaccuucaagaucugcaaccgcgaguacaccgugguguuccacacggucgccaaggacgacaagaucgagaucaacgugggggaccagaccuccuucaucaaggagaaggacgaccggugcaagaccuggcugugccgcgugcgggacgagggcaucagcgucaucuucgagcccaucaaggccuucuucggguccuacuucagcaucuucuucuacaucaucgugguggucguggugggcuuccugaucaucuacaucuucaugccgauguucaugaagcucaaggagguccugaaggccaacgagaagcuguaccuccaggagaucaagcagaaguga

SEQ ID NO: 12500 - RNA, 4311 nt, Artificial Sequence
  derived and/or modified CDS sequence (opt1) from BUNV(SFCrEq231)__KP063893.1__GP
augaagaugauccugcucaucaucauccugugcgugaaccuggccgccgcgaaccccgucgccacccgcugcuuccacggcgggcagcucaucgccgagacccggagcgccacguccaucagcgaguucugccugaaggacgacguguccaugaucaagagcgagaucaccuacaccaagaacgacaccggcaucuucgggcacuccaagaucuacaagagcuggcugaucaaggacuggaagcucugcaacccggugcccacggccggcggguccaucaacgucaucgaggugaacagcgaccugucccugaccaccaaggcguacgugugcagccgcgacugcaccaucacgaucgacaaggaggaggcccagaucaucuuccagaccgacaagcucaaccacuucgaggucuccggcaccacccugagcuccggcugguucaagacgaaggccagcgugacccuggaccggaccugcgagcacaucaaggugaccugcgggaagaagacgcuccaguuccacgccugcuuccgccaccacauguccugcguccgguucuuccacaacaccauccugcccggcaccauggugaacagcaugugccagaacaucgagcugaucaucauccucgggcugacccugaucaucuucacgcucauggugauccugaccaagaccuacaucugcuacauccugaugccccucuucaugccgaucgcguacgccuacggcugggccuacaacaaguccugcaagaagugcaacugcugcgggcuggccuaccaccccuucaccaacugcggcagccacugcgucugcggccugaaguucgaggccuccgaccgcaugcggauccaccgcgagagcgggcucugccagggcuacaagagccugcggaucgcgcgccugcucugcaaguccaaggggagcucccugaucaucagcacgcugcucuccaugcugcugcucagcuucaucacccccaucgagggcaccaugaccaacuaccccgagacgcggcaguacucccuggaggagaucgccgacgugguggagggccugcucagcgagcagaacaucaaggaguacgucguguucuacaccucccuguucgggagccugauccuccugcuggccuucauccucuccaucacccugaccaaggugacgaacgcccuggcccgcaccaacgucaucuacugcgaggagugcagcauguaccacgcgaagaagggcaucaaguacaacggggacuucaccaacaagugcggcuucugcacgugcgacgagcaggaggacgaggaggggaucaucauccacaagguguccaagaagugcaccuaccgguaccagcuccagugggccaagaucaucaugaucauccuggugaugcugcucaugaugcagaacaccauccugaucgucgccgccgagaccgacugcuggaccaagaacagccuggagcuggacugcaucggcccgcuccugaccaucuccgacugcagcaacaaggaguccaagaacuacgaggaggaggccgcgaagcuggugagccaguccaagaucacgcaggccgacgccgagcaggucaccauccucggcaacaccaucgacaccgcccugaaggccauccgcagccagaagacguaccagaccaugcaccuccucgagagcguguuccugaugaagaacugcgacuacuacuccagcuucgagcccaacuccggguacagccaggcgaaguggcggcugaucgccaagaccucccacuucgacaucugcagccgccacuccaugcaccacuucugccggugcguggccgacggcaccaagugccagaacggggacugggacuucgccggcgagaugaacaacaucuacagcacgaagaacgacuucuaccuccacgaccugaaccuguucuucacccuccacgagaccgcguuccccgggaccacggagucccuguucuaccagcugaucgccaagaagaacaccaccggcgccagcaagcuccugggcaagcugaucaccaaguacgggaacaacaagcuguucgucggcaucuggaaguucgggcaguaccugcugacgcuccccuacgugaacaccaccgagcuguccaagacccgccgggagacgauccugaagacccaccagauccucacccgcagccagggcgggcgguccgagagcauguccagcgccgaggugggccagaucgccaaggagugcgcgaacgccaagaacgucggcugcaucuccccgcgcuucgggauccccaucggcaaccugaccgccugcgggaacagccccaacuacaagaucuacaagacgcccaacaagaucuacaagagcaacaaccgcggcgagguguggugcuccgaggacgugcacugccuggccgacuucgagccggccgacaccgaggucgugaacaaggugaagaagaugaccugcuuccucagcgacgucaacacccgggcggacaucuucuccaucgccaucagcgccugccgcaugguggacaagggcgugugcacggucaacggggccaaguggaacauccugaagugcgaguccggccuguacuacuucaccgaccaccgggaggggcaggacaccggcaacgacuucggggaguacugcaucagccacuccugcaacaccgagcgcuaccccaucaaccccgacauccucaaggagugcaucugggaguaccacagccggaaguccaaguacaucagcacgaucaaccuggagucccuggaggaguucaagcgcgccaugagcgacaagcucucccacacccugaugguguacaacuucaagcccaccgcgaaccugccgcacaucaagcccagcuacaaguucaucaccgccaacggcaucgagaacuccgacggccucgagagcgccuacauccuguccagcauccccgccaucgggggcauguccaucggguacaacauccagacgaaggacaacuucccccugcucgaccugaucguguucgucaagagcgcggugaucaagaccaccuacaaccacaucuacgacaccggcccgaccaucgggaucaacacgaaccacgacgagcacugcaccggccccugccccaccaucaucccccacaaggagaacuggcugaccuucagccaggagcggacgucccgcuggggcugcgaggaguucgggugccucgccaucaacaccggcugcguguucgggagcugccaggacgucauccacccggagaccaagaucuaccggaaggccguggaggaggaggugguccugaccgugugcaucaacuuccccggcaacacguucugcaccgagaucaacgccaucgagcccaagaucaccgacgagaucgagcugcaguucaagaccguggacacgaagacccucccgaaccugcuggccguccagaaccacaagcucuacuccgggcagaucaacgaccugggcagcuucucccagggcugcgggaacgugcagaagaccaaccagagcauccugggcgcggggaccgugaaguucgacuacgucugccacggcgccucccgcaaggacaucaucgugcggcgcugcuacacgaacaacuacgacagcugcaagcuccugaaggaggagcggucccugaucuucgccgacaaccacgagacccucgagguggccaacacccgccaccugaucggggagcugcaguucaagaucaugcucggcgacauccgguacaaggccuucgcggagaagcccgagcuggagaucgacgccaagugcgucggcugccccagcugcuucgaguccuacagcugcaacuuccagaucgugaccuccaucgacacggugugcagcgucgaggggcccugcacccuguuccacaaccgcaucaucaucaccgccgccaagcaguccuacggcgugaagaugagcugcaagaccaagccggggcccguggaggaguucacgaucugcaaccggaacuaccgcgucuccuucgccaccaucgacaagaacgacaagaucgagaucaacaccggcgaccagaccagcuacaucguggagaaggacucccggugcaagacguggcucugccgcgugcgcgacgagggcaucagcgucaucuucgagccccugaaggcguucuucgggagcuacuucuccaucgccuucuacaucaucaucggcaucgccgcccuguuccucaucaucuacaucuuccugcccauguucuucaagcugcgggacgugcucaagaagaacgaguaccuguaccugcaggagcucaagcacaaguga

SEQ ID NO: 12501 - RNA, 4302 nt, Artificial Sequence
  derived and/or modified CDS sequence (opt1) from BUNV(GSA/S4/11232/WT)__KM507339.1__GP
augcgcauccugauccuccugcuggccgugaccaagcucgccgucggcagccccguggugacccggugcuuccacgggggccagcugaucgcggagcgcaagucccagacgagcaucuccgaguucugcaucaaggacgacgucagcaugcugaaguccgagaucguguacaccaagaacgacaccgggaucuucggccacagcaagguguuccggcacuggaccaucacggacuggaaggccugcaacccggucgugaccgccgggggcuccaucaacgugaucgaggucgacaagaaccucaaccuggugacccgcaacuacgugugcaccggcgacugcacgaucaccgucgacaaggagaacgcccagaucaucuuccagaccgaccggcugaaccacuucgaggugaccgggacgaccaucagcaccggcugguucaaguccaaggccagcgugacccucgaccgcacgugcgagcacaucaaggucuccugcgggaagaagacccugcaguuccacgcgugcuucaagcagcacaugagcugcgugcgguuccugcaccgcuccauccuccccggcagcauggccaucuccaucugccagaacaucgagcugaucaucaucaccauccuggcccucugcaucuucaucaucaugaucauccugaccaagacguacaucugcuacgugcugauccccgucuucaugcccaucgccuucgcguacgggugggccuacaaccggagcugcaagaagugcacgugcugcggccucgccuaccacccguucaccaacugcggcuccuacugcgugugcgggagcaaguucgagaccuccgaccgcaugcggaugcaccgcgagagcggccugugccagggguucaagagccugcggguggcccgccggcucugcaaguccaagggcagcucccugaucaucagcauccugcucuccguccugauccugagcuucgugacccccaucgagggcacccucaccaacuaccccaccgaccagaaguacacgcuggacgagaucgccgacgugcugcaggcgaagacccacgaggacuccaccaaguacuacaucauccucuacaccagccuguucggggccggccugacgaucaucuucgccggggucgcccucggccugaccaucauccuggaggugcucaccaagaucaacgucaucuucugcaacgagugcaacauguaccacuccaagaaguccaucaaguacgugggggacuucaccaacaagugcggcuucugcacgugcggccugcuggaggaccccgaggggguggucgugcacaaggccaagaaguccugcaccuacagcuaccagaucuccugggugaagggcaucaugaucuucgucgcguuccucuucgugauccagaacaccaucaucaugguggccgccgaggaggacugcuggaagaacgaggagcugaaggaggacugcgucgggccgcugaucgcccccaaggacugcaccgacaaggaccgcaagaccuaccucagcgaggccucccugcuggcgacggccaagaagaucacccagguggacgccgagaacguggagauccucggcaagaccauggagagcgccauccgggucaucgagcgccagaagaccuaccaccggaugcaccuccuggaggccguguuccucaacaagcacugcgacuacuacaagauguucgagcacaacuccggguacagccaggugaaguggcgcaugaugaucaagacgcagcacuucgacaucugcgcgcugcaggccuccagccccuucugcgcccagugcaucgccgacaacagcugcgcgcagggcuccugggaguucgacacccacaugaacagcaccuacuccagcaaggucgacaacuucaagcacgacuucucccuguuccugcggaucuucgaggccgccuuccccggcaccgccuacgugcaccuccugacgaacaucaaggagaagaagccguaccaggccgugagcaugaucgagaagaucaagaagaaguuccccaacaacaagcugcucaucggguaccuggacuucggcaaguaccugcucgggcugucccacgcgagcaccuacgagcugcagcagucccagcucgacaagcuguaccagcccaccgagcugacccgcagcggcgggcagcagacgucccucgccagcuccgucgugggccaggccaccaaggagugcaagaaguacaaggacgugagcugccugagcccccgcuucggcaucccgcuggaggaccucaucagcugcggggaccagcccaacuacaacaucuacaagaagcccaagaaggucuacaaggcccacaacaaggaggagaccuggugcaucaacgaccagcacugccugguggacuucgugcccgccgaggcggacaccgucgagaagcugaagccgaugaagugcuggcucguggaccccggcaagaacgacgacguguacuccaucgccaucaagacgugccgggucaucgacaagggggugugcaccgugaacagccagaaguggaacaucaucaagugcgacagcgaccugcuguacuacuccgaccacguccccggcgaggacaccggcaacgacaucgggcacuacugcgugagcgccggcugcaagaccgaccgcuaccccaucaacccggacguggucacggacugcgugugggaguucaccucccggcgcagccaguacaucgggaagaucuccaugcagagccucgaggacuacaagaaggcccugaccgaccggcugacccacacgcucgagaccuacuccuucgcgccccuggagaaccugccccacaucaagcccguguacaaguacaucaccgcccagggcgucgagaacagcgacgggaucgagggcgccuucaucaccgccuccaucccggccgcgggcgggacgagcaucggcuacaacgugcgcuccaaggacggguucccccuccuggaccugaucguguucgucaagagcgccgugaucaaguccaccuacaaccacaucuacgacaccggccccaccaucagcaucaacacgaagcacgacgagcacugcaccgggcagugcccguccaacaucgagcacgaggccaacuggcucaccuucagccaggagcggaccucccgcuggggcugcgaggaguucggcugccuggccgugaacacggggugcgucuucggcagcugccaggacgugauccggcccgagaccaagguguaccgcaaggccgucgacgagaucgugauccugaccgugugcaucaccuaccccgggcacaccuucugcacggagaucaacgcgaucgagcccaagaucaccgaggagaucgagcuccaguucaagaccgucgacaccaagacgcugccguacaucguggccgugaacaaccacaagcuguacuccggccagaucaacgaccucgggaccuucggccagaugugcggcaacguccagaagaccaacagcagcauccuggggaccggcacgcccaaguucgacuacacgugccacggggccucccggaaggacaucaucgugcgccggugcuacaacaacaacuucgacagcugcaagcugcucaaggaggagacccagcugaucuucaacgacgaccacgacaccaucaccgucuacaacaccaaccaccugaucggcgagcucgccaucaagcugauccugggggacauccaguacaagcuguucaccgagacccuggaccugcagaucgacgccaagugcgugggcugccccgacugcuucgaguccuacagcugcaacuuccagaucguguccaacaucgacacgaucugcaaccucgagggccccugcgacaccuuccacaaccgcaucagcaucaaggcgaugcagcagaacuacgccgucaagcuguccugccagaaggacccggggcccagcggcaccuucaagaucugcaaccgggaguacaccgugguguuccacacggucgccaaggacgacaagaucgagaucaacgugggggaccagaccuccuucaucaaggagaaggacgaccgcugcaagaccuggcugugccgggugcgcgacgagggcaucagcgucaucuucgagcccaucaaggccuucuucggcuccuacuucagcaucuucuucuacaucaucaucaucgugguggucggguuccucaucaucuacaucuucaugcccauguucaugaagcugaaggaggugcugaaggccaacgagaagcucuaccugcaggagaucaagcagaaguga

SEQ ID NO: 12502 - RNA, 4302 nt, Artificial Sequence
  derived and/or modified CDS sequence (opt1) from BUNV(MGD/S1/12060/WT)__KM507340.1__GP
augcgcauccugauccuccugcuggccgugaccaagcucgccgucggcagccccguggugacccggugcuuccacgggggccagcugaucgcggagcgcaagucccagacgagcaucuccgaguucugcaucaaggacgacgucagcaugcugaaguccgagaucguguacaccaagaacgacaccgggaucuucggccacagcaagguguuccggcacuggaccaucacggacuggaaggccugcaacccggucgugaccgccgggggcuccaucaacgugaucgaggucgacaagaaccucaaccuggugacccgcaacuacgugugcaccggcgacugcacgaucaccgucgacaaggagaacgcccagaucaucuuccagaccgaccggcugaaccacuucgaggugaccgggacgaccaucagcaccggcugguucaaguccaaggccagcgugacccucgaccgcacgugcgagcacaucaaggucuccugcgggaagaagacccugcaguuccacgcgugcuucaagcagcacaugagcugcgugcgguuccugcaccgcuccauccuccccggcagcauggccaucuccaucugccagaacaucgagcugaucaucaucaccauccuggcccucugcaucuucaucaucaugaucauccugaccaagacguacaucugcuacgugcugauccccgucuucaugcccaucgccuucgcguacgggugggccuacaaccggagcugcaagaagugcacgugcugcggccucgccuaccacccguucaccaacugcggcuccuacugcgugugcgggagcaaguucgagaccuccgaccgcaugcggaugcaccgcgagagcggccugugccagggguucaagagccugcggguggcccgccggcucugcaaguccaagggcagcucccugaucaucagcauccugcucuccguccugauccugagcuucgugacccccaucgagggcacccucaccaacuaccccaccgaccagaaguacacgcuggacgagaucgccgacgugcugcaggcgaagacccacgaggacuccaccaaguacuacaucauccucuacaccagccuguucggggccggccugacgaucaucuucgccggggucgcccucggccugaccaucauccuggaggugcucaccaagaucaacgucaucuucugcaacgagugcaacauguaccacuccaagaaguccaucaaguacgugggggacuucaccaacaagugcggcuucugcacgugcggccugcuggaggaccccgaggggguggucgugcacaaggccaagaaguccugcaccuacagcuaccagaucuccugggugaagggcaucaugaucuucgucgcguuccucuucgugauccagaacaccaucaucaugguggccgccgaggaggacugcugggagaacgaggagcugaaggaggacugcgucgggccgcugaucgcccccaaggacugcaccgacaaggaccgcaagaccuaccucagcgaggccucccugcuggcgacggccaagaagaucacccagguggacgccgagaacguggagauccucggcaagaccauggagagcgccauccgggucaucgagcgccagaagaccuaccaccggaugcaccuccuggaggccguguuccucaacaagcacugcgacuacuacaagauguucgagcacaacuccggguacagccaggugaaguggcgcaugaugaucaagacgcagcacuucgacaucugcgcgcugcaggccuccagccccuucugcgcccagugcaucgccgacaacagcugcgcgcagggcuccugggaguucgacacccacaugaacagcaccuacuccagcaaggucgacaacuucaagcacgacuucucccuguuccugcggaucuucgaggccgccuuccccggcaccgccuacgugcaccuccugacgaacaucaaggagaagaagccguaccaggccgugagcaugaucgagaagaucaagaagaaguuccccaacaacaagcugcucaucggguaccuggacuucggcaaguaccugcucgggcugucccacgcgagcaccuacgagcugcagcagucccagcucgacaagcuguaccagcccaccgagcugacccgcagcggcgggcagcagacgucccucgccagcuccgucgugggccaggccaccaaggagugcaagaaguacaaggacgugagcugccugagcccccgcuucggcaucccgcuggaggaccucaucagcugcggggaccagcccaacuacaacaucuacaagaagcccaagaaggucuacaaggcccacaacaaggaggagaccuggugcaucaacgaccagcacugccugguggacuucgugcccgccgaggcggacaccgucgagaagcugaagccgaugaagugcuggcucguggaccccggcaagaacgacgacguguacuccaucgccaucaagacgugccgggucaucgacaagggggugugcaccgugaacagccagaaguggaacaucaucaagugcgacagcgaccugcuguacuacuccgaccacguccccggcgaggacaccggcaacgacaucgggcacuacugcgugagcgccggcugcaagaccgaccgcuaccccaucaacccggacguggucacggacugcgugugggaguucaccucccggcgcagccaguacaucgggaagaucuccaugcagagccucgaggacuacaagaaggcccugaccgaccggcugacccacacgcucgagaccuacuccuucgcgccccuggagaaccugccccacaucaagcccguguacaaguacaucaccgcccagggcgucgagaacagcgacgggaucgagggcgccuucaucaccgccuccaucccggccgcgggcgggacgagcaucggcuacaacgugcgcuccaaggacggguucccccuccuggaccugaucguguucgucaagagcgccgugaucaaguccaccuacaaccacaucuacgacaccggccccaccaucagcaucaacacgaagcacgacgagcacugcaccgggcagugcccguccaacaucgagcacgaggccaacuggcucaccuucagccaggagcggaccucccgcuggggcugcgaggaguucggcugccuggccgugaacacggggugcgucuucggcagcugccaggacgugauccggcccgagaccaagguguaccgcaaggccgucgacgagaucgugauccugaccgugugcaucaccuaccccgggcacaccuucugcacggagaucaacgcgaucgagcccaagaucaccgaggagaucgagcuccaguucaagaccgucgacaccaagacgcugccguacaucguggccgugaacaaccacaagcuguacuccggccagaucaacgaccucgggaccuucggccagaugugcggcaacguccagaagaccaacagcagcauccuggggaccggcacgcccaaguucgacuacacgugccacggggccucccggaaggacaucaucgugcgccggugcuacaacaacaacuucgacagcugcaagcugcucaaggaggagacccagcugaucuucaacgacgaccacgacaccaucaccgucuacaacaccaaccaccugaucggcgagcucgccaucaagcugauccugggggacauccaguacaagcuguucaccgagacccuggaccugcagaucgacgccaagugcgugggcugccccgacugcuucgaguccuacagcugcaacuuccagaucguguccaacaucgacacgaucugcaaccucgagggccccugcgacaccuuccacaaccgcaucagcaucaaggcgaugcagcagaacuacgccgucaagcuguccugccagaaggacccggggcccagcggcaccuucaagaucugcaaccgggaguacaccgugguguuccacacggucgccaaggacgacaagaucgagaucaacgugggggaccagaccuccuucaucaaggagaaggacgaccgcugcaagaccuggcugugccgggugcgcgacgagggcaucagcgucaucuucgagcccaucaaggccuucuucggcuccuacuucagcaucuucuucuacaucaucaucaucgugguggucggguuccucaucaucuacaucuucaugcccauguucaugaagcugaaggaggugcugaaggccaacgagaagcucuaccugcaggagaucaagcagaaguga

SEQ ID NO: 12503 - RNA, 4308 nt, Artificial Sequence
  derived and/or modified CDS sequence (opt1) from Ab-BUNV(Cu20-XJ)__KJ710423.1__GP
auggccaucagcaucgugcugaugaucaucuucuccaccaccagcugccucgcccgcgcggcccccuccaucagcaagugcuuccaggacggcguccugaucgccgagaagaaguccagcuccgggaucagcgaguucugcaucaaggacgacaucuccauccucaagagcgagaucaacuacuccaagaacgacacgggcaucuucaugcacagcaagguguuccggcacuggaccguggccgacuggaagcagugccagccgauccccuccgccgggggcagcaucaacguccucgagguggacaagaaccugaaccugguggcgaagaacuacaugugcacccgccccugcgucaucaccaucgacaaggagaacgcccagcuccuguuccagacggagcagcugaaccaguucgaggugaccgggaccaccaucuccacgggcugguucaagagcaagaccuccgugagccucgacaacacgugcgagcacaucaaggugaccugcggcaagaagucccugcaguuccacgccugcuucaagcagcacaugagcugcguccgguuccugcaccgcagcgugcuccccggguacauggccaacuccaucugccagaacaucgagcugaucaucaucaucacccugacccucgcgaucuucaucuucaugugcaucaucacccggaccuacaucugcuacaucaugcugccgcuguucgcccccaucgccuacaucuacggcuggcucuacaaccgcagcugcaagaagugcaucugcugcgggcuggccuaccaccccuucacgaacugcggcuccuacugcgucugcgggagccgguucgagaccuccgaccgcaugcggcugcaccgcgagagcggccucugccagggcuucaagucccugcggguggcccgcacccugugcaagagcaagggguccagccucgugaucuccguccugaccgcgaugcugauccucagcuucgugacgccccuggaggccaucuccaccaacuacccgaccgaccggaaguacacccugaacgaggugaacgacaucguccucggcaaggggacggagaacgagcugaagaccagcauccuggcccucguguccaucugcggcaucggcaucaucaucaucuucaucgcccugaccaugcugcucgacaucgugcuggaggccaucgcgaagcgcagcaccaucuucugcacggagugcaaccugauccacgacaagaaggccaugaaguucgucggggacuucaccaacaagugcggcuucugccccugcggggagcucgaggaccccgagggccuggugauccacaccacccggaaguccugcacguacuacaucaagauccgcaaccugaagcucaucaugcugguguucagcaucgccauccugaugcagaacaccgccaugcucgucguggccgacgagaacugcuggaccaacaccgagaucaaggcggacugcgucgggccccugaucggcccgacgaccugcaccaacaagggcuccaagaccuacaaggccguggcccaggagcuggugaccagcaacaagaucacgcagcucgacgccgacaaguacacccugcugggggacaccaucgagagcgcccuguccgcgaucaccgagcagaagcacuacagcgccauccaccuccuggagacgaucuuccugaugaagcacugcgacuacuacaaggucuacgagcacaacuccggcuacagccagaccaaguggcggcucaucgccaagaccaacuccuucgacaucugcagcauccccuccacccccaacuucugcaagugccugagcgacuccagcugcuccacgagcacccugaacuucgccaccuccaugaacagcaccuacacguccaaggcggaguacuucaaccacgacuucacccucuuccugaacaucuucgaggccgccuuccccgggagcgccaccgccuuccuguucaagaagaucaaggagaaggcgccguaccaggccuucgagaugaugggcaagaucgccaacaaguaccccaacaacaagcuccugguggugcugcucaaguacgggcaguacauggucggccugucccacgccagcaccuaccagcugaagcaggaguggaucgccaagagccucucccuggugcgcagcacgaagaccggccugaagauggcgaugaccaacgccgagcccgggcccgccaccaaggagugcuccgacgccaagacgaucgccugccucaccccgaaguuccagguggaggucaacaaccugaugagcugcggcgcgucccccaacuucaagaucuacaugaaguccggggagcuguacaaggcccacgaccggaacagcguguggugccucaacgacaugcacugccugacccccuacacccccgccaacgccgagcugguggcgacgaugaagaagauggagugcuggcaggacaacccgaagcagcccaccaacgacuacgccacgccccgccggagcugccagaugaaggaccgcggccucugcaacgucggggccgacaaguggaaggugaucaagugcgacgacgaccugauguucuacaccgacgcccuggagucccccgacccggccgcggacaucggccaguacugcuucagcgagaagugccagaucgagcgcuaccccaucaaccccaccucccucaccaacugcgaguggcuguaccgggccgugaagccgcaguacaucaagcgccugagccuccagaccaucgaggaguacaagaaggccaucaccgacaagcugacgcacacccugcagcucuaccacuucgcgccccuggagaaccugccccacauccggcccaccuacgaguacaucaccgcccagggcacguacaccgccgacgggaucgagggcgccuccaucaucaccagcaucccggcccucuccgggaccagcgucggcuucaagaucaacgccaaggacggcaccgcccugcuggacaucgugguguacaucaaguccagcgucgugaaguccguguacaaccacaucuacgacacggggcccaccaucaacaucaacagcaagcacgacgagcucugcaccggccagugccccaagcgcauccccgcggacccgaacuggcugaccuucagccaggagcggacgucccgcugggggugcgaggaguucggcugccuggccaucaacaccgggugcgucuacggcagcugccaggacgugauccggaccgagaccaagguguaccgcaaggccaacgaggagacggucaugcucaccgugugcaucaccuaccccggccacaccuucugcacggacgugaacgcccuggagcccaagaucaccgacgagcuggagcuccaguucaagaccaucgacaucaagucccugcccaaccuggucgcgaucaccaaccacaagcucuacacggggcagaucaacgaccugggcaccuucgggcagaugugcggcaacgugcagaagaccaacaccagcauccugggggccggcacgccgaaguucgacuacacgugcuacuccgccagccggaaggacaucaucauccgccggugcuacaacaacaacuacgacuccugccgccuccugaagcaggagggcgaccugcuguucgacgacaaccacgagacccugaucguguacaacaacaagcggcugaacggggagcucaccaugaagcugcugcucggcgacauccaguacaagcuguacaccgagaacauggagcuggagcucgaggccaagugcgucgggugcgugggcugcuucgagagcuaccagugcaaccugcagaucaccuccagccuggacgggaacugcgccaucuccggccccugcgagaccuuccacgaccgcauccagaucaagaccacgaagaaggacuacgcgcucaagcuggccugcaccaaggaccccggcgacaaggccaccuuccgggugugcgggaaggacuacgacuucaacuuccacaccgucgugaagaacgacaagaucgaggugaacgucggcgacgagacgagcuacaucaaggagaaggacgcccgcugcgggaccuggcugugccgggugcgcgacgagggccucuccgugaucuucgagccccugaagaacuucuucgggaacuaccugaacauguuccucuacauccugggcggcguccugcuccuguuccugagccucuacaucaucaugccggugugcgcccggcugcgcgacgagcugaagaagaacgagaagcuccaccagauggagaugaagaagcgcuga

SEQ ID NO: 12504 - RNA, 4305 nt, Artificial Sequence
  derived and/or modified CDS sequence (opt1) from ANADV(EIV-13128Kam)__KT313718.1__GP
auguuccugauccucgugcugcugauccccuucuacaucaccgccaccccggucacgacccgcugcuuccacggcgggcagcucaucgccgagagcaagucccugaccgcgaucagcgaguucugccugaaggacgacguguccaccgucaagagcgagaucacguaccucaagaacgacaccggcaucuucgcccacuccaaggugcugcggaacuggaucaucaaggacuggaagaacugcaaccccgugcccaccgccgggggcagcaucaacgugaucgaggucaacaccgaccugucccucagcacgaagaccuacgugugcucccgcgacugcaccaucaccguggacaaggaggacgcccagaucaucuuccagacggacaagcugaaccacuucgaggucagcgggaccacccuguccagcggcugguucaagaccaaggccuccgugacgcucgaccggaccugcgagcacaucaaggugaccugcggcaagaagacccugcaguuccacgcgugcuucaagcaccacaugagcugcauccgcuucuuccacaacacgauccugcccgggaccauggccgucuccaucugccagaacaucgagcucaucaucaucaccagccugacccugaucaucuucauccucauggugauccugacgaagaccuacaucugcuacgugcugaugccgcuguucaugcccgucgccuaccuguacggcugggccuacaaccgguccugcaagaagugcagcugcugcgggcuggcguaccaccccuucaccaacugcggcucccacugcgugugcgggcucaaguucgaggccagcgaccgcaugcggauccaccgcgagagcggccugugccagggcuacaagucccugcggguggcccgccuccugugcaagagcaagggguccagccugaucaucuccauccuccugagcguccugauccucuccuucgugacccccaucgagggcacgcugaccaacuacccggagagcaagaaguacucccuggaggagaucgccgacgugaucgagggguucaucgccgagaagggcaucaaggaguacaucguccucuacaccagcaucuucggcgcgcugcugcuccugaucgcccugaucaucaccgugucccucaaccggaucacggaguaccugaccaaccugaacgugaucuacugccacgagugcagcauguaccacuccaagaagaacaucaaguacaucggggacuucaccaacaagugcggcuucugcacgugcggggagcucgaggaccaggagggccugaacaugcacaaggucagcaagaagugcaucuaccgcuaccagcugaccugguccaaggugaucaugaccauccucgucugccugcugaucgcccagaacaccgugcugaucguggccgccaacgacgacugcugggcgaagcagagccucgagaucgagugcgucgggccccugcagcaggucgacgccugcgaggacaaguccagccgguccuacaacggcgaggccaagaagcuggugggcaccagcaaggugaccgagcucgacgccggccaggugaaccugcuggggcagacgaucgagagcgccaucaucgcgauccgcaagcagcggaccuacgccaccaugcacuuccucgaguccguguuccuggggcgccacugcgacuacuacaaggucuucgagcacaacagcggcuacucccaggccaaguggcggcugcucgccaagaccaaccacuucgacaucugcagccgccacuccacgcaccacuucugccggugcaugagcgacgggaccaagugcgagaacggcaacugggacuucgccggcgagaugaacaccaccuaccacuccaagcgcgacuucuucaagcacgacuucaaccuguucugcacgcugcucgagaacgcguuccccgggaccaccgagagccuguacuaccagcugcucuccaagcggaacaccacgggcgccagcaagcugcuggggaagcucaucaccaaguucggcaacaacaaccuguucguggggaucuggaaguucggccaguuccugcucucccugcccuacgugaacaacaccgagcugagcgcccuccaguccagcaagauccuggaguccccggagccccugcuccgcagcgccuccggccgccaggagagccugagcuccaccacgcccggggaggcgagcaaggagugccggaacgccaagaagaucuccugcaucagcccccgcuucggcgucccgauggagaaccugaccgccugcggggagucccccaacuacaagaucuacaagacccccacccggaucuacaagagcaacaacaagggcgagaucuggugcgccggcgacgugcacugcuuccaggaguucacgcccgugcuccaggaggucguggacaagcugaagaagaugaccugcuuccugaccgagccggaggccgaggaggacgcguucuccaucgccaucgccaugugcaagauccucgacaagggggugugcaccaucaacagcgagcgcuggaacaucaucaagugcgacuccggccugauguacuacacggaccagcgggacgggcaggacaccggcaacgacuucggggaguacugcaucagccacaacugcaagaccgagcgcuuccccaucaaccccuccaucaucagcgacugcaucugggaguaccacucccgcaagagccgguacaucuccacccugaaccucgagagccuggaggaguucaagcgggccaucuccgagaagcugagccacacgcucgucguguaccaguucaagcccaccuccaaccugccgcacaugaagcccguguacaaguacaucaccgcccagggcgucgagaacagcgacggcaucgacagcgcguucaucaccgccuccaugcccgcccugagcgggacguccaucggcuacaacgugaugagcaaggacaacuucccccucuucgacaucaucaucuucaucaaguccgccgugaucaagaccaccuacaaccacaucuacgacaccgggccgacgaucggcaucaacgucaugcacgacgagcacugcaccgggcagugccccaucgagaucccccacaaggagaacuggcugaccuucagccaggagcgcaccucccgguggggcugcgaggaguucggcugccuggccaucaacaccgggugcguguucggcagcugccaggacaucauccgcccggagacgaagguguaccggaaggcgaucgaggaguccguccuccugaccgugugcgugaccuaccccgggaacaccuucugcacggagaucaacgccaucgagcccaagaucaccgacgagcuggagcuccaguucaagaccgucgacaccaagacgcugcccaaccugcucgccgugcagaaccacaagcuguacagcggccagaucaacgaccugggguccuucgcccagggcugcggcaacauccagaagaccaaccucagcgugaucgggaccggcaccgcgaaguucgacuacaucugccacggggccucccgcaaggacaucgucgugcggcgcugcuacaacaacaacuacgagagcugcaagcugcugaaggaggagccgucccucaucuucagcgacaaccacgagacgaucgagguggccaacauccggcaccuccugggcgagcuccaguucaagcugaugcugggggaccuccgcuacaaguccuucgccgagaaccccgagcuggagaucgaggccaagugcgucggcugccccagcugcuucuccagcuacagcugcaacuuccggaucuccagcuccaucgacaccgugugcgcgaucgacggccccugcaccaucuuccacaaccgccugaucaucagcuccaccaagcaggacuacgggaucaagaugagcugcaaggagaagccgaaccccguggagaaguucaacaucugcaagcgcaucuacuccguccucuucacgaccaucgacaagagcgacaagaucgagaucaacaccggcgaccagaccuccuucauccaggagaaggacgaccggugcaagacguggcugugccgcgugcgggacgaggggaucagcgugaucuucgagcccaucaaggccuucuucggcuccuacuucagcaucgccuucuacgucgugaucggcaucaucgcccuguucaucaccaucuacaucuuccuccccaugguguucaagcugaaggacauccugaagaagaacgagcuccuguaccugcaggagaugaaguacaaguga

SEQ ID NO: 12505 - RNA, 4305 nt, Artificial Sequence
  derived and/or modified CDS sequence (opt1) from ANADV(EIV-13130Kam)__KT313721.1__GP
auguuccugauccucgugcugcugauccccuucuacaucaccgccaccccggucacgacccgcugcuuccacggcgggcagcucaucgccgagagcaagucccugaccgcgaucagcgaguucugccugaaggacgacguguccaccgucaagagcgagaucacguaccucaagaacgacaccggcaucuucgcccacuccaaggugcugcggaacuggaucaucaaggacuggaagaacugcaaccccgugcccaccgccgggggcagcaucaacgugaucgaggucaacgccgaccugucccucagcaccaagacguacgugugcucccgcgacugcaccaucaccguggacaaggaggacgcccagaucaucuuccagaccgacaagcugaaccacuucgaggucagcgggacgacccuguccagcggcugguucaagaccaaggcguccgugacccucgaccggacgugcgagcacaucaaggugaccugcggcaagaagacccugcaguuccacgccugcuucaagcaccacaugagcugcauccgcuucuuccacaacaccauccugcccgggacgauggccgucuccaucugccagaacaucgagcucaucaucaucaccagccugacccugaucaucuucauccucauggugauccugaccaagacguacaucugcuacgugcugaugccgcuguucaugcccgucgccuaccuguacggcugggcguacaaccgguccugcaagaagugcagcugcugcgggcuggccuaccaccccuucaccaacugcggcucccacugcgugugcgggcucaaguucgaggccagcgaccgcaugcggauccaccgcgagagcggccugugccagggcuacaagucccugcggguggcccgccuccugugcaagagcaagggguccagccugaucaucuccauccuccugagcguccugauccucuccuucgugacccccaucgagggcacccugacgaacuacccggagagcaagaaguacucccuggaggagaucgccgacgugaucgagggguucaucgcggagaagggcaucaaggaguacaucguccucuacaccagcaucuucggcgcccugcugcuccugaucgcccugaucaucaccgugucccucaaccggaucaccgaguaccugacgaaccugaacgugaucuacugccacgagugcagcauguaccacuccaagaagaacaucaaguacaucggggacuucaccaacaagugcggcuucugcacgugcggggagcucgaggaccaggagggccugaacaugcacaaggucagcaagaagugcaucuaccgcuaccagcugaccugguccaaggugaucaugaccauccucgucugccugcugaucgcccagaacaccgugcugaucguggccgcgaacgacgacugcugggccaagcagagccucgagaucgagugcgucgggccccugcagcaggucgacgccugcgaggacaaguccagccgguccuacaacggcgaggccaagaagcuggugggcaccagcaaggugaccgagcucgacgccggccaggugaaccugcuggggcagaccaucgagagcgcgaucaucgccauccgcaagcagcggacguacgccaccaugcacuuccucgaguccguguuccuggggcgccacugcgacuacuacaaggucuucgagcacaacagcggcuacucccaggccaaguggcggcugcucgccaagaccaaccacuucgacaucugcagccgccacuccacccaccacuucugccggugcaugagcgacgggacgaagugcgagaacggcaacugggacuucgcgggcgagaugaacaccaccuaccacuccaagcgcgacuucuucaagcacgacuucaaccuguucugcacccugcucgagaacgccuuccccgggacgaccgagagccuguacuaccagcugcucuccaagcggaacaccaccggcgccagcaagcugcuggggaagcucaucacgaaguucggcaacaacaaccuguucguggggaucuggaaguucggccaguuccugcucucccugcccuacgugaacaacaccgagcugagcgcccuccaguccagcaagauccuggaguccccggagccccugcuccgcagcgcguccggccgccaggagagccugagcuccgccacccccggggaggccagcaaggagugccggaacgccaagaagaucuccugcaucagcccccgcuucggcgucccgauggagaaccugaccgccugcggggagucccccaacuacaagaucuacaagacgcccacccggaucuacaagagcaacaacaagggcgagaucuggugcgcgggcgacgugcacugcuuccaggaguucacccccgugcuccaggaggucguggacaagcugaagaagaugaccugcuuccugacggagccggaggccgaggaggacgccuucuccaucgccaucgccaugugcaagauccucgacaagggggugugcaccaucaacagcgagcgcuggaacaucaucaagugcgacuccggccugauguacuacaccgaccagcgggacgggcaggacaccggcaacgacuucggggaguacugcaucagccacaacugcaagacggagcgcuuccccaucaaccccuccaucaucagcgacugcaucugggaguaccacucccgcaagagccgguacaucuccacccugaaccucgagagccuggaggaguucaagcgggcgaucuccgagaagcugagccacacccucaucgucuaccaguucaagcccaccuccaaccugccgcacaugaagcccguguacaaguacaucacggcccagggcguggagaacagcgacggcaucgacagcgccuucaucaccgccuccaugcccgcccugagcgggaccuccaucggcuacaacgucaugagcaaggacaacuucccccucuucgacaucaucaucuucaucaaguccgcggugaucaagaccacguacaaccacaucuacgacaccgggccgaccaucggcaucaacgugaugcacgacgagcacugcaccgggcagugccccaucgagaucccccacaaggagaacuggcugacguucagccaggagcgcaccucccgguggggcugcgaggaguucggcugccuggccaucaacaccgggugcgucuucggcagcugccaggacaucauccgcccggagaccaagguguaccggaaggccaucgaggaguccgugcuccugaccgucugcgugacguaccccgggaacaccuucugcaccgagaucaacgccaucgagcccaagaucaccgacgagcuggagcuccaguucaagacgguggacaccaagacccugcccaaccugcucgcgguccagaaccacaagcuguacagcggccagaucaacgaccugggguccuucgcccagggcugcggcaacauccagaagaccaaccucagcgugaucgggacgggcaccgccaaguucgacuacaucugccacggggccucccgcaaggacaucgugguccggcgcugcuacaacaacaacuacgagagcugcaagcugcugaaggaggagccgucccucaucuucagcgacaaccacgagaccaucgagguggccaacauccggcaccuccugggcgagcuccaguucaagcugaugcugggggaccuccgcuacaaguccuucgcggagaaccccgagcuggagaucgaggccaagugcgugggcugccccagcugcuucuccagcuacagcugcaacuuccggaucuccagcuccaucgacaccgucugcgccaucgacggccccugcacgaucuuccacaaccgccugaucaucagcuccaccaagcaggacuacgggaucaagaugagcugcaaggagaagccgaaccccguggagaaguucaacaucugcaagcgcguguacuccguccucuucaccaccaucgacaagaacgacaagaucgagaucaacacgggcgaccagaccagcuucauccaggagaaggacgaccggugcaagaccuggcugugccgcgugcgggacgaggggaucuccgugaucuucgagcccaucaaggccuucuucggcagcuacuucuccaucgccuucuacgucgugaucggcaucaucgcgcuguucaucaccaucuacaucuuccuccccaugguguucaagcugaaggacauccugaagaagaacgagcuccuguaccugcaggagaugaaguacaaguga

SEQ ID NO: 12506 - RNA, 4305 nt, Artificial Sequence
  derived and/or modified CDS sequence (opt1) from ANADV(EIV-13395Mg)__KU159765.1__GP
auguuccugauccucgugcugcugauccccuucuacaucaccgccaccccggucacgacccgcugcuuccacggcgggcagcucaucgccgagagcaagucccugaccgcgaucagcgaguucugccugaaggacgacguguccaccgucaagagcgagaucacguaccucaagaacgacaccggcaucuucgcccacuccaaggugcugcggaacuggaucaucaaggacuggaagaacugcaaccccgugcccaccgccgggggcagcaucaacgugaucgaggucaacgccgaccugucccucagcaccaagacguacgugugcucccgcgacugcaccaucaccguggacaaggaggacgcccagaucaucuuccagaccgacaagcugaaccacuucgaggucagcgggacgacccuguccagcggcugguucaagaccaaggcguccgugacccucgaccggacgugcgagcacaucaaggugaccugcggcaagaagacccugcaguuccacgccugcuucaagcaccacaugagcugcauccgcuucuuccacaacaccauccugcccgggacgauggccgucuccaucugccagaacaucgagcucaucaucaucaccagccugacccugaucaucuucauccucauggugauccugaccaagacguacaucugcuacgugcugaugccgcuguucaugcccgucgccuaccuguacggcugggcguacaaccgguccugcaagaagugcagcugcugcgggcuggccuaccaccccuucaccaacugcggcucccacugcgugugcgggcucaaguucgaggccagcgaccgcaugcggauccaccgcgagagcggccugugccagggcuacaagucccugcggguggcccgccuccugugcaagagcaagggguccagccugaucaucuccauccuccugagcguccugauccucuccuucgugacccccaucgagggcacccugacgaacuacccggagagcaagaaguacucccuggaggagaucgccgacgugaucgagggguucaucgcggagaagggcaucaaggaguacaucguccucuacaccagcaucuucggcgcccugcugcuccugaucgcccugaucaucaccgugucccucaaccggaucaccgaguaccugacgaaccugaacgugaucuacugccacgagugcagcauguaccacuccaagaagaacaucaaguacaucggggacuucaccaacaagugcggcuucugcacgugcggggagcucgaggaccaggagggccugaacaugcacaaggucagcaagaagugcaucuaccgcuaccagcugaccugguccaaggugaucaugaccauccucgucugccugcugaucgcccagaacaccgugcugaucguggccgcgaacgacgacugcugggccaagcagagccucgagaucgagugcgucgggccccugcagcaggucgacgccugcgaggacaaguccagccgguccuacaacggcgaggccaagaagcuggugggcaccagcaaggugaccgagcucgacgccggccaggugaaccugcuggggcagaccaucgagagcgcgaucaucgccauccgcaagcagcggacguacgccaccaugcacuuccucgaguccguguuccuggggcgccacugcgacuacuacaaggucuucgagcacaacagcggcuacucccaggccaaguggcggcugcucgccaagaccaaccacuucgacaucugcagccgccacuccacccaccacuucugccggugcaugagcgacgggacgaagugcgagaacggcaaccgcgacuucgcgggcgagaugaacaccaccuaccacuccaagcgggacuucuucaagcacgacuucaaccuguucugcacccugcucgagaacgccuuccccgggacgaccgagagccuguacuaccagcugcucuccaagcgcaacaccaccggcgccagcaagcugcuggggaagcucaucacgaaguucggcaacaacaaccuguucguggggaucuggaaguucggccaguuccugcucucccugcccuacgugaacaacaccgagcugagcgcccuccaguccagcaagauccuggaguccccggagccccugcuccgcagcgcguccggccggcaggagagccugagcuccgccacccccggggaggccagcaaggagugccgcaacgccaagaagaucuccugcaucagcccccgguucggcgucccgauggagaaccugaccgccugcggggagucccccaacuacaagaucuacaagacgcccacccgcaucuacaagagcaacaacaagggcgagaucuggugcgcgggcgacgugcacugcuuccaggaguucacccccgugcuccaggaggucguggacaagcugaagaagaugaccugcuuccugacggagccggaggccgaggaggacgccuucuccaucgccaucgccaugugcaagauccucgacaagggggugugcaccaucaacagcgagcgguggaacaucaucaagugcgacuccggccugauguacuacaccgaccagcgcgacgggcaggacaccggcaacgacuucggggaguacugcaucagccacaacugcaagacggagcgguuccccaucaaccccuccaucaucagcgacugcaucugggaguaccacucccgcaagagccgguacaucuccacccugaaccucgagagccuggaggaguucaagcgcgcgaucuccgagaagcugagccacacccucgucguguaccaguucaagcccaccuccaaccugccgcacaugaagcccguguacaaguacaucacggcccagggcgucgagaacagcgacggcaucgacagcgccuucaucaccgccuccaugcccgcccugagcgggaccuccaucggcuacaacgugaugagcaaggacaacuucccccucuucgacaucaucaucuucaucaaguccgcggugaucaagaccacguacaaccacaucuacgacaccgggccgaccaucggcaucaacgucaugcacgacgagcacugcaccgggcagugccccaucgagaucccccacaaggagaacuggcugacguucagccaggagcggaccucccgcuggggcugcgaggaguucggcugccuggccaucaacaccgggugcguguucggcagcugccaggacaucauccggccggagaccaagguguaccgcaaggccaucgaggaguccguccuccugaccgugugcgugacguaccccgggaacaccuucugcaccgagaucaacgccaucgagcccaagaucaccgacgagcuggagcuccaguucaagacggucgacaccaagacccugcccaaccugcucgcggugcagaaccacaagcuguacagcggccagaucaacgaccugggguccuucgcccagggcugcggcaacauccagaagaccaaccucagcgugaucgggacgggcaccgccaaguucgacuacaucugccacggggccucccggaaggacaucgucgugcgccggugcuacaacaacaacuacgagagcugcaagcugcugaaggaggagccgucccucaucuucagcgacaaccacgagaccaucgagguggccaacauccgccaccuccugggcgagcuccaguucaagcugaugcugggggaccuccgguacaaguccuucgcggagaaccccgagcuggagaucgaggccaagugcgucggcugccccagcugcuucuccagcuacagcugcaacuuccgcaucuccagcuccaucgacaccgugugcgccaucgacggccccugcacgaucuuccacaaccgccugaucaucagcuccaccaagcaggacuacgggaucaagaugagcugcaaggagaagccgaaccccguggagaaguucaacaucugcaagcgggucuacuccguccucuucaccaccaucgacaagaacgacaagaucgagaucaacacgggcgaccagaccagcuucauccaggagaaggacgaccgcugcaagaccuggcugugccgggugcgcgacgaggggaucuccgugaucuucgagcccaucaaggccuucuucggcagcuacuucuccaucgccuucuacguggugaucggcaucaucgcgcuguucaucaccaucuacaucuuccuccccauggucuucaagcugaaggacauccugaagaagaacgagcuccuguaccugcaggagaugaaguacaaguga

SEQ ID NO: 12507 - RNA, 4305 nt, Artificial Sequence
  derived and/or modified CDS sequence (opt1) from ANADV(EIV-16002Mg)__KT313724.1__GP
auguuccugauccucgugcugcugauccccuucuacaucaccgccaccccggucacgacccgcugcuuccacggcgggcagcucaucgccgagagcaagucccugaccgcgaucagcgaguucugccugaaggacgacguguccaccgucaagagcgagaucacguaccucaagaacgacaccggcaucuucgcccacuccaaggugcugcggaacuggaucaucaaggacuggaagaacugcaaccccgugcccaccgccgggggcagcaucaacgugaucgaggucaacgccgaccugucccucagcaccaagacguacgugugcucccgcgacugcaccaucaccguggacaaggaggacgcccagaucaucuuccagaccgacaagcugaaccacuucgaggucagcgggacgacccuguccagcggcugguucaagaccaaggcguccgugacccucgaccggacgugcgagcacaucaaggugaccugcggcaagaagacccugcaguuccacgccugcuucaagcaccacaugagcugcauccgcuucuuccacaacaccauccugcccgggacgauggccgucuccaucugccagaacaucgagcucaucaucaucaccagccugacccugaucaucuucauccucauggugauccugaccaagacguacaucugcuacgugcugaugccgcuguucaugcccgucgccuaccuguacggcugggcguacaaccgguccugcaagaagugcagcugcugcgggcuggccuaccaccccuucaccaacugcggcucccacugcgugugcgggcucaaguucgaggccagcgaccgcaugcggauccaccgcgagagcggccugugccagggcuacaagucccugcggguggcccgccuccugugcaagagcaagggguccagccugaucaucuccauccuccugagcguccugauccucuccuucgugacccccaucgagggcacccugacgaacuacccggagagcaagaaguacucccuggaggagaucgccgacgugaucgagggguucaucgcggagaagggcaucaaggaguacaucguccucuacaccagcaucuucggcgcccugcugcuccugaucgcccugaucaucaccgugucccucaaccggaucaccgaguaccugacgaaccugaacgugaucuacugccacgagugcagcauguaccacuccaagaagaacaucaaguacgucggggacuucaccaacaagugcggcuucugcacgugcggggagcucgaggaccaggagggccugaacaugcacaaggugagcaagaagugcaucuaccgcuaccagcugaccugguccaaggucaucaugaccauccucgugugccugcugaucgcccagaacaccgugcugaucgucgccgcgaacgacgacugcugggccaagcagagccucgagaucgagugcguggggccccugcagcaggucgacgccugcgaggacaaguccagccgguccuacaacggcgaggccaagaagcuggugggcaccagcaaggugaccgagcucgacgccggccaggugaaccugcuggggcagaccaucgagagcgcgaucaucgccauccgcaagcagcggacguacgccaccaugcacuuccucgaguccgucuuccuggggcgccacugcgacuacuacaagguguucgagcacaacagcggcuacucccaggccaaguggcggcugcucgccaagaccaaccacuucgacaucugcagccgccacuccacccaccacuucugccggugcaugagcgacgggacgaagugcgagaacggcaacugggacuucgcgggcgagaugaacaccaccuaccacuccaagcgcgacuucuucaagcacgacuucaagcuguucugcacccugcucgagaacgccuuccccgggacgaccgagagccuguacuaccagcugcucuccaagcggaacaccaccggcgccagcaagcugcuggggaagcucaucacgaaguucggcaacaacaaccuguucguggggaucuggaaguucggccaguuccugcucucccugcccuacgucaacaacaccgagcugagcgcccuccaguccagcaagauccuggaguccccggagccccugcuccgcagcgcguccggccgccaggagagccugagcuccgccacccccggggaggccagccgggagugccgcaacgccaagaagaucuccugcaucagcccccgguucggcgugccgauggagaaccugaccgccugcggggagucccccaacuacaagaucuacaagacgcccgcgcgcaucuacaagagcaacaacaagggcgagaucuggugcgccggcgacgugcacugcuuccaggaguucacccccguccuccaggaggugguggacaagcugaagaagaugaccugcuuccugaccgagccggaggccgaggaggacgccuucuccaucgccaucgcgaugugcaagauccucgacaagggggucugcacgaucaacagcgagcgguggaacaucaucaagugcgacuccggccugauguacuacaccgaccagcgcgacgggcaggacaccggcaacgacuucggggaguacugcaucagccacaacugcaagaccgagcgguuccccaucaaccccuccaucaucagcgacugcaucugggaguaccacucccgcaagagccgguacaucuccacgcugaaccucgagagccuggaggaguucaagcgcgccaucuccgagaagcugagccacacccucgugguguaccaguucaagcccaccuccaaccugccgcacaugaagcccgucuacaaguacaucaccgcccagggcguggagaacagcgacggcaucgacagcgccuucaucacggccuccaugcccgcgcugagcgggaccuccaucggcuacaacgugaugagcaaggacaacuucccccucuucgacaucaucaucuucaucaaguccgccgucaucaagaccaccuacaaccacaucuacgacacggggccgaccaucggcaucaacgugaugcacgacgagcacugcaccgggcagugccccaucgagaucccccacaaggagaacuggcugaccuucagccaggagcggacgucccgcuggggcugcgaggaguucggcugccuggccaucaacaccgggugcguguucggcagcugccaggacaucauccggccggagaccaaggucuaccgcaaggccaucgaggaguccgugcuccugaccgugugcgucaccuaccccgggaacacguucugcaccgagaucaacgcgaucgagcccaagaucaccgacgagcuggagcuccaguucaagaccguggacacgaagacccugcccaaccugcucgccgugcagaaccacaagcuguacagcggccagaucaacgaccugggguccuucgcccagggcugcggcaacauccagaagaccaaccucagcgucaucgggaccggcacggccaaguucgacuacaucugccacggggccucccggaaggacaucguggugcgccggugcuacaacaacaacuacgagagcugcaagcugcugaaggaggagccgucccucaucuucagcgacaaccacgagaccaucgaggucgcgaacauccgccaccuccugggcgagcuccaguucaagcugaugcugggggaccuccgguacaaguccuucgccgagaaccccgagcuggagaucgaggccaagugcgugggcugccccagcugcuucuccagcuacagcugcaacuuccgcaucuccagcuccaucgacaccgugugcgccaucgacggccccugcaccgucuuccacaaccgccugaucaucagcuccacgaagcaggacuacgggaucaagaugagcugcaaggagaagccgaaccccguggagaaguucaacaucugcaagcggguguacuccguccucuucaccaccaucgacaagaacgacaagaucgagaucaacaccggcgaccagacgagcuucauccaggagaaggacgaccgcugcaagaccuggcugugccgggugcgcgacgaggggaucuccgugaucuucgagcccaucaaggccuucuucggcagcuacuucuccaucgcguucuacgucgugaucggcaucaucgcccuguucaucaccaucuacaucuuccuccccaugguguucaagcugaaggacauccugaagaagaacgagcuccuguaccugcaggagaugaaguacaaguga

SEQ ID NO: 12508 - RNA, 4305 nt, Artificial Sequence
  derived and/or modified CDS sequence (opt1) from ANADV(EIV-16199Mg)__KT313730.1__GP
auguuccugauccucgugcugcugauccccuucuacaucaccgccaccccggucacgacccgcugcuuccacggcgggcagcucaucgccgagagcaagucccugaccgcgaucagcgaguucugccugaaggacgacguguccaccgucaagagcgagaucacguaccucaagaacgacaccggcaucuucgcccacuccaaggugcugcggaacuggaucaucaaggacuggaagaacugcaaccccgugcccaccgccgggggcagcaucaacgugaucgaggucaacgccgaccugucccucagcaccaagacguacgugugcucccgcgacugcaccaucaccguggacaaggaggacgcccagaucaucuuccagaccgacaagcugaaccacuucgaggucagcgggacgacccuguccagcggcugguucaagaccaaggcguccgugacccucgaccggacgugcgagcacaucaaggugaccugcggcaagaagacccugcaguuccacgccugcuucaagcaccacaugagcugcauccgcuucuuccacaacaccauccugcccgggacgauggccgucuccaucugccagaacaucgagcucaucaucaucaccagccugacccugaucaucuucauccucauggugauccugaccaagacguacaucugcuacgugcugaugccgcuguucaugcccgucgccuaccuguacggcugggcguacaaccgguccugcaagaagugcagcugcugcgggcuggccuaccaccccuucaccaacugcggcucccacugcgugugcgggcucaaguucgaggccagcgaccgcaugcggauccaccgcgagagcggccugugccagggcuacaagucccugcggguggcccgccuccugugcaagagcaagggguccagccugaucaucuccauccuccugagcguccugauccucuccuucgugacccccaucgagggcacccugacgaacuacccggagagcaagaaguacucccuggaggagaucgccgacgugaucgagggguucaucgcggagaagggcaucaaggaguacaucguccucuacaccagcaucuucggcgcccugcugcuccugaucgcccugaucaucaccgugucccucaaccggaucaccgaguaccugacgaaccugaacgugaucuacugccacgagugcagcauguaccacuccaagaagaacaucaaguacaucggggacuucaccaacaagugcggcuucugcacgugcggggagcucgaggaccaggagggccugaacaugcacaaggucagcaagaagugcaucuaccgcuaccagcugaccugguccaaggugaucaugaccauccucgucugccugcugaucgcccagaacaccgugcugaucguggccgcgaacgacgacugcugggccaagcagagccucgagaucgagugcgucgggccccugcagcaggucgacgccugcgaggacaaguccagccgguccuacaacgaggaggccaagaagcuggugggcaccagcaaggugaccgagcucgacgccggccaggugaaccugcuggggcagaccaucgagagcgcgaucaucgccauccgcaagcagcggacguacgccaccaugcacuuccucgaguccguguuccugggccgccacugcgacuacuacaaggucuucgagcacaacagcggguacucccaggccaaguggcggcugcucgccaagaccaaccacuucgacaucugcagccgccacuccacccaccacuucugccggugcaugagcgacggcacgaagugcgagaacgggaacugggacuucgcgggcgagaugaacaccaccuaccacuccaagcgcgacuucuucaagcacgacuucaaccuguucugcacccugcucgagaacgccuuccccggcacgaccgagagccuguacuaccagcugcucuccaagcggaacaccaccggggccagcaagcugcugggcaagcucaucacgaaguucgggaacaacaaccuguucgugggcaucuggaaguucgggcaguuccugcucucccugcccuacgugaacaacaccgagcugagcgcccuccaguccagcaagauccuggaguccccggagccccugcuccgcagcgcguccggccgccaggagagccugagcuccgccacccccggcgaggccagcaaggagugccggaacgccaagaagaucuccugcaucagcccccgcuucggggucccgauggagaaccugaccgccugcggcgagucccccaacuacaagaucuacaagacgcccacccggaucuacaagagcaacaacaagggggagaucuggugcgcgggcgacgugcacugcuuccaggaguucacccccgugcuccaggaggucguggacaagcugaagaagaugaccugcuuccugacggagccggaggccgaggaggacgccuucuccaucgccaucgccaugugcaagauccucgacaagggcgugugcaccaucaacagcgagcgcuggaacaucaucaagugcgacuccgggcugauguacuacaccgaccagcgggacggccaggacaccgggaacgacuucggcgaguacugcaucagccacaacugcaagacggagcgcuuccccaucaaccccuccaucaucagcgacugcaucugggaguaccacucccgcaagagccgguacaucuccacccugaaccucgagagccuggaggaguucaagcgggcgaucuccgagaagcugagccacacccucaucgucuaccaguucaagcccaccuccaaccugccgcacaugaagcccguguacaaguacaucacggcccaggggguggagaacagcgacggcaucgacagcgccuucaucaccgccuccaugcccgcccugagcggcaccuccaucggguacaacgucaugagcaaggacaacuucccccucuucgacaucaucaucuucaucaaguccgcggugaucaagaccacguacaaccacaucuacgacaccggcccgaccaucgggaucaacgugaugcacgacgagcacugcaccggccagugccccaucgagaucccccacaaggagaacuggcugacguucagccaggagcgcaccucccggugggggugcgaggaguucggcugccuggccaucaacaccggcugcgucuucgggagcugccaggacaucauccgcccggagaccaagguguaccggaaggccaucgaggaguccgugcuccugaccgucugcgugacguaccccggcaacaccuucugcaccgagaucaacgccaucgagcccaagaucaccgacgagcuggagcuccaguucaagacgguggacaccaagacccugcccaaccugcucgcgguccagaaccacaagcuguacagcgggcagaucaacgaccugggcuccuucgcccaggggugcggcaacauccagaagaccaaccucagcgugaucggcacggggaccgccaaguucgacuacaucugccacggcgccucccgcaaggacaucgugguccggcgcugcuacaacaacaacuacgagagcugcaagcugcugaaggaggagccgucccucaucuucagcgacaaccacgagaccaucgagguggccaacauccggcaccuccugggggagcuccaguucaagcugaugcugggcgaccuccgcuacaaguccuucgcggagaaccccgagcuggagaucgaggcccggugcguggggugccccagcugcuucuccagcuacagcugcaacuuccgcaucuccagcuccaucgacaccgucugcgccaucgacggccccugcacgaucuuccacaaccgccugaucaucagcuccaccaagcaggacuacggcaucaagaugagcugcaaggagaagccgaaccccguggagaaguucaacaucugcaagcggguguacuccguccucuucaccaccaucgacaagaacgacaagaucgagaucaacacgggggaccagaccagcuucauccaggagaaggacgaccgcugcaagaccuggcugugccgggugcgcgacgagggcaucuccgugaucuucgagcccaucaaggccuucuucgggagcuacuucuccaucgccuucuacgucgugaucggcaucaucgcgcuguucaucaucaucuacaucuuccuccccaugguguucaagcugaaggacauccugaagaagaacgagcuccuguaccugcaggagaugaaguacaaguga

SEQ ID NO: 12509 - RNA, 4305 nt, Artificial Sequence
  derived and/or modified CDS sequence (opt1) from ANADV(EIV-16208Mg)__KT313733.1__GP
auguuccugauccucgugcugcugauccccuucuacaucaccgccaccccggucacgacccgcugcuuccacggcgggcagcucaucgccgagagcaagucccugaccgcgaucagcgaguucugccugaaggacgacguguccaccgucaagagcgagaucacguaccucaagaacgacaccggcaucuucgcccacuccaaggugcugcggaacuggaucaucaaggacuggaagaacugcaaccccgugcccaccgccgggggcagcaucaacgugaucgaggucaacgccgaccugucccucagcaccaagacguacgugugcucccgcgacugcaccaucaccguggacaaggaggacgcccagaucaucuuccagaccgacaagcugaaccacuucgaggucagcgggacgacccuguccagcggcugguucaagaccaaggcguccgugacccucgaccggacgugcgagcacaucaaggugaccugcggcaagaagacccugcaguuccacgccugcuucaagcaccacaugagcugcauccgcuucuuccacaacaccauccugcccgggacgauggccgucuccaucugccagaacaucgagcucaucaucaucaccagccugacccugaucaucuucauccucauggugauccugaccaagacguacaucugcuacgugcugaugccgcuguucaugcccgucgccuaccuguacggcugggcguacaaccgguccugccgcaagugcagcugcugcgggcuggccuaccaccccuucaccaacugcggcucccacugcgugugcgggcucaaguucgaggccagcgaccggaugcgcauccaccgggagagcggccugugccagggcuacaagucccugcgcguggcccggcuccugugcaagagcaagggguccagccugaucaucuccauccuccugagcguccugauccucuccuucgugacccccaucgagggcacccugacgaacuacccggagagcaagaaguacucccuggaggagaucgccgacgugaucgagggguucaucgcggagaagggcaucaaggaguacaucguccucuacaccagcaucuucggcgcccugcugcuccugaucgcccugaucaucaccgugucccucaaccgcaucaccgaguaccugacgaaccugaacgugaucuacugccacgagugcagcauguaccacuccaagaagaacaucaaguacaucggggacuucaccaacaagugcggcuucugcacgugcggggagcucgaggaccaggagggccugaacaugcacaaggucagcaagaagugcaucuaccgguaccagcugaccugguccaaggugaucaugaccauccucaucugccugcugaucgcccagaacgccguccugaucguggcggccaacgacgacugcugggccaagcagagccucgagaucgagugcguggggccccugcagcaggucgacgccugcgaggacaaguccagccgcuccuacaacggcgaggccaagaagcuggugggcaccagcaaggugaccgagcucgacgcggggcaggucaaccugcugggccagaccaucgagagcgccaucaucgccauccggaagcagcgcaccuacgccacgaugcacuuccucgaguccguguuccuggggcggcacugcgacuacuacaagguguucgagcacaacagcggcuacucccaggccaaguggcgccugcucgcgaagaccaaccacuucgacaucugcagccggcacuccacccaccacuucugccgcugcaugagcgacgggaccaagugcgagaacggcaacugggacuucgccggcgagaugaacacgaccuaccacuccaagcgggacuucuucaagcacgacuucaagcuguucugcacccugcucgagaacgccuuccccgggaccacggagagccuguacuaccagcugcucuccaagcgcaacaccaccggcgccagcaagcugcuggggaagcucaucaccaaguucggcaacaacaaccuguucgucgggaucuggaaguucggccaguuccugcucucccugcccuacgugaacaacacggagcugagcgcgcuccaguccagcaagauccuggaguccccggagccccugcuccgcagcgccuccggccggcaggagagccugagcuccgccacccccggggaggccagcaaggagugccgcaacgccaagaagaucuccugcaucagcccccgguucggcgugccgauggagaaccugaccgcgugcggggagucccccaacuacaagaucuacaagacccccacgcgcaucuacaagagcaacaacaagggcgagaucuggugcgccggcgacguccacugcuuccaggaguucacccccgugcuccaggagguggucgacaagcugaagaagaugaccugcuuccugaccgagccggaggccgaggaggacgccuucuccaucgccaucgcgaugugcaagauccucgacaagggggugugcacgaucaacagcgagcgguggaacaucaucaagugcgacuccggccugauguacuacaccgaccagcgcgacgggcaggacaccggcaacgacuucggggaguacugcaucagccacaacugcaagaccgagcgguuccccaucaaccccuccaucaucagcgacugcaucugggaguaccacucccgcaagagcaaguacaucuccacgcugaaccucgagagccuggaggaguucaagcgggccaucuccgagaagcugagccacacccucguggucuaccaguucaagcccaccuccaaccugccgcacaugaagcccguguacaaguacaucaccgcccagggcguggagaacagcgacggcaucgacagcgccuucaucacggccuccaugcccgcgcugagcgggaccuccaucggcuacaacgucaugagcaaggacaacuucccccucuucgacaucaucaucuucaucaaguccgccgugaucaagaccaccuacaaccacaucuacgacacggggccgaccaucggcaucaacgugaugcacgacgagcacugcaccgggcagugccccaucgagaucccccacaaggagaacuggcugaccuucagccaggagcgcacgucccgguggggcugcgaggaguucggcugccuggccaucaacaccgggugcgucuucggcagcugccaggacaucauccgcccggagaccaagguguaccggaaggccaucgaggaguccgugcuccugaccgucugcgugaccuaccccgggaacacguucugcaccgagaucaacgcgaucgagcccaagaucaccgacgagcuggagcuccaguucaagaccguggacacgaagacccugcccaaccugcucgccguccagaaccacaagcuguacagcggccagaucaacgaccugggguccuucgcccagggcugcggcaacauccagaagaccaaccucagcgugaucgggaccggcacggccaaguucgacuacaucugccacggggccucccgcaaggacaucaucgugcggcgcugcuacaacaacaacuacgagagcugcaagcugcugaaggaggagccgucccucaucuucagcgacaaccacgagaccaucgaggucgcgaacauccggcaccuccugggcgagcuccaguucaagcugaugcugggggaccuccgcuacaaguccuucgccgagaaccccgagcuggagaucgaggccaagugcgugggcugccccagcugcuucuccagcuacagcugcaacuuccggaucuccagcuccaucgacaccgugugcgccaucgacggccccugcaccaucuuccacaaccgccugaucaucagcuccacgaagcaggacuacgggaucaagaugagcugcaaggagaagccgaacuccgucgagaaguucaacaucugcaagcgcguguacagcguccucuucaccaccaucgacaagaacgacaagaucgagaucaacaccggcgaccagacguccuucauccaggagaaggacgaccggugcaagaccuggcugugccgcgugcgggacgaggggaucagcgugaucuucgagcccaucaaggccuucuucggcuccuacuucagcaucgcguucuacguggucaucggcaucaucgcccuguucaucaucaucuacaucuuccuccccaugguguucaagcugaaggacauccugaagaagaacgagcuccuguaccugcaggagaugaaguacaaguga

SEQ ID NO: 12510 - RNA, 4305 nt, Artificial Sequence
  derived and/or modified CDS sequence (opt1) from ANADV(EIV-16356Mg)__KT313736.1__GP
auguuccugauccucgugcugcugauccccuucuacaucaccgccaccccggucacgacccgcugcuuccacggcgggcagcucaucgccgagagcaagucccugaccgcgaucagcgaguucugccugaaggacgacguguccaccgucaagagcgagaucacguaccucaagaacgacaccggcaucuucgcccacuccaaggugcugcggaacuggaucaucaaggacuggaagaacugcaaccccgugcccaccgccgggggcagcaucaacgugaucgaggucaacgccgaccugucccucagcaccaagacguacgugugcucccgcgacugcaccaucaccguggacaaggaggacgcccagaucaucuuccagaccgacaagcugaaccacuucgaggucagcgggacgacccuguccagcggcugguucaagaccaaggcguccgugacccucgaccggacgugcgagcacaucaaggugaccugcggcaagaagacccugcaguuccacgccugcuucaagcaccacaugagcugcauccgcuucuuccacaacaccauccugcccgggacgauggccgucuccaucugccagaacaucgagcucaucaucaucaccagccugacccugaucaucuucauccucauggugauccugaccaagacguacaucugcuacgugcugaugccccucuucaugcccgucgccuaccuguacggcugggcguacaaccgguccugcaagaagugcagcugcugcgggcuggccuaccaccccuucaccaacugcggcucccacugcgugugcgggcucaaguucgaggccagcgaccgcaugcggauccaccgcgagagcggccugugccagggcuacaagucccugcggguggcccgccuccugugcaagagcaagggguccagccugaucaucuccauccuccugagcguccugauccucuccuucgugacccccaucgagggcacccugacgaacuacccggagagcaagaaguacucccuggaggagaucgccgacgugaucgagggguucaucgcggagaagggcaucaaggaguacaucguccucuacaccagcaucuucggcgcccugcugcuccugaucgcccugaucaucaccgugucccucaaccggaucaccgaguaccugacgaaccugaacgugaucuacugccacgagugcagcauguaccacuccaagaagaacaucaaguacaucggggacuucaccaacaagugcggcuucugcacgugcggggagcucgaggaccaggagggccugaacaugcacaaggucagcaagaagugcaucuaccgcuaccagcugaccugguccaaggugaucaugaccauccucgucugccugcugaucgcccagaacaccgugcugaucguggccgcgaacgacgacugcugggccaagcagagccucgagaucgagugcgucgggccccugcagcaggucgacgccugcgaggacaaguccagccgguccuacaacggcgaggccaagaagcuggugggcaccagcaaggugaccgagcucgacgccggccaggugaaccugcuggggcagaccaucgagagcgcgaucaucgccauccgcaagcagcggacguacgccaccaugcacuuccucgaguccguguuccuggggcgccacugcgacuacuacaaggucuucgagcacaacagcggcuacucccaggccaaguggcggcugcucgccaagaccaaccacuucgacaucugcagccgccacuccacccaccacuucugccggugcaugagcgacgggacgaagugcgagaacggcaacugggacuucgcgggcgagaugaacaccaccuaccacuccaagcgcgacuucuucaagcacgacuucaagcuguucugcacccugcucgagaacgccuuccccgggacgaccgagagccuguacuaccagcugcucuccaagcggaacaccaccggcgccagcaagcugcuggggaagcucaucacgaaguucggcaacaacaaccuguucguggggaucuggaaguucggccaguuccugcucucccugcccuacgugaacaacaccgagcugagcgcccuccaguccagcaagauccuggaguccccggagccccugcuccgcagcgcguccggccgccaggagagccugagcuccgccacccccggggaggccagcaaggagugccggaacgccaagaagaucuccugcaucagcccccgcuucggcgucccgauggagaaccugaccgccugcggggagucccccaacuacaagaucuacaagacgcccacccggaucuacaagagcaacaacaagggcgagaucuggugcgcgggcgacgugcacugcuuccaggaguucaccccgcuccugcaggagguggucgacaagcugaagaagaugaccugcuuccucacggagccggaggccgaggaggacgccuucuccaucgccaucgccaugugcaagauccuggacaagggggugugcaccaucaacagcgagcgcuggaacaucaucaagugcgacuccggccugauguacuacaccgaccagcgggacgggcaggacaccggcaacgacuucggggaguacugcaucagccacaacugcaagacggagcgcuuccccaucaaccccuccaucaucagcgacugcaucugggaguaccacucccgcaagagccgguacaucuccacccucaaccuggagagccuggaggaguucaagcgggcgaucuccgagaagcucagccacacccugguggucuaccaguucaagcccaccuccaaccugccgcacaugaagcccguguacaaguacaucacggcccagggcguggagaacagcgacggcaucgacagcgccuucaucaccgccuccaugcccgcccucagcgggaccuccaucggcuacaacgucaugagcaaggacaacuucccccuguucgacaucaucaucuucaucaaguccgcggugaucaagaccacguacaaccacaucuacgacaccgggccgaccaucggcaucaacgugaugcacgacgagcacugcaccgggcagugccccaucgagaucccccacaaggagaacuggcugacguucagccaggagcgcaccucccgguggggcugcgaggaguucggcugccucgccaucaacaccgggugcgucuucggcagcugccaggacaucauccgcccggagaccaagguguaccggaaggccaucgaggaguccgugcugcugaccgucugcgugacguaccccgggaacaccuucugcaccgagaucaacgccaucgagcccaagaucaccgacgagcucgagcugcaguucaagacgguggacaccaagacccugcccaaccuccuggcgguccagaaccacaagcuguacagcggccagaucaacgaccucggguccuucgcccagggcugcggcaacauccagaagaccaaccugagcgugaucgggacgggcaccgccaaguucgacuacaucugccacggggccucccgcaaggacaucgugguccggcgcugcuacaacaacaacuacgagagcugcaagcugcucaaggaggagccgucccugaucuucagcgacaaccacgagaccaucgagguggccaacauccggcaccuccucggcgagcugcaguucaagcugaugcucggggaccugcgcuacaaguccuucgcggagaaccccgagcuggagaucgaggccaagugcgugggcugccccagcugcuucuccagcuacagcugcaacuuccggaucuccagcuccaucgacaccgucugcgccaucgacggccccugcacgaucuuccacaaccgccucaucaucagcuccaccaagcaggacuacgggaucaagaugagcugcaaggagaagccgaaccccguggagaaguucaacaucugcaagcgcguguacuccguccuguucaccaccaucgacaagaacgacaagaucgagaucaacacgggcgaccagaccagcuucauccaggagaaggacgaccggugcaagaccuggcugugccgcgugcgggacgaggggaucuccgugaucuucgagcccaucaaggccuucuucggcagcuacuucuccaucgccuucuacgucgugaucggcaucaucgcgcuguucaucaccaucuacaucuuccugcccaugguguucaagcugaaggacauccucaagaagaacgagcugcuguaccuccaggagaugaaguacaaguga

SEQ ID NO: 12511 - RNA, 4305 nt, Artificial Sequence
  derived and/or modified CDS sequence (opt1) from ANADV(EIV-17769Yak)__KT313739.1__GP
auguuccugauccucgugcugcugauccccuucuacaucaccgccaccccggucgccacgcgcugcuuccacggcgggcagcucaucgcggagagcaagucccugaccgccaucagcgaguucugccugaaggacgacguguccaccgucaagagcgagaucaccuaccucaagaacgacacgggcaucuucgcccacuccaaggugcugcggaacuggaucaucaaggacuggaagaacugcaaccccgugcccaccgccgggggcagcaucaacgugaucgaggucaacgccgaccugucccucagcaccaagaccuacgugugcucccgcgacugcacgaucaccguggacaaggaggacgcgcagaucaucuuccagaccgacaaccugaaccacuucgaggucagcgggaccacgcuguccagcggcugguucaagaccaaggccuccgugacccucgaccggaccugcgagcacaucaaggugacgugcggcaagaagacccugcaguuccacgccugcuucaagcaccacaugagcugcauccgcuucuuccacaacaccauccugcccgggaccauggccgucuccaucugccagaacaucgagcucaucaucaucacgagccugacccugaucaucuucauccucauggugauccugaccaagaccuacaucugcuacgugcugaugccgcuguucaugcccgucgcguaccuguacggcugggccuacaaccgguccugcaagaagugcagcugcugcgggcuggccuaccaccccuucacgaacugcggcucccacugcgugugcgggcucaaguucgaggccagcgaccgcaugcggauccaccgcgagagcggccugugccagggcuacaagucccugcggguggcccgccuccugugcaagagcaagggguccagccugaucaucuccauccuccugagcguccugauccucuccuucgugacccccaucgagggcacccugaccaacuacccggagagcaagaaguacucccuggaggagaucgcggacgugaucgagggguucaucgccgagaagggcaucaaggaguacaucguccucuacacgagcaucuucggcgcccugcugcuccugaucgcccugaucaucaccgugucccucaaccggaucaccgaguaccugaccaaccugaacgugaucuacugccacgagugcagcauguaccacuccaagaagaacaucaaguacgucggggacuucacgaacaagugcggcuucugcacgugcggggagcucgaggaccaggagggccugaacaugcacaaggugagcaagaagugcaucuaccgcuaccagcugaccugguccaaggucaucaugaccauccucgugugccugcugaucgcccagaacaccgugcugaucgucgcggccaacgacgacugcugggccaagcagagccucgagaucgagugcguggggccccugcagcaggucgacgccugcgaggacaaguccagccgguccuacaacggcgaggccaagaagcuggugggcaccagcaaggugaccgagcucgacgcgggccaggugaaccugcuggggcagaccaucgagagcgccaucaucgccauccgcaagcagcggaccuacgccacgaugcacuuccucgaguccgucuuccuggggcgccacugcgacuacuacaagguguucgagcacaacagcggcuacucccaggccaaguggcggcugcucgcgaagaccaaccacuucgacaucugcagccgccacuccacccaccacuucugccggugcaugagcgacgggaccaagugcgagaacggcaaccgcgacuucgccggcgagaugaacacgaccuaccacuccaagcgggacuucuucaagcacgacuucaaccuguucugcacccugcucgagaacgccuuccccgggaccacggagagccuguacuaccagcugcucuccaagcgcaacaccaccggcgccagcaagcugcuggggaagcucaucaccaaguucggcaacaacaaccuguucguggggaucuggaaguucggccaguuccugcucucccugcccuacgucaacaacacggagcugagcgcgcuccaguccagcaagauccuggaguccccggagccccugcuccgcagcgccuccggccggcaggagagccugagcuccgccacccccggggaggccagccgcgagugccggaacgccaagaagaucuccugcaucagcccccgcuucggcgugccgauggagaaccugaccgcgugcggggagucccccaacuacaagaucuacaagacccccacgcggaucuacaagagcaacaacaagggcgagaucuggugcgccggcgacgugcacugcuuccaggaguucacccccguccuccaggaggugguggacaagcugaagaagaugaccugcuuccugaccgagccggaggccgaggaggacgccuucuccaucgccaucgcgaugugcaagauccucgacaagggggucugcacgaucaacagcgagcgcuggaacaucaucaagugcgacuccggccugauguacuacaccgaccagcgggacgggcaggacaccggcaacgacuucggggaguacugcaucagccacaacugcaagaccgagcgcuuccccaucaaccccuccaucaucagcgacugcaucugggaguaccacucccgcaagagccgguacaucuccacgcugaaccucgagagccuggaggaguucaagcgggccaucuccgagaagcugagccacacccucgugguguaccaguucaagcccaccuccaaccugccgcacaugaagcccgucuacaaguacaucaccgcccagggcguggagaacagcgacggcaucgacagcgccuucaucacggccuccaugcccgcgcugagcgggaccuccaucggcuacaacgugaugagcaaggacaacuucccccucuucgacaucaucaucuucaucaaguccgccgucaucaagaccaccuacaaccacaucuacgacacggggccgaccaucggcaucaacgugaugcacgacgagcacugcaccgggcagugccccaucgagaucccccacaaggagaacuggcugaccuucagccaggagcgcacgucccgguggggcugcgaggaguucggcugccuggccaucaacaccgggugcguguucggcagcugccaggacaucauccgcccggagaccaaggucuaccggaaggccaucgaggaguccgugcuccugaccgugugcgucaccuaccccgggaacacguucugcaccgagaucaacgcgaucgagcccaagaucaccgacgagcuggagcuccaguucaagaccguggacacgaagacccugcccaaccugcucgccgugcagaaccacaagcuguacagcggccagaucaacgaccugggguccuucgcccagggcugcggcaacauccagaagaccaaccucagcgucaucgggaccggcacggccaaguucgacuacaucugccacggggccucccgcaaggacaucguggugcggcgcugcuacaacaacaacuacgagagcugcaagcugcugaaggaggagccgucccucaucuucagcgacaaccacgagaccaucgaggucgcgaacauccggcaccuccugggcgagcuccaguucaagcugaugcugggggaccuccgcuacaaguccuucgccgagaaccccgagcuggagaucgaggccaagugcgugggcugccccagcugcuucuccagcuacagcugcaacuuccgcaucuccagcuccaucgacaccgugugcgccaucgacggccccugcaccaucuuccacaaccggcugaucaucagcuccacgaagcaggacuacgggaucaagaugagcugcaaggagaagccgaaccccgucgagaaguucaacaucugcaagcgcguguacuccguccucuucaccaccaucgacaagaacgacaagaucgagaucgacaccggcgaccagacgagcuucauccaggagaaggacgaccggugcaagaccuggcugugccgcgugcgggacgaggggaucuccgugaucuucgagcccaucaaggccuucuucggcagcuacuucuccaucgcguucuacguggucaucggcaucaucgcccuguucaucaccaucuacaucuuccuccccaugguguucaagcugaaggacauccugaagaagaacgagcuccuguaccugcaggagaugaaguacaaguga

SEQ ID NO: 12512 - RNA, 4305 nt, Artificial Sequence
  derived and/or modified CDS sequence (opt1) from ANADV(EIV-18098Yak)__KT313742.1__GP
auguuccugauccucgugcugcugauccccuucuacaucaccgccaccccggucacgacccgcugcuuccacggcgggcagcucaucgccgagagcaagucccugaccgcgaucagcgaguucugccugaaggacgacguguccaccgucaagagcgagaucacguaccucaagaacgacaccggcaucuucgcccacuccaaggugcugcggaacuggaucaucaaggacuggaagaacugcaaccccgugcccaccgccgggggcagcaucaacgugaucgaggucaacgccgaccugucccucagcaccaagacguacgugugcucccgcgacugcaccaucaccguggacaaggaggacgcccagaucaucuuccagaccgacaagcugaaccacuucgaggucagcgggacgacccuguccagcggcugguucaagaccaaggcguccgugacccucgaccggacgugcgagcacaucaaggugaccugcggcaagaagacccugcaguuccacgccugcuucaagcaccacaugagcugcauccgcuucuuccacaacaccauccugcccgggacgauggccgucuccaucugccagaacaucgagcucaucaucaucaccagccugacccugaucaucuucauccucauggugauccugaccaagacguacaucugcuacgugcugaugccgcuguucaugcccgucgccuaccuguacggcugggcguacaaccgguccugcaagaagugcagcugcugcgggcuggccuaccaccccuucaccaacugcggcucccacugcgugugcgggcucaaguucgaggccagcgaccgcaugcggauccaccgcgagagcggccugugccagggcuacaagucccugcggguggcccgccuccugugcaagagcaagggguccagccugaucaucuccauccuccugagcguccugauccucuccuucgugacccccaucgagggcacccugacgaacuacccggagagcaagaaguacucccuggaggagaucgccgacgugaucgagggguucaucgcggagaagggcaucaaggaguacaucguccucuacaccagcaucuucggcgcccugcugcuccugaucgcccugaucaucaccgugucccucaaccggaucaccgaguaccugacgaaccugaacgugaucuacugccacgagugcagcauguaccacuccaagaagaacaucaaguacgucggggacuucaccaacaagugcggcuucugcacgugcggggagcucgaggaccaggagggccugaacaugcacaaggugagcaagaagugcaucuaccgcuaccagcugaccugguccaaggucaucaugaccauccucgugugccugcugaucgcccagaacaccgugcugaucgucgccgcgaacgacgacugcugggccaagcagagccucgagaucgagugcguggggccccugcagcaggucgacgccugcgaggacaaguccagccgguccuacaacggcgaggccaagaagcuggugggcaccagcaaggugaccgagcucgacgccggccaggugaaccugcuggggcagaccaucgagagcgcgaucaucgccauccgcaagcagcggacguacgccaccaugcacuuccucgaguccgucuuccuggggcgccacugcgacuacuacaagguguucgagcacaacagcggcuacucccaggccaaguggcggcugcucgccaagaccaaccacuucgacaucugcagccgccacuccacccaccacuucugccggugcaugagcgacgggacgaagugcgagaacggcaacugggacuucgcgggcgagaugaacaccaccuaccacuccaagcgcgacuucuucaagcacgacuucaaccuguucugcacccugcucgagaacgccuuccccgggacgaccgagagccuguacuaccagcugcucuccaagcggaacaccaccggcgccagcaagcugcuggggaagcucaucacgaaguucggcaacaacaaccuguucguggggaucuggaaguucggccaguuccugcucucccugcccuacgucaacaacaccgagcugagcgcccuccaguccagcaagauccuggaguccccggagccccugcuccgcagcgcguccggccgccaggagagccugagcuccgccacccccggggaggccagccgggagugccgcaacgccaagaagaucuccugcaucagcccccgguucggcgugccgauggagaaccugaccgccugcggggagucccccaacuacaagaucuacaagacgcccgcgcgcaucuacaagagcaacaacaagggcgagaucuggugcgccggcgacgugcacugcuuccaggaguucacccccguccuccaggaggugguggacaagcugaagaagaugaccugcuuccugaccgagccggaggccgaggaggacgccuucuccaucgccaucgcgaugugcaagauccucgacaagggggucugcacgaucaacagcgagcgguggaacaucaucaagugcgacuccggccugauguacuacaccgaccagcgcgacgggcaggacaccggcaacgacuucggggaguacugcaucagccacaacugcaagaccgagcgguuccccaucaaccccuccaucaucagcgacugcaucugggaguaccacucccgcaagagccgguacaucuccacgcugaaccucgagagccuggaggaguucaagcgcgccaucuccgagaagcugagccacacccucgugguguaccaguucaagcccaccuccaaccugccgcacaugaagcccgucuacaaguacaucaccgcccagggcguggagaacagcgacggcaucgacagcgccuucaucacggccuccaugcccgcgcugagcgggaccuccaucggcuacaacgugaugagcaaggacaacuucccccucuucgacaucaucaucuucaucaaguccgccgucaucaagaccaccuacaaccacaucuacgacacggggccgaccaucggcaucaacgugaugcacgacgagcacugcaccgggcagugccccaucgagaucccccacaaggagaacuggcugaccuucagccaggagcggacgucccgcuggggcugcgaggaguucggcugccuggccaucaacaccgggugcguguucggcagcugccaggacaucauccggccggagaccaaggucuaccgcaaggccaucgaggaguccgugcuccugaccgugugcgucaccuaccccgggaacacguucugcaccgagaucaacgcgaucgagcccaagaucaccgacgagcuggagcuccaguucaagaccguggacacgaagacccugcccaaccugcucgccgugcagaaccacaagcuguacagcggccagaucaacgaccugggguccuucgcccagggcugcggcaacauccagaagaccaaccucagcgucaucgggaccggcacggccaaguucgacuacaucugccacggggccucccggaaggacaucguggugcgccggugcuacaacaacaacuacgagagcugcaagcugcugaaggaggagccgucccucaucuucagcgacaaccacgagaccaucgaggucgcgaacauccgccaccuccugggcgagcuccaguucaagcugaugcugggggaccuccgguacaaguccuucgccgagaaccccgagcuggagaucgaggccaagugcgugggcugccccagcugcuucuccagcuacagcugcaacuuccgcaucuccagcuccaucgacaccgugugcgccaucgacggccccugcaccgucuuccacaaccgccugaucaucagcuccacgaagcaggacuacgggaucaagaugagcugcaaggagaagccgaaccccguggagaaguucaacaucugcaagcggguguacuccguccucuucaccaccaucgacaagaacgacaagaucgagaucaacaccggcgaccagacgagcuucauccaggagaaggacgaccgcugcaagaccuggcugugccgggugcgcgacgaggggaucuccgugaucuucgagcccaucaaggccuucuucggcagcuacuucuccaucgcguucuacgucgugaucggcaucaucgcccuguucaucaccaucuacaucuuccuccccaugguguucaagcugaaggacauccugaagaagaacgagcuccuguaccugcaggagaugaaguacaaguga

SEQ ID NO: 12513 - RNA, 4305 nt, Artificial Sequence
  derived and/or modified CDS sequence (opt1) from ANADV(EIV-18136Yak)__KT313745.1__GP
auguuccugauccucgugcugcugauccccuucuacaucaccgccaccccggucacgacccgcugcuuccacggcgggcagcucaucgccgagagcaagucccugaccgcgaucagcgaguucugccugaaggacgacguguccaccgucaagagcgagaucacguaccucaagaacgacaccggcaucuucgcccacuccaaggugcugcggaacuggaucaucaaggacuggaagaacugcaaccccgugcccaccgccgggggcagcaucaacgugaucgaggucaacgccgaccugucccucagcaccaagacguacgugugcucccgcgacugcaccaucaccguggacaaggaggacgcccagaucaucuuccagaccgacaagcugaaccacuucgaggucagcgggacgacccuguccagcggcugguucaagaccaaggcguccgugacccucgaccggacgugcgagcacaucaaggugaccugcggcaagaagacccugcaguuccacgccugcuucaagcaccacaugagcugcauccgcuucuuccacaacaccauccugcccgggacgauggccgucuccaucugccagaacaucgagcucaucaucaucaccagccugacccugaucaucuucauccucauggugauccugaccaagacguacaucugcuacgugcugaugccgcuguucaugcccgucgccuaccuguacggcugggcguacaaccgguccugcaagaagugcagcugcugcgggcuggccuaccaccccuucaccaacugcggcucccacugcgugugcgggcucaaguucgaggccagcgaccgcaugcggauccaccgcgagagcggccugugccagggcuacaagucccugcggguggcccgccuccugugcaagagcaagggguccagccugaucaucuccauccuccugagcguccugauccucuccuucgugacccccaucgagggcacccugacgaacuacccggagagcaagaaguacucccuggaggagaucgccgacgugaucgagggguucaucgcggagaagggcaucaaggaguacaucguccucuacaccagcaucuucggcgcccugcugcuccugaucgcccugaucaucaccgugucccucaaccggaucaccgaguaccugacgaaccugaacgugaucuacugccacgagugcagcauguaccacuccaagaagaacaucaaguacaucggggacuucaccaacaagugcggcuucugcacgugcggggagcucgaggaccaggagggccugaacaugcacaaggucagcaagaagugcaucuaccgcuaccagcugaccugguccaaggugaucaugaccauccucgucugccugcugaucgcccagaacaccgugcugaucguggccgcgaacgacgacugcugggccaagcagagccucgagaucgagugcgucgggccccugcagcaggucgacgccugcgaggacaaguccagccgguccuacaacggcgaggccaagaagcuggugggcaccagcaaggugaccgagcucgacgccggccaggugaaccugcuggggcagaccaucgagagcgcgaucaucgccauccgcaagcagcggacguacgccaccaugcacuuccucgaguccguguuccuggggcgccacugcgacuacuacaaggucuucgagcacaacagcggcuacucccaggccaaguggcggcugcucgccaagaccaaccacuucgacaucugcagccgccacuccacccaccacuucugccggugcaugagcgacgggacgaagugcgagaacggcaacugggacuucgcgggcgagaugaacaccaccuaccacuccaagcgcgacuucuucaagcacgacuucaagcuguucugcacccugcucgagaacgccuuccccgggacgaccgagagccuguacuaccagcugcucuccaagcggaacaccaccggcgccagcaagcugcuggggaagcucaucacgaaguucggcaacaacaaccuguucguggggaucuggaaguucggccaguuccugcucucccugcccuacgugaacaacaccgagcugagcgcccuccaguccagcaagauccuggaguccccggagccccugcuccgcagcgcguccggccgccaggagagccugagcuccgccacccccggggaggccagcaaggagugccggaacgccaagaagaucuccugcaucagcccccgcuucggcgucccgauggagaaccugaccgccugcggggagucccccaacuacaagaucuacaagacgcccacccggaucuacaagagcaacaacaagggcgagaucuggugcgugggcgacgugcacugcuuccaggaguucacccccguccuccaggaggugguggacaagcugaagaagaugaccugcuuccugacggagccggaggcggaggaggacgccuucuccaucgccaucgccaugugcaagauccucgacaagggggucugcaccaucaacagcgagcgcuggaacaucaugaagugcgacuccggccugauguacuacaccgaccagcgggacgggcaggacaccggcaacgacuucggggaguacugcaucagccacaacugcaagacggagcgcuuccccaucaaccccuccaucaucagcgacugcaucugggaguaccacucccgcaagagccgguacaucggcacccugaaccucgagucccuggaggaguucaagcgggccaucagcgagaagcugucccacacccucgugguguaccaguucaagcccaccagcaaccugccgcacaugaagcccgucuacaaguacaucacggcgcagggcguggagaacuccgacgggaucgacagcgccuucaucaccgccagcaugcccgcccuguccggcaccagcaucggguacaacgugauguccaaggacaacuucccccucuucgacaucaucaucuucaucaagagcgccgucaucaagaccacguacaaccacaucuacgacaccggcccgaccaucgggaucaacgugaugcacgacgagcacugcaccggccagugccccaucgagaucccccacaaggagaacuggcugacguucucccaggagcgcaccagccgguggggcugcgaggaguucgggugccuggcgaucaacaccggcugcguguucggguccugccaggacaucauccgcccggagaccaaggucuaccggaaggccaucgaggagagcgugcuccugaccgugugcgucacguaccccggcaacaccuucugcaccgagaucaacgccaucgagcccaagaucaccgacgagcuggagcuccaguucaagacgguggacaccaagacccugcccaaccugcucgccgugcagaaccacaagcuguacuccgggcagaucaacgaccugggcagcuucgcgcagggcugcgggaacauccagaagaccaaccucuccgucaucggcacggggaccgccaaguucgacuacaucugccacggcgccagccgcaaggacaucguggugcggcgcugcuacaacaacaacuacgaguccugcaagcugcugaaggaggagccgagccucaucuucuccgacaaccacgagaccaucgaggucgccaacauccggcaccuccugggggagcuccaguucaagcugaugcugggcgaccuccgcuacaagagcuucgccgagaaccccgagcuggagaucgaggcgcggugcgugggcugccccuccugcuucagcuccuacagcugcaacuuccgcaucagcuccagcaucgacaccgugugcgccaucgacgggcccugcacgaucuuccacaaccgccugaucaucuccagcaccaagcaggacuacggcaucaagauguccugcaaggagaagccgaaccccgucgagaaguucaacaucugcaagcggguguacagcguccucuucaccaccaucgacaagaacgacaagaucgagaucaacacgggggaccagaccuccuucauccaggagaaggacgaccgcugcaagaccuggcugugccgggugcgcgacgagggcaucagcgugaucuucgagcccaucaaggccuucuucggcuccuacuucagcaucgccuucuacguggucaucgggaucaucgcccuguucaucaucaucuacaucuuccuccccaugguguucaagcugaaggacauccugaagaagaacgagcuccuguaccugcaggagaugaaguacaaguga

SEQ ID NO: 12514 - RNA, 4305 nt, Artificial Sequence
  derived and/or modified CDS sequence (opt1) from ANADV(EIV-18146Yak)__KT313748.1__GP
auguuccugauccucgugcugcugauccccuucuacaucaccgccaccccggucacgacccgcugcuuccacggcgggcagcucaucgccgagagcaagucccugaccgcgaucagcgaguucugccugaaggacgacguguccaccgucaagagcgagaucaucuaccucaagaacgacacgggcaucuucgcccacuccaaggugcugcggaacuggaucaucaaggacuggaagaacugcaaccccgugcccaccgccgggggcagcaucaacgugaucgaggucaacgccgaccugucccucagcaccaagaccuacgugugcucccgcgacugcacgaucaccguggacaaggaggacgcccagaucaucuuccagaccgacaagcugaaccacuucgaggucagcgggaccacgcuguccagcggcugguucaagaccaaggcguccgugacccucgaccggaccugcgagcacaucaaggugacgugcggcaagaagacccugcagcugcacgccugcuucaagcaccacaugagcugcauccgcuucuuccacaacaccauccuccccgggaccauggccgucuccaucugccagaacaucgagcugaucaucaucacgagccugacccucaucaucuucauccugauggugauccugaccaagaccuacaucugcuacgugcucaugccgcuguucaugcccgucgccuaccuguacggcugggcguacaaccgguccugcaagaagugcagcugcugcgggcucgccuaccaccccuucacgaacugcggcucccacugcgugugcgggcugaaguucgaggccagcgaccgcaugcggauccaccgcgagagcggccugugccagggcuacaagucccuccggguggcccgccugcugugcaagagcaagggguccagccucaucgucuccauccugcugagcgugcucauccuguccuucgugacccccaucgagggcacccugaccaacuacccggagagcaagaaguacucccucgaggagaucgccgacgucaucgagggguucaucgcggagaagggcaucaaggaguacaucgugcuguacacgagcaucuucggcgcccugcuccugcugaucgcccucaucaucaccgugucccugaaccggaucaccgaguaccugaccaaccucaacgucaucuacugccacgagugcagcauguaccacuccaagaagaacaucaaguacaucggggacuucacgaacaagugcggcuucugcacgugcggggagcuggaggaccaggagggccugaacaugcacaaggugagcaagaagugcaucuaccgcuaccagcucaccugguccaaggucaucaugaccauccuggugugccugcugaucgcccagaacaccgugcucaucgucgccgcgaacgacgacugcugggccaagcagagccuggagaucgagugcguggggccccugcagcaggucgacgccugcgaggacaaguccagccgguccuacaacgaggaggccaagaagcucgugggcaccagcaaggugaccgagcuggacgccggccaggugaaccugcucgggcagaccaucgagagcgcgaucaucgccauccgcaagcagcggaccuacgccacgaugcacuuccuggaguccgucuuccugggccgccacugcgacuacuacaagguguucgagcacaacagcggguacucccaggccaaguggcggcuccuggccaagaccaaccacuucgacaucugcagccgccacuccacccaccacuucugccggugcaugagcgacggcaccaagugcgagaacgggaacugggacuucgcgggcgagaugaacacgaccuaccacuccaagcgcgacuucuucaagcacgacuucaaccuguucugcacccuccuggagaacgccuuccccggcaccacggagagccuguacuaccagcuccuguccaagcggaacaccaccggggccagcaagcugcucggcaagcugaucaccaaguucgggaacaacaaccuguucgugggcaucuggaaguucgggcaguuccuccugucccugcccuacgucaacaacacggagcucagcgcccugcaguccagcaagauccuggaguccccggagccccuccugcgcagcgcguccggccgccaggagagccugagcuccgccacccccggcgaggccagcaaggagugccggaacgccaagaagaucuccugcaucagcccccgcuucggggugccgauggagaaccucaccgccugcggcgagucccccaacuacaagaucuacaagacccccacgcggaucuacaagagcaacaacaagggggagaucuggugcgcgggcgacgugcacugcuuccaggaguucacccccguccugcaggaggugguggacaagcugaagaagaugaccugcuuccucaccgagccggaggccgaggaggacgccuucuccaucgccaucgccaugugcaagauccuggacaagggcgucugcacgaucaacagcgagcgcuggaacaucaucaagugcgacuccgggcugauguacuacaccgaccagcgggacggccaggacaccgggaacgacuucggcgaguacugcaucagccacaacugcaagaccgagcgcuuccccaucaaccccuccaucaucagcgacugcaucugggaguaccacucccgcaagagccgguacaucuccacgcucaaccuggagagccuggaggaguucaagcgggcgaucuccgagaagcucagccacacccugaucguguaccaguucaagcccaccuccaaccugccgcacaugaagcccguguacaaguacaucaccgcccagggggucgagaacagcgacggcaucgacagcgccuucaucacggccuccaugcccgcccucagcggcaccuccaucggguacaacgugaugagcaaggacaacuucccccuguucgacaucaucaucuucaucaaguccgcggugaucaagaccaccuacaaccacaucuacgacacgggcccgaccaucgggaucaacgucaugcacgacgagcacugcaccggccagugccccaucgagaucccccacaaggagaacuggcugaccuucagccaggagcgcacgucccggugggggugcgaggaguucggcugccucgccaucaacaccggcugcguguucgggagcugccaggacaucauccgcccggagaccaagguguaccggaaggccaucgaggaguccguccugcugaccgugugcgugaccuaccccggcaacacguucugcaccgagaucaacgccaucgagcccaagaucaccgacgagcucgagcugcaguucaagaccgucgacacgaagacccugcccaaccuccuggcggugcagaaccacaagcuguacagcgggcagaucaacgaccucggcuccuucgcccaggggugcggcaacauccagaagaccaaccugagcgugaucggcaccgggacggccaaguucgacuacaucugccacggcgccucccgcaaggacaucgucgugcggcgcugcuacaacaacaacuacgagagcugcaagcugcucaaggaggagccgucccugaucuucagcgacaaccacgagaccaucgagguggccaacauccggcaccuccucggggagcugcaguucaagcugaugcucggcgaccugcgcuacaaguccuucgcggagaaccccgagcuggagaucgaggcccggugcgucgggugccccagcugcuucuccagcuacagcugcaacuuccgcaucuccagcuccaucgacaccgugugcgccaucgacggccccugcaccaucuuccacaaccgccucaucaucagcuccacgaagcaggacuacggcaucaagaugagcugcaaggagaagccgaaccccguggagaaguucaacaucugcaagcgggucuacuccgugcuguucaccaccaucgacaagaacgacaagaucgagaucaacaccggggaccagacgagcuucauccaggagaaggacgaccgcugcaagaccuggcugugccgggugcgcgacgagggcaucuccgucaucuucgagcccaucaaggccuucuucgggagcuacuucuccaucgccuucuacguggugaucggcaucaucgcgcuguucaucaucaucuacaucuuccugcccauggucuucaagcugaaggacauccucaagaagaacgagcugcuguaccuccaggagaugaaguacaaguga

SEQ ID NO: 12515 - RNA, 4305 nt, Artificial Sequence
  derived and/or modified CDS sequence (opt1) from ANADV(EIV-18353Yak)__KT313751.1__GP
auguuccugauccucgugcugcugauccccuucuacaucaccgccaccccggucacgacccgcugcuuccacggcgggcagcucaucgccgagagcaagucccugaccgcgaucagcgaguucugccugaaggacgacguguccaccgucaagagcgagaucaucuaccucaagaacgacacgggcaucuucgcccacuccaaggugcugcggaacuggaucaucaaggacuggaagaacugcaaccccgugcccaccgccgggggcagcaucaacgugaucgaggucaacgccgaccugucccucagcaccaagaccuacgugugcucccgcgacugcacgaucaccguggacaaggaggacgcccagaucaucuuccagaccgacaagcugaaccacuucgaggucagcgggaccacgcuguccagcggcugguucaagaccaaggcguccgugacccucgaccggaccugcgagcacaucaaggugacgugcggcaagaagacccugcaguuccacgccugcuucaagcaccacaugagcugcauccgcuucuuccacaacaccauccugcccgggaccauggccgucuccaucugccagaacaucgagcucaucaucaucacgagccugacccugaucaucuucauccucauggugauccugaccaagaccuacaucugcuacgugcugaugccgcuguucaugcccgucgccuaccuguacggcugggcguacaaccgguccugcaagaagugcagcugcugcgggcuggccuaccaccccuucacgaacugcggcucccacugcgugugcgggcucaaguucgaggccagcgaccgcaugcggauccaccgcgagagcggccugugccagggcuacaagucccugcggguggcccgccuccugugcaagagcaagggguccagccugaucaucuccauccuccugagcguccugauccucuccuucgugacccccaucgagggcacccugaccaacuacccggagagcaagaaguacucccuggaggagaucgccgacgugaucgagggguucaucgcggagaagggcaucaaggaguacaucguccucuacacgagcaucuucggcgcccugcugcuccugaucgcccugaucaucaccgugucccucaaccggaucaccgaguaccugaccaaccugaacgugaucuacugccacgagugcagcauguaccacuccaagaagaacaucaaguacaucggggacuucacgaacaagugcggcuucugcacgugcggggagcucgaggaccaggagggccugaacaugcacaaggucagcaagaagugcaucuaccgcuaccagcugaccugguccaaggugaucaugaccauccucgucugccugcugaucgcccagaacaccgugcugaucguggccgcgaacgacgacugcugggccaagcagagccucgagaucgagugcgucgggccccugcagcaggucgacgccugcgaggacaaguccagccgguccuacaacgaggaggccaagaagcuggugggcaccagcaaggugaccgagcucgacgccggccaggugaaccugcuggggcagaccaucgagagcgcgaucaucgccauccgcaagcagcggaccuacgccacgaugcacuuccucgaguccguguuccugggccgccacugcgacuacuacaaggucuucgagcacaacagcggguacucccaggccaaguggcggcugcucgccaagaccaaccacuucgacaucugcagccgccacuccacccaccacuucugccggugcaugagcgacggcaccaagugcgagaacgggaacugggacuucgcgggcgagaugaacacgaccuaccacuccaagcgcgacuucuucaagcacgacuucaaccuguucugcacccugcucgagaacgccuuccccggcaccacggagagccuguacuaccagcugcucuccaagcggaacaccaccggggccagcaagcugcugggcaagcucaucaccaaguucgggaacaacaaccuguucgugggcaucuggaaguucgggcaguuccugcucucccugcccuacgugaacaacacggagcugagcgcccuccaguccagcaagauccuggaguccccggagccccugcuccgcagcgcguccggccgccaggagagccugagcuccgccacccccggcgaggccagcaaggagugccggaacgccaagaagaucuccugcaucagcccccgcuucggggucccgauggagaaccugaccgccugcggcgagucccccaacuacaagaucuacaagacccccacgcggaucuacaagagcaacaacaagggggagaucuggugcgcgggcgacgugcacugcuuccaggaguucacccccgugcuccaggaggucguggacaagcugaagaagaugaccugcuuccugaccgagccggaggccgaggaggacgccuucuccaucgccaucgccaugugcaagauccucgacaagggcgugugcacgaucaacagcgagcgcuggaacaucaucaagugcgacuccgggcugauguacuacaccgaccagcgggacggccaggacaccgggaacgacuucggcgaguacugcaucagccacaacugcaagaccgagcgcuuccccaucaaccccuccaucaucagcgacugcaucugggaguaccacucccgcaagagccgguacaucuccacgcugaaccucgagagccuggaggaguucaagcgggcgaucuccgagaagcugagccacacccucaucgucuaccaguucaagcccaccuccaaccugccgcacaugaagcccguguacaaguacaucaccgcccaggggguggagaacagcgacggcaucgacagcgccuucaucacggccuccaugcccgcccugagcggcaccuccaucggguacaacgucaugagcaaggacaacuucccccucuucgacaucaucaucuucaucaaguccgcggugaucaagaccaccuacaaccacaucuacgacacgggcccgaccaucgggaucaacgugaugcacgacgagcacugcaccggccagugccccaucgagaucccccacaaggagaacuggcugaccuucagccaggagcgcacgucccggugggggugcgaggaguucggcugccuggccaucaacaccggcugcgucuucgggagcugccaggacaucauccgcccggagaccaagguguaccggaaggccaucgaggaguccgugcuccugaccgucugcgugaccuaccccggcaacacguucugcaccgagaucaacgccaucgagcccaagaucaccgacgagcuggagcuccaguucaagaccguggacacgaagacccugcccaaccugcucgcgguccagaaccacaagcuguacagcgggcagaucaacgaccugggcuccuucgcccaggggugcggcaacauccagaagaccaaccucagcgugaucggcaccgggacggccaaguucgacuacaucugccacggcgccucccgcaaggacaucgugguccggcgcugcuacaacaacaacuacgagagcugcaagcugcugaaggaggagccgucccucaucuucagcgacaaccacgagaccaucgagguggccaacauccggcaccuccugggggagcuccaguucaagcugaugcugggcgaccuccgcuacaaguccuucgcggagaaccccgagcuggagaucgaggcccggugcguggggugccccagcugcuucuccagcuacagcugcaacuuccgcaucuccagcuccaucgacaccgucugcgccaucgacggccccugcaccaucuuccacaaccgccugaucaucagcccgacgaagcaggacuacggcaucaagauguccugcaaggagaagcccaaccccguggagaaguucaacaucugcaagcggguguacagcguccucuucaccaccaucgacaagaacgacaagaucgagaucaacaccggggaccagacguccuucauccaggagaaggacgaccgcugcaagaccuggcugugccgggugcgcgacgagggcaucagcgugaucuucgagcccaucaaggccuucuucggguccuacuucagcaucgccuucuacgucgugaucggcaucaucgcgcuguucaucaucaucuacaucuuccucccgaugguguucaagcugaaggacauccugaagaagaacgagcuccuguaccugcaggagaugaaguacaaguga

SEQ ID NO: 12516 - RNA, 4305 nt, Artificial Sequence
  derived and/or modified CDS sequence (opt1) from ANADV(EIV-18560Yak)__KT313754.1__GP
auguuccugauccucgugcugcugauccccuucuacaucaccgccaccccggucacgacccgcugcuuccacggcgggcagcucaucgccgagagcaagucccugaccgcgaucagcgaguucugccugaaggacgacguguccaccgucaagagcgagaucaucuaccucaagaacgacacgggcaucuucgcccacuccaaggugcugcggaacuggaucaucaaggacuggaagaacugcaaccccgugcccaccgccgggggcagcaucaacgugaucgaggucaacgccgaccugucccucagcaccaagaccuacgugugcucccgcgacugcacgaucaccguggacaaggaggacgcccagaucaucuuccagaccgacaagcugaaccacuucgaggucagcgggaccacgcuguccagcggcugguucaagaccaaggcguccgugacccucgaccggaccugcgagcacaucaaggugacgugcggcaagaagacccugcaguuccacgccugcuucaagcaccacaugagcugcauccgcuucuuccacaacaccauccugcccgggaccauggccgucuccaucugccagaacaucgagcucaucaucaucacgagccugacccugaucaucuucauccucauggugauccugaccaagaccuacaucugcuacgugcugaugccgcuguucaugcccgucgccuaccuguacggcugggcguacaaccgguccugcaagaagugcagcugcugcgggcuggccuaccaccccuucacgaacugcggcucccacugcgugugcgggcucaaguucgaggccagcgaccgcaugcggauccaccgcgagagcggccugugccagggcuacaagucccugcggguggcccgccuccugugcaagagcaagggguccagccugaucaucuccauccuccugagcguccugauccucuccuucgugacccccaucgagggcacccugaccaacuacccggagagcaagaaguacucccuggaggagaucgccgacgugaucgagggguucaucgcggagaagggcaucaaggaguacaucguccucuacacgagcaucuucggcgcccugcugcuccugaucgcccugaucaucaccgugucccucaaccggaucaccgaguaccugaccaaccugaacgugaucuacugccacgagugcagcauguaccacuccaagaagaacaucaaguacaucggggacuucacgaacaagugcggcuucugcacgugcggggagcucgaggaccaggagggccugaacaugcacaaggucagcaagaagugcaucuaccgcuaccagcugaccugguccaaggugaucaugaccauccucgucugccugcugaucgcccagaacaccgugcugaucguggccgcgaacgacgacugcugggccaagcagagccucgagaucgagugcgucgggccccugcagcaggucgacgccugcgaggacaaguccagccgguccuacaacgaggaggccaagaagcuggugggcaccagcaaggugaccgagcucgacgccggccaggugaaccugcuggggcagaccaucgagagcgcgaucaucgccauccgcaagcagcggaccuacgccacgaugcacuuccucgaguccguguuccugggccgccacugcgacuacuacaaggucuucgagcacaacagcggguacucccaggccaaguggcggcugcucgccaagaccaaccacuucgacaucugcagccgccacuccacccaccacuucugccggugcaugagcgacggcaccaagugcgagaacgggaaccgcgacuucgcgggcgagaugaacacgaccuaccacuccaagcgggacuucuucaagcacgacuucaaccuguucugcacccugcucgagaacgccuuccccggcaccacggagagccuguacuaccagcugcucuccaagcgcaacaccaccggggccagcaagcugcugggcaagcucaucaccaaguucgggaacaacaaccuguucgugggcaucuggaaguucgggcaguuccugcucucccugcccuacgugaacaacacggagcugagcgcccuccaguccagcaagauccuggaguccccggagccccugcuccgcagcgcguccggccggcaggagagccugagcuccgccacccccggcgaggccagcaaggagugccgcaacgccaagaagaucuccugcaucagcccccgguucggggucccgauggagaaccugaccgccugcggcgagucccccaacuacaagaucuacaagacccccacgcgcaucuacaagagcaacaacaagggggagaucuggugcgcgggcgacgugcacugcuuccaggaguucacccccgugcuccaggaggucguggacaagcugaagaagaugaccugcuuccugaccgagccggaggccgaggaggacgccuucuccaucgccaucgccaugugcaagauccucgacaagggcgugugcacgaucaacagcgagcgguggaacaucaucaagugcgacuccgggcugauguacuacaccgaccagcgcgacggccaggacaccgggaacgacuucggcgaguacugcaucagccacaacugcaagaccgagcgguuccccaucaaccccuccaucaucagcgacugcaucugggaguaccacucccgcaagagccgguacaucuccacgcugaaccucgagagccuggaggaguucaagcgcgcgaucuccgagaagcugagccacacccucaucgucuaccaguucaagcccaccuccaaccugccgcacaugaagcccguguacaaguacaucaccgcccaggggguggagaacagcgacggcaucgacagcgccuucaucacggccuccaugcccgcccugagcggcaccuccaucggguacaacgucaugagcaaggacaacuucccccucuucgacaucaucaucuucaucaaguccgcggugaucaagaccaccuacaaccacaucuacgacacgggcccgaccaucgggaucaacgugaugcacgacgagcacugcaccggccagugccccaucgagaucccccacaaggagaacuggcugaccuucagccaggagcggacgucccgcugggggugcgaggaguucggcugccuggccaucaacaccggcugcgucuucgggagcugccaggacaucauccggccggagaccaagguguaccgcaaggccaucgaggaguccgugcuccugaccgucugcgugaccuaccccggcaacacguucugcaccgagaucaacgccaucgagcccaagaucaccgacgagcuggagcuccaguucaagaccguggacacgaagacccugcccaaccugcucgcgguccagaaccacaagcuguacagcgggcagaucaacgaccugggcuccuucgcccaggggugcggcaacauccagaagaccaaccucagcgugaucggcaccgggacggccaaguucgacuacaucugccacggcgccucccggaaggacaucgugguccgccggugcuacaacaacaacuacgagagcugcaagcugcugaaggaggagccgucccucaucuucagcgacaaccacgagaccaucgagguggccaacauccgccaccuccugggggagcuccaguucaagcugaugcugggcgaccuccgguacaaguccuucgcggagaaccccgagcuggagaucgaggcccgcugcguggggugccccagcugcuucuccagcuacagcugcaacuuccgcaucuccagcuccaucgacaccgucugcgccaucgacggccccugcaccaucuuccacaaccggcugaucaucagcccgacgaagcaggacuacggcaucaagauguccugcaaggagaagcccaaccccguggagaaguucaacaucugcaagcgcguguacagcguccucuucaccaccaucgacaagaacgacaagaucgagaucaacaccggggaccagacguccuucauccaggagaaggacgaccggugcaagaccuggcugugccgcgugcgggacgagggcaucagcgugaucuucgagcccaucaaggccuucuucggguccuacuucagcaucgccuucuacgucgugaucggcaucaucgcgcuguucaucaucaucuacaucuuccucccgaugguguucaagcugaaggacauccugaagaagaacgagcuccuguaccugcaggagaugaaguacaaguga

SEQ ID NO: 12517 - RNA, 4305 nt, Artificial Sequence
  derived and/or modified CDS sequence (opt1) from ANADV(EIV-18715Yak)__KT313757.1__GP
auguuccugauccucgugcugcugauccccuucuacaucaccgccaccccggucacgacccgcugcuuccacggcgggcagcucaucgccgagagcaagucccugaccgcgaucagcgaguucugccugaaggacgacguguccaccgucaagagcgagaucacguaccucaagaacgacaccggcaucuucgcccacuccaaggugcugcggaacuggaucaucaaggacuggaagaacugcaaccccgugcccaccgccgggggcagcaucaacgugaucgaggucaacgccgaccugucccucagcaccaagacguacgugugcucccgcgacugcaccaucaccguggacaaggaggacgcccagaucaucuuccagaccgacaagcugaaccacuucgaggucagcgggacgacccuguccagcggcugguucaagaccaaggcguccgugacccucgaccggacgugcgagcacaucaaggugaccugcggcaagaagacccugcaguuccacgccugcuucaagcaccacaugagcugcauccgcuucuuccacaacaccauccugcccgggacgauggccgucuccaucugccagaacaucgagcucaucaucaucaccagccugacccugaucaucuucauccucauggugauccugaccaagacguacaucugcuacgugcugaugccgcuguucaugcccgucgccuaccuguacggcugggcguacaaccgguccugcaagaagugccccugcugcgggcuggccuaccaccccuucaccaacugcggcagccacugcgugugcgggcucaaguucgaggccuccgaccgcaugcggauccaccgcgagagcggccugugccagggcuacaagagccugcggguggcccgccuccugugcaaguccaaggggagcucccugaucaucagcauccuccuguccguccugauccucagcuucgugaccccgaucgagggcacccugacgaacuaccccgaguccaagaaguacagccuggaggagaucgccgacgugaucgagggguucaucgcggagaagggcaucaaggaguacaucguccucuacaccuccaucuucggcgcccugcugcuccugaucgcccugaucaucaccgugagccucaaccggaucaccgaguaccugacgaaccugaacgugaucuacugccacgagugcuccauguaccacagcaagaagaacaucaaguacaucggggacuucaccaacaagugcggcuucugcacgugcggggagcucgaggaccaggagggccugaacaugcacaaggucuccaagaagugcaucuaccgcuaccagcugaccuggagcaaggugaucaugaccauccucaucugccugcugaucgcccagaacaccguccugaucguggccgcgaacgacgacugcugggccaagcagucccucgagaucgagugcguggggccccugcagcaggucgacgccugcgaggacaagagcucccggagcuacaacggcgaggccaagaagcuggugggcaccucccgcgugaccgagcucgacgccgggcaggucaaccugcugggccagaccaucgagagcgcgaucaucgccauccggaagcagcgcacguacgccaccaugcacuuccucgagagcguguuccuggggcggcacugcgacuacuacaagguguucgagcacaacuccggcuacagccaggccaaguggcgccugcucgccaagaccaaccacuucgacaucugcucccggcacagcacccaccacuucugccgcugcauguccgacgggacgaagugcgagaacggcaacugggacuucgcgggcgagaugaacaccaccuaccacagcaagcgggacuucuucaagcacgacuucucccuguucugcacccugcucgagaacgccuuccccgggacgaccgagagccuguacuaccagcugcucuccaagcgcaacaccaccggcgccagcaagcugcuggggaagcucaucacgaaguucggcaacaacaaccuguucgucgggaucuggaaguucggccaguuccugcucucccugccguacgugaacaacaccgagcugagcgcccuccaguccagcaagauccuggagucccccgagccccugcuccgcagcgcguccggccggcaggagagccugagcuccgccacccccggggaggccagcaaggagugccgcaacgccaagaagaucuccugcaucagcccgcgguucggcgugcccauggagaaccugaccgccugcggggagucccccaacuacaagaucuacaagacgcccacccgcaucuacaagagcaacaacaagggcgagaucuggugcgcgggcgacguccacugcuuccaggaguucaccccggugcuccaggagguggucgacaagcugaagaagaugaccugcuuccugacggagcccgaggccgaggaggacgccuucuccaucgccaucgccaugugcaagauccucgacaagggggugugcaccaucaacagcgagcgguggaacaucaucaagugcgacuccggccugauguacuacaccgaccagcgcgacgggcaggacaccggcaacgacuucggggaguacugcaucagccacaacugcaagacggagcgguuccccaucaaccccuccaucaucagcgacugcgugugggaguaccacucccgcaagagccgguacaucuccacccugaaccucgagagccuggaggaguucaagcgcgcgaucuccgagaagcugagccacacccucgucguguaccaguucaagccgaccuccaaccugccccacaugaagcccguguacaaguacaucacggcccagggcgucgagaacagcgacggcaucgacagcgccuucaucaccgccuccaugcccgcccugagcgggaccuccaucggcuacaacgugaugagcaaggacaacuucccccucuucgacaucaucaucuucaucaaguccgcggugaucaagaccacguacaaccacaucuacgacaccgggccgaccaucggcaucaacgucaugcacgacgagcacugcaccgggcagugccccaucgagaucccgcacaaggagaacuggcugacguucagccaggagcggaccucccgcuggggcugcgaggaguucggcugccuggccaucaacaccgggugcguguucggcagcugccaggacaucauccggcccgagaccaagguguaccgcaaggccaucgaggaguccguccuccugaccgugugcgugacguaccccgggaacaccuucugcaccgagaucaacgccaucgagcccaagaucaccgacgagcuggagcuccaguucaagacggucgacaccaagacccugccgaaccugcucgcggugcagaaccacaagcuguacagcggccagaucaacgaccugggguccuucgcccagggcugcggcaacauccagaagaccaaccucagcgugaucgggacgggcaccgccaaguucgacuacaucugccacggggccucccggaaggacaucgucgugcgccggugcuacaacaacaacuacgagagcugcaagcugcugaaggaggagcccucccucaucuucagcgacaaccacgagaccaucgagguggccaacauccgccaccuccugggcgagcuccaguucaagcugaugcugggggaccuccgguacaaguccuucgcggagaaccccgagcuggagaucgaggcccgcugcgucggcugccccagcugcuucuccagcuacagcugcaacuuccgcaucuccagcuccaucgacaccgugugcgccaucgacggcccgugcacgaucuuccacagccggcugaucaucuccagcaccaagcaggacuacgggaucaagauguccugcaaggagaagcccaaccccguggagaaguucaacaucugcaagcgcgucuacagcguccucuucaccaccaucgacaagaacgacaagaucgagaucaacacgggcgaccagaccuccuucauccaggagaaggacgaccggugcaagaccuggcugugccgcgugcgggacgaggggaucagcgugaucuucgagcccaucaaggccuucuucggcuccuacuucagcaucgccuucuacguggugaucggcaucaucgcgcuguucaucaucaucuacaucuuccucccgauggucuucaagcugaaggacauccugaagaagaacgagcuccuguaccugcaggagaugaaguacaaguga

SEQ ID NO: 12518 - RNA, 4305 nt, Artificial Sequence
  derived and/or modified CDS sequence (opt1) from ANADV(EIV-23263Tyum)__KT313760.1__GP
auguuccugauccucgugcugcugauccccuucuacaucaccgccaccccggucacgacccgcugcuuccacggcgggcagcucaucgccgagagcaagucccugaccgcgaucagcgaguucugccugaaggacgacguguccaccgucaagagcgagaucacguaccucaagaacgacaccggcaucuucgcccacuccaaggugcugcggaacuggaucaucaaggacuggaagaacugcaaccccgugcccaccgccgggggcagcaucaacgugaucgaggucaacgccgaccugucccucagcaccaagacguacgugugcucccgcgacugcaccaucaccguggacaaggaggacgcccagaucaucuuccagaccgacaagcugaaccacuucgaggucagcgggacgacccuguccagcggcugguucaagaccaaggcguccgugacccucgaccggacgugcgagcacaucaaggugaccugcggcaagaagacccugcaguuccacgccugcuucaagcaccacaugagcugcauccgcuucuuccacaacaccauccugcccgggacgauggccgucuccaucugccagaacaucgagcucaucaucaucaccagccugacccugaucaucuucauccucauggugauccugaccaagacguacaucugcuacgugcugaugccgcuguucaugcccgucgccuaccuguacggcugggcguacaaccgguccugcaagaagugcagcugcugcgggcuggccuaccaccccuucaccaacugcggcucccacugcgugugcgggcucaaguucgaggccagcgaccgcaugcggauccaccgcgagagcggccugugccagggcuacaagucccugcggguggcccgccuccugugcaagagcaagggguccagccugaucaucuccauccuccugagcguccugauccucuccuucgugacccccaucgagggcacccugacgaacuacccggagagcaagaaguacucccuggaggagaucgccgacgugaucgagggguucaucgcggagcggggcaucaaggaguacaucguccucuacaccagcaucuucggcgcccugcugcuccugaucgcccugaucaucaccgugucccucaaccgcaucaccgaguaccugacgaaccugaacgugaucuacugccacgagugcagcauguaccacuccaagaagaacaucaaguacaucggggacuucaccaacaagugcggcuucugcacgugcggggagcucgaggaccaggagggccugaacaugcacaaggucagcaagaagugcaucuaccgguaccagcugaccugguccaaggugaucaugaccauccucgucugccugcugaucgcccagaacaccgugcugaucguggccgcgaacgacgacugcugggccaagcagagccucgagaucgagugcgucgggccccugcagcaggucgacgccugcgaggacaaguccagccgcuccuacaacggcgaggcccggaagcuggugggcaccagcaaggugaccgagcucgacgccggccaggugaaccugcuggggcagaccaucgagagcgcgaucaucgccauccgcaagcagcggacguacgccaccaugcacuuccucgaguccguguuccuggggcgccacugcgacuacuacaaggucuucgagcacaacagcggcuacucccaggccaaguggcggcugcucgccaagaccaaccacuucgacaucugcagccgccacuccacccaccacuucugccggugcaugagcgacgggacgaagugcgagaacggcaacugggacuucgcgggcgagaugaacaccaccuaccacuccaagcgcgacuucuucaagcacgacuucaagcuguucugcacccugcucgagaacgccuuccccgggacgaccgagagccuguacuaccagcugcucuccaagcgcaacaccaccggcgccagcaagcugcuggggaagcucaucacgaaguucggcaacaacaaccuguucguggggaucuggaaguucggccaguuccugcucucccugcccuacgugaacaacaccgagcugagcgcccuccaguccagcaagauccuggaguccccggagccccugcuccggagcgcguccggccgccaggagagccugagcuccgccacccccggggaggccagcaaggagugccggaacgccaagaagaucuccugcaucagcccccgcuucggcgucccgauggagaaccugaccgccugcggggagucccccaacuacaagaucuucaagacgcccacccggaucuacaagagcaacaacaagggcgagaucuggugcgcgggcgacgugcacugcuuccaggaguucacccccauccuccaggagguggucgacaagcugaagaagaugaccugcuuccugacggagccggaggccgaggaggacgccuucuccaucgccaucgccaugugcaagauccucgacaagggggugugcaccaucaacagcgagcgcuggaacaucaucaagugcgacuccggccugauguacuacaccgaccagcgggacgggcaggacaccggcaacgacuucggggaguacugcaucagccacaacugcaagacggagcgcuuccccaucaaccccuccaucaucagcgacugcaucugggaguaccacucccgcaagagccgguacaucuccacccugaaccucgagagccuggaggaguucaagcgggcgaucuccgagaagcugagccacacccucguggucuaccaguucaagcccaccuccaaccugccgcacaugaagcccguguacaaguacaucacggcccagggcguggagaacagcgacggcaucgacagcgccuucaucaccgccuccaugcccgcccugagcgggaccuccaucggcuacaacgucaugagcaaggacaacuucccccucuucgacaucaucaucuucaucaaguccgcggugaucaagaccacguacaaccacaucuacgacaccgggccgaccaucggcaucaacgugaugcacgacgagcacugcaccgggcagugccccaucgagaucccccacaaggagaacuggcugacguucagccaggagcgcaccucccgguggggcugcgaggaguucggcugccuggccaucaacaccgggugcgucuucggcagcugccaggacaucauccgcccggagaccaagguguaccggaaggccaucgaggaguccgugcuccugaccgucugcgugacguaccccgggaacaccuucugcaccgagaucaacgccaucgagcccaagaucaccgacgagcuggagcuccaguucaagacgguggacaccaagacccugcccaaccugcucgcgguccagaaccacaagcuguacagcggccagaucaacgaccugggguccuucgcccagggcugcggcaacauccagaagaccaaccucagcgugaucgggacgggcaccgccaaguucgacuacaucugccacggggccucccgcaaggacaucgugguccggcgcugcuacaacaacaacuacgagagcugcaagcugcugaaggaggagccgucccucaucuucagcgacaaccacgagaccaucgagguggccaacauccggcaccuccugggcgagcuccaguucaagcugaugcugggggaccuccgcuacaaguccuucgcggagaaccccgagcuggagaucgaggcccgcugcgugggcugccccagcugcuucuccagcuacagcugcaacuuccggaucuccagcuccaucgacaccgucugcgccaucgacggccccugcacgaucuuccacaaccgccugaucaucagcuccaccaagcaggacuacgggaucaagaugagcugcaaggagaagccgaaccccguggagaaguucaacaucugcaagcggguguacuccguccucuucaccaccaucgacaagaacgacaagaucgagaucaacacgggcgaccagaccagcuucauccaggagaaggacgaccgcugcaagaccuggcugugccgggugcgcgacgaggggaucuccgugaucuucgagcccaucaaggccuucuucggcagcuacuucuccaucgccuucuacgucgugaucggcaucaucgcgcuguucaucaucaucuacaucuuccuccccaugggguucaagcugaaggacauccugaagaagaacgagcuccuguaccugcaggagaugaaguacaaguga

SEQ ID NO: 12519 - RNA, 4305 nt, Artificial Sequence
  derived and/or modified CDS sequence (opt1) from BATV(804992)__FJ436801.1__GP
augcugcuccugcuggugcuccugauccccugcugcgucagcgccuccccggugaucacccgcugcuuccacggcgggcagcugaucgccgagcgcaagagccaggcggccaucuccgaguucugccucaaggacgacgugagcaccaucaaguccgagaucaucuacgagaagaacgacacgggccuguucgcccacaacaagguccugcgcaacuggaucaucaaggacuggaagaacugcaaccccgugcccaccgccgggggcagcaucaacgugaucgaggucaacaccgaccucucccugaccacgaagaccuacgugugcagccgggacugcaccaucaccguggacaaggaggacgcccagaucaucuuccagacggagaagcugaaccacuucgaggucuccgggaccacccucagcuccggcugguucaagaccaaggcgagcgugacgcuggaccggaccugcgagcacaucaaggugaccugcggcaagaagacccugcaguuccacgccugcuucaagcaccacauguccugcauccgguucuuccacgggacgauccuccccggcaccauggccaccagcaucugccagaacaucgagcugaucaucaucaucucccugacccucaucaucuucauccugauggucauccugacgaagaccuacaucugcuaccuccugaugccgcuguucaugcccaucgccuacuucuacggguggagcuacaacaaguccugcaagaagugccccugcugcggccucgcguaccaccccuucaccaacugcgggagccacugcgugugcggccugaaguucgaggccuccgaccgcaugcggauccaccgcgagagcggccugugccagggguacaagagccuccggguggcccgccugcugugcaaguccaagggcagcucccucaucaucagcauccugcuguccaugcucauccugagcuucgucaccccgaucgaggggacgcugaccaacuaccccgagucccggaaguacgaccucgaggagaucgccgacgugcuggagggcuucguggucgagaagggcaucaaggaguacgugguguucuacaccagcaucuucggggcccuguuccuccugauggcgcugaucgucaucaucgcccucaaccgcgugaccgaguaccugacgaacaucaacgugcuguacugccacgagugcuccauguaccacagcaagaagaacaucaaguacaucggcgacuucaccaacaagugcggguucugcacgugcggcgagcucgaggaccaggaggggcugaagauccacaaggucucccggaagugcaucuacaaguaccagcugaccuggagcaaggugaucaugaugauccucgucugccugcugaucgcccagaacaccauccugaucguggccgccuccgacgacugcuggaccaagaagucccucgagauggagugcaucggcccccugcagcaggucgacacgugcgacgacaagaccucccgcagcuacuccggcgaggcgaagaagcuggugcgggccagcaagaucuccgaccucgacgccgcccagguggggcugcugggcagcaccaucgagagcgccaucgcguccauccgccggcagcgcaccuacagcaccaugcaccuccuggaguccguguuccuggggaagcacugcgacuacuacaaggucuucgagcacaacagcggcuacucccaggccaaguggcggcucaccgccaagacccaccacuucgacaucugcagccgccacuccacgcaccacuucugccggugcaucagcgacgggaccaagugccagaacggcgacugggacuucgccggcgagaugaacuccaucuaccagagcaagaaggacuucuucaagcacgacuucaagcuguucugcacccugguggagaacgccuuccccgggaccacggagucccucuucuacgagaugcugagcaagaagaacaccaccggcaucaccaagcugcucgacaagcugacgaagaaguucgggaacaacaacauguucgugggcaucuggaaguucgggcaguaccugaugucccucccguacgucaacgagaccagccugucccccauccagcuggcgaaggugcucgaggugaccgaccagcaccaccgcagcgucuccggccgccaggagagccuggccagcgccacccccggcuccaagagcuccgagugcgaccacgccaagaaggugagcugcaucagcccccgguucggggcgccgauggagggccugauggccugcgggaacagccccaacuacaagaucuacaagacgcccgccaagcucuacaaguccaacaacaagggcgagguguggugcagcggcgacguccacugcuuccaggagcugacccccgccucccaggagagcguggaccgcaucaagcagaugaccugcuuccugaccgagccggaggugaacgacgacgucuucuccaucgccaucgcgaugugcaaggugcaggacaagggggugugcacgaucaacgaggaccgguggaacaucaucaagugcgacagcggccucaucuacuacaccgaccagcgcgaggggcaggacaccggcaacgacuucggggaguacugccugucccacagcugccggaucgagcgcuuccccaucaaccccgccaucaucuccgacugccugugggaguaccacagccggaaguccaaguacaucaccagccucgaccuggagucccuggaggaguucaagcgcgccaucagcgagaagcucagccacacgcuggucguguacaacuucaagcccaccgccaaccugccgcacaucaagcccguguacaaguacaucaccguccagggcguggagaacuccgacggcguggacagcgccuacaucaccgcguccaugcccgcccucagcgggacguccaucggcuacaacaucaugagccgggacaacuucccccuguucgacaucaucaucuucaucaaguccgccaucaucaaggccaccuacaaccacaucuacgacaccgggccgaccaucggcaucaacgucaugcacgacgagcacugcacggggcagugccccaccgacaucccccacaaggagaacuggaucaccuucgcccaggagcgcaccagccgguggggcugcgaggaguucggcugccuggcggugaacacggggugcguguucggcuccugccaggacaucauccgcccggagaccaaggucuaccggaaggccguggaggagagcgugcuccugaccgucugcaucaccuaccccgggaagacguucugcaccgagaucaacgccaucgagcccaagaucaccgacgagcuggagcuccaguucaagaccguggacaccaagacgcugcccaacauccuggccgugcagaaccacaagcucuacuccggccagaucaacgaccuggggagcuucucccagggcugcggcaacauccagaagaccaacagcuccaucaucgggaccggcaccgcgaaguucgacuacgucugccacggggccagccgcaaggacaucaucgugcggcgcugcuacaacaacaacuacgaguccugcaagcugcucaaggaggagcagagccugauguucgccgacaaccacgagacgaucgacguggccaacguccggcaccuccugggcgaccugcaguucaagcugaugcucggggaccugcgcuacaaguccuucgccgagaacccggaccuggagaucgaggcgaagugcgugggcugccccagcugcuucaccagcuacuccugcagcuucaagaucguguccaacaucgacaccgucugcagcaucgagggccccugcaccacguuccacaaccggcucaugaucaccuccaccaagcaggacuacgggaucaagaugagcugcaagaccaagcccggccugacggaggaguuccagaucugcaagaagaccuacaccgugcuguucgccaccguggagaagaacgacaagaucgagaucuccacgggggaccagaccagcuucauccaggagcgcgacgaccgcugcaagaccuggcucugccggguccgcgacgagggcaucuccgugaucuucgagccgauccgggccuucuucggcagcuacuucuccaucgccuucuacaucgugaucgggaucaucguccuguuccuggugaucuacaucuuccuccccaugauguucaagcugcgcgacgugcugaagcggaacgaguaccucuaccugcaggagaucaagcacaaguga

SEQ ID NO: 12520 - RNA, 4305 nt, Artificial Sequence
  derived and/or modified CDS sequence (opt1) from BATV(8627-11)__FJ436799.1__GP
augcugcuccugcuggugcuccugauccccugcugcgucagcgccuccccggugaucacccgcugcuuccacggcgggcagcugaucgccgagcgcaagagccaggcggccaucuccgaguucugccucaaggacgacgugagcaccaucaaguccgagaucaucuacgagaagaacgacacgggccuguucgcccacaacaagguccugcgcaacuggaucaucaaggacuggaagaacugcaaccccgugcccaccgccgggggcagcaucaacgugaucgaggucaacaccgaccucucccugaccacgaagaccuacgugugcagccgggacugcaccaucaccguggacaaggaggacgcccagaucaucuuccagacggagaagcugaaccacuucgaggucuccgggaccacccucagcuccggcugguucaagaccaaggcgagcgugacgcuggaccggaccugcgagcacaucaaggugaccugcggcaagaagacccugcaguuccacgccugcuucaagcaccacauguccugcauccgguucuuccacgggacgauccuccccggcaccauggccaccagcaucugccagaacaucgagcugaucaucaucaucucccugacccucaucaucuucauccugauggucauccugacgaagaccuacaucugcuaccuccugaugccgcuguucaugcccaucgccuacuucuacggguggagcuacaacaaguccugcaagaagugccccugcugcggccucgcguaccaccccuucaccaacugcgggagccacugcgugugcggccugaaguucgaggccuccgaccgcaugcggauccaccgcgagagcggccugugccagggguacaagagccuccggguggcccgccugcugugcaaguccaagggcagcucccucaucaucagcauccugcuguccaugcucauccugagcuucgucaccccgaucgaggggacgcugaccaacuaccccgagucccggaaguacgaccucgaggagaucgccgacgugcuggagggcuucguggucgagaagggcaucaaggaguacgugguguucuacaccagcaucuucggggcccuguuccuccugauggcgcugaucgucaucaucgcccucaaccgcgugaccgaguaccugacgaacaucaacgugcuguacugccacgagugcuccauguaccacagcaagaagaacaucaaguacaucggcgacuucaccaacaagugcggguucugcacgugcggcgagcucgaggaccaggaggggcugaagauccacaaggucucccggaagugcaucuacaaguaccagcugaccuggagcaaggugaucaugaugauccucgucugccugcugaucgcccagaacaccauccugaucguggccgccuccgacgacugcuggaccaagcgcagccucgagauggagugcaucggcccccugcagcaggucgacacgugcgacgacaagaccucccggagcuacuccggcgaggcgaagaagcuggugcgcgccagcaagaucuccgaccucgacgccgcccagguggggcugcugggcagcaccaucgagagcgccaucgcguccauccggcgccagcggaccuacagcaccaugcaccuccuggaguccguguuccuggggaagcacugcgacuacuacaaggucuucgagcacaacagcggcuacucccaggccaaguggcgccucaccgccaagacccaccacuucgacaucugcagccggcacuccacgcaccacuucugccgcugcaucagcgacgggaccaagugccagaacggcgacugggacuucgccggcgagaugaacuccaccuaccagagcaagaaggacuucuucgagcacgacuucaagcuguucugcacccugguggagaacgccuuccccgggacgaccgagucccucuucuacgagaugcugagcaagaagaacaccaccggcaucacgaagcugcucgacaagcugaccaagaaguucgggaacaacaacauguucgugggcaucuggaaguucgggcaguaccugaugucccucccguacgucaacgagaccagccugucccccacccagcuggcgaaggugcucgaggugacggaccagcaccaccgcagcgucuccggccggcaggagagccuggccagcgccacccccggcuccaagagcuccgagugcgaccacgccaagaaggugagcugcaucagcccccgcuucggggugccgauggagggccugauggcgugcgggaacucccccaacuacaagaucuacaagacccccgccaagcucuacaaguccaacaacaagggcgaggucuggugcagcggcaacgugcacugcuuccaggagcugaaccccgccucccaggagagcguggaccggaucaagcagaugaccugcuuccugacggagccggaggucaacgacgacguguucuccaucgccaucgccaugugcaaggugcaggacaagggggucugcaccaucaacaaggaccgcuggaacaucaucaagugcgacagcggccucaucuacuacaccgaccagcgggaggggcaggacaccggcaacgacuucggggaguacugccugucccacagcugccgcaucgagcgguuccccaucaaccccgcgaucaucuccgacugccugugggaguaccacagccgcaaguccaaguacaucacgagccucgaccuggagucccuggaggaguucaagcgggccaucagcgagaagcucagccacacccuggugguguacaacuucaagcccaccgccaaccugccgcacaucaagcccgucuacgaguacaucaccgugcagggcguggagaacuccgacggcgucgacagcgccuacaucacggccuccaugcccgcgcucagcgggaccuccaucggcuacaacaucaugagccgcgacaacuucccccuguucgacaucaucaucuucaucaaguccgccaucaucaaggccaccuacaaccacaucuacgacaccgggccgacgaucggcaucaacgugaugcacgacgagcacugcaccgggcagugccccaccgacaucccccacaaggagaacuggaucaccuucgcccaggagcggacgagccgcuggggcugcgaggaguucggcugccuggccgugaacaccgggugcgucuucggcuccugccaggacaucauccggccggagaccaagguguaccgcaaggcgguggaggagagcguccuccugaccgugugcaucacguaccccgggaagaccuucugcaccgagaucaacgccaucgagcccaagaucaccgacgagcuggagcuccaguucaagaccguggacacgaagacccugcccaacauccuggccguccagaaccacaagcucuacuccggccagaucaacgaccuggggagcuucucccagggcugcggcaacauccagaagaccaacagcuccaucaucgggaccggcacggccaaguucgacuacgugugccacggggcgagccggaaggacaucaucgugcgccggugcuacaacaacaacuacgaguccugcaagcugcucaaggaggagcagagccugauguucgccgacaaccacgagaccaucgacgucgccaacgugcgccaccuccugggcgaccugcaguucaagcugaugcucggggaccugcgguacaaguccuucgccgagaacccggaccuggagaucgaggccaagugcgugggcugccccagcugcuucaccagcuacuccugcagcuucaagaucgucuccaacaucgacaccgugugcagcaucgagggccccugcacgaccuuccacaaccgccucaugaucaccuccacccgccaggacuacgggaucaagaugagcugcaagacgaagcccggccugaccgaggaguuccagaucugcaagaagaccuacaccgugcuguucgcgacggucgagaagaacgacaagaucgagaucuccaccggggaccagaccagcuucauccaggagcgggacgaccgcugcaagaccuggcucugccgggugcgcgacgagggcaucuccgugaucuucgagccgauccgggccuucuucggcagcuacuucuccaucgccuucuacaucgucaucgggaucaucgugcuguuccuggugaucuacaucuuccuccccaugauguucaagcugcgcgacguccugaagcggaacgaguaccucuaccugcaggagaucaagcacaaguga

SEQ ID NO: 12521 - RNA, 4305 nt, Artificial Sequence
  derived and/or modified CDS sequence (opt1) from BATV(Chittoor/IG-20217)__JX846599.1__GP
augcugcuccugcuggugcuccugauccccugcugcgucagcgccuccccggugaucacccgcugcuuccacggcgggcagcugaucgccgagcgcaagagccaggcggccaucuccgaguucugccucaaggacgacgugagcaccaucaaguccgagaucaucuacgagaagaacgacacgggccuguucgcccacaacaagguccugcgcaacuggaucaucaaggacuggaagaacugcaaccccgugcccaccgccgggggcagcaucaacgugaucgaggucaacaccgaccucucccugaccacgaagaccuacgugugcagccgggacugcaccaucaccguggacaaggaggacgcccagaucaucuuccagacggagaagcugaaccacuucgaggucuccgggaccacccucagcuccggcugguucaagaccaaggcgagcgugacgcuggaccggaccugcgagcacaucaaggugaccugcggcaagaagacccugcaguuccacgccugcuucaagcaccacauguccugcauccgguucuuccacgggacgauccuccccggcaccauggccaccagcaucugccagaacaucgagcugaucaucaucaucucccugacccucaucaucuucauccugaugaucauccugacgaagaccuacaucugcuaccuccugaugccgcuguucaugcccaucgccuacuucuacggguggagcuacaacaaguccugcaagaagugccccugcugcggccucgcguaccaccccuucaccaacugcgggagccacugcgucugcggccugaaguucgaggccuccgaccgcaugcggauccaccgcgagagcggccugugccagggguacaagagccuccggguggcccgccugcugugcaaguccaagggcagcucccucaucaucagcauccugcuguccaugcucauccugagcuucgugaccccgaucgaggggacgcugaccaacuaccccgagucccggaaguacgaccucgaggagaucgccgacguccuggagggcuucgugguggagaagggcaucaaggaguacgucguguucuacaccagcaucuucggggcccuguuccuccugauggcgcugaucgugaucaucgcccucaaccgcgucaccgaguaccugacgaacaucaacgugcuguacugccacgagugcuccauguaccacagcaagaagaacaucaaguacaucggcgacuucaccaacaagugcggguucugcacgugcggcgagcucgaggaccaggaggggcugaagauccacaaggugucccggaagugcaucuacaaguaccagcugaccuggagcaaggucaucaugaugauccucgugugccugcugaucgcccagaacaccauccugaucgucgccgccuccgacgacugcuggaccaagaagucccucgagauggagugcaucggcccccugcagcaggucgacacgugcgacgacaagaccucccgcagcuacuccggcgaggcgaagaagcuggugcgggccagcaagaucuccgaccucgacgccgcccagguggggcugcugggcagcaccaucgagagcgccaucgcguccauccgccggcagcgcaccuacagcaccaugcaccuccuggaguccguguuccuggggaagcacugcgacuacuacaagguguucgagcacaacagcggcuacucccaggccaaguggcggcucaccgccaagacccaccacuucgacaucugcagccgccacuccacgcaccacuucugccggugcaucagcgacgggaccaagugccagaacggcgacugggacuucgccggcgagaugaacuccaccuaccagagcaagcgcgacuucuucgagcacgacuucaagcuguucugcacccugaucgagaacgccuuccccgggacgaccgagucccucuucuacgagaugcugagcaagaagaacaccaccggcaucacgaagcugcucgacaagcugaccaagaaguucgggaacaacaacauguucgucggcaucuggaaguucgggcaguaccugaucucccucccguacgugaacgagaccagccugucccccacccagcuggcgaaggugcucgaggucacggaccagcaccaccgcagcaucuccggccggcaggagagccuggccagcgccacccccggcuccaagagcuccgagugcgaccacgccaagaaggcgagcugcaucagcccccgcuucggggugccgauggagggccugauggccugcgggaacagccccaacuacaagaucuacaagacccccgccaagcucuacaaguccaacaacaagggcgagguguggugcagcggcaacuuccacugcuuccaggagcugauccccgccucccaggagagcgucgaccggaucaagcagaugaccugcuuccugacggagccggaggugaacgacgacguguucuccaucgccaucgcgaugugcaagguccaggacaagggggugugcaccaucaacaaggaccgcuggaacgugaucaagugcgacagcggccucaucuacuacaccgaccagcgggaggggcaggacaccggcaacgacuucggggaguacugccugucccacagcugccgcaucgagcgguuccccaucaaccccgccaucaucuccgacugccugugggaguaccacagccgcaaguccaaguacaucacgagccucgaccuggagucccuggaggaguucaagcgggccaucagcgagaagcucagccacacccugaucgucuacaacuucaagcccaccgccaaccugccgcacaucaagcccguguacaaguacaucaccgugcagggcgucgagaacuccgacggcguggacagcgccuacaucacggcguccaugcccgcccucagcgggaccuccaucggcuacaacaucaugagccgcgacaacuucccccuguucgacaucaucaucuucaucaaguccgccaucaucaaggccaccuacaaccacaucuacgacaccgggccgacgaucggcaucaacgugaugcacgacgagcacugcaccgggcagugccccaccgacaucccccacaaggagaacuggaucaccuucgcccaggagcggacgagccgcuggggcugcgaggaguucggcugccuggcggucaacaccgggugcguguucggcuccugccaggacaucauccggccggagaccaagguguaccgcaaggccgucgaggagagcgugcuccugaccgugugcaucacguaccccgggaagaccuucugcaccgagaucaacgccaucgagcccaagaucaccgacgagcuggagcuccaguucaagaccgucgacaucaagacgcugcccaacauccuggccgugcagaaccacaagcucuacuccggccagaucaacgaccuggggagcuucucccagggcugcggcaacauccagaagaccaacagcuccaucaucgggaccggcaccgcgaaguucgacuacgugugccacggggccagccggaaggacaucaucguccgccggugcuacaacaacaacuacgaguccugcaagcugcucaaggaggagcagagccugauguucgccgacaaccacgagacgaucgacguggccaacgugcgccaccuccugggcgaccugcaguucaagcugaugcucggggaccugcgguacaaguccuucgccgagaacccggaccuggagaucgaggcgaagugcgucggcugccccagcugcuucaccagcuacuccugcagcuucaagaucguguccaacaucgacaccgugugcagcaucgagggccccugcaccacguuccacaaccgccucaugaucaccuccaccaagcaggacuacgggaucaagaugagcugcaagaccaagcccggccugacggaggaguuccagaucugcaagaagaccuacaccguccuguucgccaccguggagaagaacgacaagaucgagaucuccacgggggaccagaccagcuucauccaggagcgcgacgaccggugcaagaccuggcucugccgcgugcgggacgagggcaucuccgucaucuucgagccgauccgcgccuucuucggcagcuacuucuccaucgccuucuacaucgugaucgggaucaucgugcuguuccuggucaucuacaucuuccuccccaugauguucaagcugcgggacgugcugaagcgcaacgaguaccucuaccugcaggagaucaagcacaaguga

SEQ ID NO: 12522 - RNA, 4305 nt, Artificial Sequence
  derived and/or modified CDS sequence (opt1) from BATV(41.3)__KM507322.1__GP
augcugcuguuccugauccugcucauccccugcuacgccagcgccuccccgguggucacccgcugcuuccacggcgggcagcugaucgcggagagccggucccccaccgccgugagcgaguucugccugaaggacgacguguccacgaucaagagcgagaucaucuacgucaagaacgacaccggccucuucgcccacaacaaggugcugcgcaacuggaucaucaaggacuggaagaacugcaaccccgugcccaccgccgggggcuccaucaacgucaucgaggugaacaccgaccugagccucuccacgaagaccuacgugugcagccgggacugcaccaucaccgucgacaaggaggacgcccagaucaucuuccagacggagaagcugaaccacuucgagguguccgggaccacccugagcuccggcugguucaagaccaaggcgagcgugacgcucgaccggaccugcgagcacaucaaggugaccugcggcaagaagacccugcaguuccacgccugcuucaagcaccacauguccugcauccgguucuuccacagcacgauccugccggggaccauggccaccuccaucugccagaacaucgagcucaucaucaucaucagccugacccugcucaucuucauccugauggccauccugacgaagaccuacaucugcuaccuccugaugccccuguucaugcccaucgcguaccucuacggcugguccuacaaccgcagcugcaagaagugcagcugcugcgggcuggccuaccaccccuucaccaacugcggcucccacugcgugugcgggcugaaguucgaggccagcgaccggaugcgcauccaccgggaguccggccucugccagggcuacaagagccugcgcguggcccggcugcucugcaaguccaaggggagcucccugaucaucagcauccugcucuccaugcugauccugagcuucgucaccccgaucgagggcacgcucaccaacuaccccgagucccgcaaguacgaccuggaggagaucgccgacgugcuggagggguucaucaccgagaagggcaucaaggaguacguggucuucuacaccagcaucuucggcgggcuguuccugcugcucgcgcugaucaucaucaucgcccugaaccgggugacggaguaccucaccaacaucaacguguucuacugccacgagugcuccauguaccacagcaagaagaacaucaaguacaucggcgacuucaccaacaagugcggguucugcacgugcggcgagcuggaggaccaggaggggcugaagauccacaaggucucccgcaagugcaucuacaaguaccagcucaccuggagcaagaucaucaugaucauccuggugugccugcugaucgcccagaacaccauccucaucguggccgccuccaacgacugcugggcgaagaagucccuggagauggagugcaucggcccccugcagcaggucgagagcugcgacgacaaggccagccggagcuacuccggcgaggccaagaagcucgugcgcgccagcaagaucuccgaccuggacgccgcgcaggucgggcugcucggcagcaccaucgaguccgccaucgccagcauccggaagcagcgcaccuaccccacgaugcaccuccuggaguccguguuccucgccaagcacugcgacuacuacaagagcuucgagcacaacuccggguacagccaggccaaguggcggcugaccgcgaagacccaccacuucgacaucugcucccgccacagcacccaccacuucugccggugcaucuccgacggcaccaagugccagaacggggacugggacuucgccggcgagaugaacagcacguaccaguccaagaaggacuucuucgagcacgacuucaagcuguucugcacccuccuggagaacgccuucccgggcaccaccgagagcuucuacuaccagaugcugcagaagaagaacacgaccgggguggucaagcuccuggacgagcugaccaagaaguucggcaacaacaacauguucguggggaucuggaaguucggccaguaccucaugucccugcccuacaucaacgagaccagccugacgccccuccagcugagcaagauccuggaggccuccaaccagcaccaccgcagcaucuccgggcgccaggagagccucgcgaacgccgccuccggcggcaagagcaaggagugcgaccacgccaagaagguguccugcaucagcccccgguucggggucccgauggagggccugaucgccugcggguccagccccaacuacaagaucuacaagaugcccaccaagcuguacaaguccaacaacaagggcgagguguggugcagcggcgacgugcacugcuuccaggagcucaaccccgcgucccaggagagcgucgaccgcaucaagcagaugaccugcuuccugaccgagccggagacgaacgaggacguguucuccaucgccaucagcaugugcaaggugcaggacaagggggucugcaccaucaacgaggagcgguggaacgugaucaagugcgacuccggccugaucuacuacaccgaccagcgcgacgggcaggacaccggcaacgacuucggggaguacugccucagccacaacugccggaucgagcgcuuccccaucaaccccacgaucaucaacgacugccugugggaguaccacucccgcaagagcaaguacaucaccagccuggaccucgagucccuggaggaguucaagcgcgccaucagcgagaagcugucccacacccucaucguguacaacuucaagcccaccgccaaccugccgcacaucaagcccgucuacaaguacaucacggugcagggcguggagaacagcgacggcgucgacuccgccuacaucaccgcgagcaugcccgcccuguccgggaccagcaucggcuacaacaucauguccaaggacaacuucccccucuucgacaucaucaucuucaucaagagcgccgugaucaaggccaccuacaaccacaucuacgacacggggccgaccaucggcaucaacgugaugcacgacgagcacugcaccgggcagugccccaccgacaucccccacaaggagaacuggaucacguucucccaggagcggaccagccgcuggggcugcgaggaguucggcugccuggccgucaacaccgggugcguguucggcuccugccaggacaucauccggccggagaccaagguguaccgcaaggcgaucgaggagagcguccugcucacggugugcaucaccuaccccgggaagaccuucugcaccgagaucaacgccaucgagcccaagaucacggacgagcuggagcugcaguucaagaccguggacaccaagacccuccccaacauccuggccguccagaaccacaagcuguacuccggccagaucaacgaccucgggagcuucucccagggcugcggcaacauccagaagaccaacagcuccaucaucgggacgggcaccgccaaguucgacuacgugugccacggggcgagccggaaggacaucaucgugcgccggugcuacaacaacaacuacgagagcugccgccugcugaaggaggagcagucccucauguucgccgacaaccacgagaccaucgacgucgccaacgugcggcaccuccugggcgaccuccaguucaagcugaugcugggggaccuccgcuacaagagcuucgccgaggacccggaccuggagaucgaggccaagugcgugggcugccccuccugcuucaccagcuacuccugcaacuuccggaucgucagcaacaucgacacggugugcuccaucgagggccccugcaccaccuuccacaaccgccugaugaucaccagcacgaagcaggacuacgggaucaagauguccugcaagggcaagcccgggagcaccgaggaguuccagaucugcaagaagaccuacaccguccucuucacgaccgucgagaagaacgacaagaucgagaucaacaccggcgaccagaccuccuucauccaggagcgcgacgaccggugcaagacguggcugugccgcgugcgggacgagggcaucagcgugaucuucgagccgauccgcgcguucuucggguccuacuucagcaucgccuucuacaucgucgugggcaucaucgugcuguuccucaugaucuacaucuuccugcccauggccuucaagcugcgggacguccucaagcgcaacgaguaccuguaccugcaggagaucaagcacaaguga

SEQ ID NO: 12523 - RNA, 4305 nt, Artificial Sequence
  derived and/or modified CDS sequence (opt1) from BATV(EIV-1217Astr)__KT313699.1__GP
augcugcuguuccugauccugcucauccccugcuacgccagcgccuccccgguggucacccgcugcuuccacggcgggcagcugaucgcggagagccggucccccaccgccgugagcgaguucugccugaaggacgacguguccacgaucaagagcgagaucaucuacgucaagaacgacaccggccucuucgcccacaacaaggugcugcgcaacuggaucaucaaggacuggaagaacugcaaccccgugcccaccgccgggggcuccaucaacgucaucgaggugaacaccgaccugagccucuccacgaagaccuacgugugcagccgggacugcaccaucaccgucgacaaggaggacgcccagaucaucuuccagacggagaagcugaaccacuucgagguguccgggaccacccugagcuccggcugguucaagaccaaggcgagcgugacgcucgaccggaccugcgagcacaucaaggugaccugcggcaagaagacccugcaguuccacgccugcuucaagcaccacauguccugcauccgcuucuuccacgggacgauccugccgggcaccauggccaccagcaucugccagaacaucgagcucaucaucaucaucucccugacccugcucaucuucauccugauggccauccugacgaagaccuacaucugcuaccuccugaugccccuguucaugcccaucgcguaccucuacggguggagcuacaaccgcuccugcaagaagugcagcugcugcggccuggccuaccaccccuucaccaacugcgggagccacugcgucugcggccugaaguucgaggccuccgaccggaugcgcauccaccgggagagcggccucugccagggguacaagucccugcgcguggcccggcugcucugcaagagcaagggcuccagccugaucaucuccauccugcucagcaugcugauccuguccuucgucaccccgaucgaggggacgcucaccaacuaccccgagagccgcaaguacgaccuggaggagaucgccgacgugcuggagggcuucgugaccgagaagggcaucaaggaguacgucguguucuacaccuccaucuucgggggccucuuccugcugcucgcgcugaucaucaucaucgcccugaaccgggugacggaguaccucaccaacaucaacgucuucuacugccacgagugcagcauguaccacuccaagaagaacaucaaguacaucggggacuucaccaacaagugcggcuucugcacgugcggggagcuggaggaccaggagggccugaagauccacaaggugagccgcaagugcaucuacaaguaccagcucaccugguccaagaucaucaugaucauccuggugugccugcugaucgcccagaacaccauccucaucgucgccgccagcaacgacugcugggcgaagaagucccuggagauggagugcaucggcccccugcagcagauggagagcugcgacgacaaggccucccggagcuacagcggggaggccaagaagcucgugcgcgccuccaagaucagcgaccuggacgccgcgcaggucggccugcucggguccaccaucgagagcgccaucgccuccauccggaagcagcgcaccuaccccacgaugcaccuccuggagagcguguuccucgccaagcacugcgacuacuacaaguccuucgagcacaacagcggcuacucccaggccaaguggcggcugaccgcgaagacccaccacuucgacaucugcagccgccacuccacccaccacuucugccggugcaucagcgacgggaccaagugccagaacggcgacugggacuucgccggcgagaugaacuccacguaccagagcaagaaggacuucuucaagcacgacuucaagcuguucugcacccuccuggagaacgccuucccggggaccaccgaguccuucuacuaccagaugcugcagaagaagaacacgaccggcguggucaagcuccuggacgagcugaccaagaaguucgggaacaacaacauguucgugggcaucuggaaguucgggcaguaccucaugagccugcccuacaucaacgagaccucccugacgccccuccagcugagcaagauccuggaggccagcgaccagcaccaccgcuccaucagcggccgccaggagucccucgcgaacgccgccagcggcgggaaguccaaggagugcgaccacgccaagaaggugagcugcaucagcccccgguucggcgucccgauggaggggcugaucgccugcggcggcucccccaacuacaagaucuacaagaugcccaccaagcuguacaaguccaacaacaagggggagguguggugcagcggcgacgugcacugcuuccaggagcucaaccccgcgcugcaggaguccgucgaccgcaucaagcagaugaccugcuuccugaccgagccggagacgaacgaggacguguucagcaucgccaucuccaugugcaaggugcaggacaagggggucugcaccaucaacgaggagcgguggaacgugaucaagugcgacagcggccucaucuacuacaccgaccagcgcgacgggcaggacaccggcaacgacuucggcgaguacugccugucccacaacugccggaucgagcgcuuccccaucaaccccacgaucaucaacgacugccugugggaguaccacagccggaaguccaaguacaucaccagccucgaccuggagucccuggaggaguucaagcgcgccaucagcgagaagcucagccacacccugaucguguacaacuucaagcccaccgccaaccugccgcacaucaagcccgucuacaaguacaucacggugcaggggguggagaacuccgacggcgucgacagcgccuacaucaccgcguccaugcccgcccucagcgggaccuccaucggcuacaacaucaugagcaaggacaacuucccccuguucgacaucaucaucuucaucaaguccgccgugaucaaggccaccuacaaccacaucuacgacacggggccgaccaucggcaucaacgugaugcacgacgagcacugcaccggccagugccccaccgacaucccccacaaggagaacuggaucacguucagccaggagcggaccucccgcugggggugcgaggaguucggcugccuggccgucaacaccgggugcguguucggcagcugccaggacaucauccggccggagaccaagguguaccgcaaggcgaucgaggaguccguccuccugacggugugcaucaccuaccccgggaagaccuucugcaccgagaucaacgccaucgagcccaagaucacggacgagcuggagcuccaguucaagaccguggacaccaagacccugcccaacauccuggccguccagaaccacaagcucuacagcggccagaucaacgaccugggcuccuucagccaggggugcggcaacauccagaagaccaacuccagcaucaucgggacgggcaccgccaaguucgacuacgugugccacggggcgucccggaaggacaucaucgugcgccggugcuacaacaacaacuacgagagcugccgccugcucaaggaggagcagucccugauguucgccgacaaccacgagaccaucgacgucgccaacgugcggcaccuccugggcgaccugcaguucaagcugaugcucggcgaccugcgcuacaagagcuucgccgaggacccggaccuggagaucgaggccaagugcguggggugccccagcugcuucaccuccuacagcugcaacuuccggaucgucuccaacaucgacacggugugcagcaucgagggccccugcaccaccuuccacaaccgccucaugaucaccuccacgaagcaggacuacgggaucaagaugagcugcaagggcaagcccggcuccaccgaggaguuccagaucugcaagaagaccuacaccgugcuguucacgaccgucgagaagaacgacaagaucgagaucaacaccggggaccagaccagcuucauccaggagcgcgacgaccggugcaagacguggcugugccgcgugcgggacgagggcaucuccguggucuucgagccgauccgcgcguucuucgggagcuacuucuccaucgccuucuacaucguggugggcaucaucguccucuuccuggugaucuacaucuuccugcccauggccuucaagcuccgggacgugcugaagcgcaacgaguaccuguaccuccaggagaucaagcacaaguga

SEQ ID NO: 12524 - RNA, 4305 nt, Artificial Sequence
  derived and/or modified CDS sequence (opt1) from BATV(EIV-12497Bl)__KT313692.1__GP
augcugcuguuccugauccugcucauccccugcuacgccagcgccuccccgguggucacccgcugcuuccacggcgggcagcugaucgcggagagccggucccccaccgccgugagcgaguucugccugaaggacgacguguccacgaucaagagcgagaucaucuacgucaagaacgacaccggccucuucgcccacaacaaggugcugcgcaacuggaucaucaaggacuggaagaacugcaaccccgugcccaccgccgggggcuccaucaacgucaucgaggugaacaccgaccugagccucuccacgaagaccuacgugugcagccgggacugcaccaucaccgucgacaaggaggacgcccagaucaucuuccagacggagaagcugaaccacuucgagguguccgggaccacccugagcuccggcugguucaagaccaaggcgagcgugacgcucgaccggaccugcgagcacaucaaggugaccugcggcaagaagacccugcaguuccacgccugcuucaagcaccacauguccugcauccgcuucuuccacgggacgauccugccgggcaccauggccaccagcaucugccagaacaucgagcucaucaucaucaccucccugacgcugcucaucuucauccugauggccauccugaccaagaccuacaucugcuaccuccugaugccccuguucaugcccaucgcguaccucuacggguggagcuacaaccgcuccugcaagaagugcagcugcugcggccuggccuaccaccccuucaccaacugcgggagccacugcgucugcggccugaaguucgaggccuccgaccggaugcgcauccaccgggagagcggccucugccagggguacaagucccugcgcguggcccggcugcucugcaagagcaagggcuccagccugaucaucuccauccugcucagcaugcugauccuguccuucgucacgccgaucgaggggacccucaccaacuaccccgagagccgcaaguacgaccuggaggagaucgccgacgugcuggagggcuucaucaccgagaagggcaucaaggaguacguggucuucuacacguccaucuucgggggccucuuccugcugcucgcgcugaucaucaucaucgcccugaaccgggugaccgaguaccucaccaacaucaacguguucuacugccacgagugcagcauguaccacuccaagaagaacaucaaguacaucggggacuucaccaacaagugcggcuucugcacgugcggggagcuggaggaccaggagggccugaagauccacaaggucagccgcaagugcaucuacaaguaccagcucaccugguccaagaucaucaugaucauccuggugugccugcugaucgcccagaacaccauccucaucguggccgccagcaacgacugcugggcgaagaagucccuggagauggagugcaucggcccccugcagcaggucgagagcugcgacgacaaggccucccggagcuacagcggggaggccaagaagcucgugcgcgccuccaagaucagcgaccuggacgccgcgcaggccggccugcucggguccaccaucgagagcgccaucgccuccauccggaagcagcgcacguaccccaccaugcaccuccuggagagcgucuuccucgccaagcacugcgacuacuacaaguccuucgagcacaacagcggcuacucccaggcgaaguggcggcugaccgccaagacccaccacuucgacaucugcagccgccacuccacccaccacuucugccggugcaucagcgacgggacgaagugccagaacggcgacugggacuucgccggcgagaugaacuccaccuaccagagcaagaaggacuucuucgagcacgacuucaagcuguucugcacccuccuggagaacgccuucccggggaccacggaguccuucuacuaccagcugcuccagaagaagaacaccaccggcguggugaagcugcuggacgagcucaccaagaaguucgggaacaacaacauguucgucggcaucuggaaguucgggcaguaccugaugagccugcccuacaucaacgagacgucccucacgccccugcagcugagcaagauccucgaggcgagcgaccagcaccaccgcuccaucagcggccgccaggagucccuggccagcgccgccuccggcggcaagagcaaggagugcgaccacgccaagaagguguccugcaucagcccccgguucuccgugccgauggaggggcugaucgcgugcgggagcucccccaacuacaagaucuaccgcaugcccaccaagcucuacaagagcaacaacaagggcgaggucuggugcuccggcgacgugcacugcuuccaggagcugaaccccgccagccaggaguccguggaccggaucaagcagaugaucugcuuccugaccgagccggaggucaacgaggacguguucagcaucgccaucuccaugugcaaggugcaggacaagggggucugcaccaucaacgaggagcgcuggaacgugaucaagugcgacagcggccucaucuacuacaccgaccagcgggacgggcaggacaccggcaacgacuucggggaguacugccugucccacaacugccgcaucgagcgguuccccaucaaccccaccaucaucaacgacugccugugggaguaccacagccgcaagagcaaguacaucacgucccucgaccuggagagccuggaggaguucaagcgggccaucuccgagaagcucagccacacccugaucguguacaacuucaagcccaccgccaaccugccgcacaucaagcccgucuacaaguacaucaccgugcagggcguggagaacuccgacggcgucgacagcgcguacaucacggccuccaugcccgcccucagcgggaccuccaucggcuacaacaucaugagccgcgacaacuucccccuguucgacaucaucaucuucaucaaguccgccgugaucaaggccaccuacaaccacaucuacgacaccgggccgacgaucggcaucaacgugaugcacgacgagcacugcaccgggcagugccccaccgacaucccccacaaggagaacuggaucaccuucagccaggagcggacgucccgcuggggcugcgaggaguucggcugccuggcggucaacaccgggugcguguucggcagcugccaggacaucauccggccggagaccaagguguaccgcaaggccgucgaggaguccgugcuccugaccgugugcaucacguaccccgggaagaccuucugcaccgagaucaacgccaucgagcccaagaucaccgacgagcuggagcuccaguucaagacggucgacaccaagacccugcccaacauccuggccgugcagaaccacaagcucuacagcggccagaucaacgaccugggguccuucagccagggcugcggcaacauccagaagaccaacuccagcaucaucgggaccggcacggcgaaguucgacuacgugugccacggggccagccggaaggacaucaucguccgccggugcuacaacaacaacuacgaguccugccgccugcucaaggaggagcagagccugauguucgccgacaaccacgagaccaucgacguggccaacgugcggcaccuccugggcgaccugcaguucaagcugaugcucggggaccugcgcuacaaguccuucgccgaggacccgggccuggagaucgaggcgaagugcgucggcugccccagcugcuucaccuccuacagcugcaacuuccgcaucguguccaacaucgacaccgugugcagcaucgaggggcccugcacgaccuuccacaaccggcucaugaucaccuccaccaagcaggacuacggcaucaagaugagcugcaaggggaagcccggcuccacggaggaguuccagaucugcaagaagaccuacaccguccuguucaccacgaucgagaagaacgacaagaucgagaucaacaccggcgaccagaccagcuucgugcaggagcgcgacgaccggugcaagaccuggcugugccgcgugcgggacgaggggaucuccgucaucuucgagccgauccgcgccuucuucggcagcuacuucuccaucgccuucuacaucgugguggggaucaucguccucuuccuggugaucuacaucuuccugcccauggccuucaagcuccgggacgugcugaagcgcaacgaguaccuguaccuccaggagaucaagcacaaguga

SEQ ID NO: 12525 - RNA, 4305 nt, Artificial Sequence
  derived and/or modified CDS sequence (opt1) from BATV(EIV-12845Ms)__KT313690.1__GP
augcugcuguuccugauccugcucauccccugcuacgccagcgccuccccgguggucacccgcugcuuccacggcgggcagcugaucgcggagaaccggagccccaccgccguguccgaguucugccugaaggacgacgugagcacgaucaaguccgagaucaucuacgucaagaacgacaccggccucuucgcccacaacaaggugcugcgcaacuggaucaucaaggacuggaagaacugcaaccccgugcccaccgccgggggcagcaucaacgucaucgaggugaacaccgaccugucccucagcacgaagaccuacgugugcucccgggacugcaccaucaccgucgacaaggaggacgcccagaucaucuuccagacggagaagcugaaccacuucgaggugagcgggaccacccuguccagcggcugguucaagaccaaggcguccgugacgcucgaccggaccugcgagcacaucaaggugaccugcggcaagaagacccugcaguuccacgccugcuucaagcaccacaugagcugcauccgguucuuccacuccacgauccugccggggaccauggccaccagcaucugccagaacaucgagcucaucaucaucaucucccugacccugcucaucuucauccugauggccauccugacgaagaccuacaucugcuaccuccugaugccccuguucaugcccaucgcguaccucuacggcuggagcuacaaccgcuccugcaagaagugcagcugcugcgggcuggccuaccaccccuucaccaacugcggcagccacugcgugugcgggcugaaguucgaggccuccgaccggaugcgcauccaccgggagagcggccucugccagggcuacaagucccugcgcguggcccggcugcucugcaagagcaagggguccagccugaucaucuccauccugcucagcaugcugauccuguccuucgucaccccgaucgagggcacgcucaccaacuaccccgagagccgcaaguacgaccuggaggagaucgccgacgugcuggagggguucaucaccgagaagggcaucaaggaguacguggucuucuacaccuccaucuucggcgggcuguuccugcugcucgcgcugaucaucaucaucgcccugaaccgggugacggaguaccucaccaacaucaacguguucuacugccacgagugcagcauguaccacuccaagaagaacaucaaguacaucggcgacuucaccaacaagugcggguucugcacgugcggcgagcuggaggaccaggaggggcugaagauccacaaggucagccgcaagugcaucuacaaguaccagcucaccugguccaagaucaucaugaucauccuggugugccugcugaucgcccagaacaccauccucaucguggccgccagcaacgacugcugggcgaagaagucccuggagauggagugcaucggcccccugcagcaggucgagagcugcgacgacaaggccucccggagcuacagcggcgaggccaagaagcucgugcgcgccuccaagaucagcgaccuggacgccgcgcaggucgggcugcucggcuccaccaucgagagcgccaucgccuccauccggaagcagcgcaccuaccccacgaugcaccuccuggagagcguguuccucgccaagcacugcgacuacuacaaguccuucgagcacaacagcggguacucccaggccaaguggcggcugaccgcgaagacccaccacuucgacaucugcagccgccacuccacccaccacuucugccggugcaucagcgacggcaccaagugccagaacggggacugggacuucgccggcgagaugaacuccacguaccagagcaagaaggacuucuucgagcacgacuucaagcuguucugcacccuccuggagaacgccuucccgggcaccaccgaguccuucuacuaccagaugcugcagaagaagaacacgaccgggguggucaagcuccuggacgagcugaccaagaaguucggcaacaacaacauguucguggggaucuggaaguucggccaguaccucaugagccugcccuacaucaacgagaccucccugacgccccuccagcugagcaagauccuggaggccagcgaccagcaccaccgcuccaucagcgggcgccaggagucccucgcgaacgccgccagcggcuccaagagcaaggagugcgaccacgccaagaagguguccugcaucagcccccgguucggcgucccgauggaggggcugaucgccugcggcuccagccccaacuacaagaucuacaagaugcccaccaagcuguacaaguccaacaacaagggggagguguggugcagcggcgacgugcacugcuuccaggagcucaaccccgcgucccaggagagcgucgaccgcaucaagcagaugaccugcuuccugaccgagccggagacgaacgaggacguguucuccaucgccaucagcaugugcaaggugcaggacaagggcgucugcaccaucaacgaggagcgguggaacgugaucaagugcgacuccgggcugaucuacuacaccgaccagcgcgacggccaggacaccgggaacgacuucggcgaguacugccucagccacaacugccggaucgagcgcuuccccaucaaccccacgaucaucaacgacugccugugggaguaccacucccgcaagagcaaguacaucaccagccuggaccucgagucccuggaggaguucaagcgcgccaucagcgagaagcugucccacacccucaucguguacaacuucaagcccaccgccaaccugccgcacaucaagcccgucuacaaguacaucacggugcaggggguggagaacagcgacggcgucgacuccgccuacaucaccgcgagcaugcccgcccuguccggcaccagcaucggguacaacaucauguccaaggacaacuucccccucuucgacaucaucaucuucaucaagagcgccgugaucaaggccaccuacaaccacaucuacgacacgggcccgaccaucgggaucaacgugaugcacgacgagcacugcaccggccagugccccaccgacaucccccacaaggagaacuggaucacguucucccaggagcggaccagccgcugggggugcgaggaguucggcugccuggccgucaacaccggcugcguguucggguccugccaggacaucauccggccggagaccaagguguaccgcaaggcgaucgaggagagcguccugcucacggugugcaucaccuaccccggcaagaccuucugcaccgagaucaacgccaucgagcccaagaucacggacgagcuggagcugcaguucaagaccguggacaccaagacccuccccaacauccuggccguccagaacuacaagcuguacuccgggcagaucaacgaccucggcagcuucucccaggggugcggcaacauccagaagaccaacagcuccaucaucggcacggggaccgccaaguucgacuacgugugccacggcgcgagccggaaggacaucaucgugcgccggugcuacaacaacaacuacgagagcugccgccugcugaaggaggagcagucccucauguucgccgacaaccacgagaccaucgacgucgccaacgugcggcaccuccugggggaccuccaguucaagcugaugcugggcgaccuccgcuacaagagcuucgccgaggacccggaccuggagaucgaggccaagugcguggggugccccuccugcuucaccagcuacuccugcaacuuccggaucgucagcaacaucgacacggugugcuccaucgagggccccugcaccaccuuccacaaccgccugaugaucaccagcacgaagcaggacuacggcaucaagauguccugcaaggggaagcccggcagcaccgaggaguuccagaucugcaagaagaccuacaccguccucuucacgaccgucgagaagaacgacaagaucgagaucaacaccggggaccagaccuccuucauccaggagcgcgacgaccggugcaagacguggcugugccgcgugcgggacgagggcaucagcgugaucuucgagccgauccgcgcguucuucggcuccuacuucagcaucgccuucuacaucgucguggggaucaucgugcuguuccucgucaucuacaucuuccugcccauggccuucaagcugcgggacgugcucaagcgcaacgaguaccuguaccugcaggagaucaagcacaaguga

SEQ ID NO: 12526 - RNA, 4305 nt, Artificial Sequence
  derived and/or modified CDS sequence (opt1) from BATV(EIV-2077Astr)__KT313702.1__GP
augcugcuguuccugauccugcucauccccugcuacgccagcgccuccccgguggucacccgcugcuuccacggcgggcagcugaucgcggagagccggucccccaccgccgugagcgaguucugccugaaggacgacguguccacgaucaagagcgagaucaucuacgucaagaacgacaccggccucuucgcccacaacaaggugcugcgcaacuggaucaucaaggacuggaagaacugcaaccccgugcccaccgccgggggcuccaucaacgucaucgaggugaacaccgaccugagccucuccacgaagaccuacgugugcagccgggacugcaccaucaccgucgacaaggaggacgcccagaucaucuuccagacggagaagcugaaccacuucgagguguccgggaccacccugagcuccggcugguucaagaccaaggcgagcgugacgcucgaccggaccugcgagcacaucaaggugaccugcggcaagaagacccugcaguuccacgccugcuucaagcaccacauguccugcauccgcuucuuccacgggacgauccugccgggcaccauggccaccagcaucugccagaacaucgagcucaucaucaucaucucccugacccugcucaucuucauccugauggccauccugacgaagaccuacaucugcuaccuccugaugccccuguucaugcccaucgcguaccucuacggguggagcuacaaccgcuccugcaagaagugcagcugcugcggccuggccuaccaccccuucaccaacugcgggagccacugcgucugcggccugaaguucgaggccuccgaccggaugcgcauccaccgggagagcggccucugccagggguacaagucccugcgcguggcccggcugcucugcaagagcaagggcuccagccugaucaucuccauccugcucagcaugcugauccuguccuucgucaccccgaucgaggggacgcucaccaacuaccccgagagccgcaaguacgaccuggaggagaucgccgacgugcuggagggcuucgugaccgagaagggcaucaaggaguacgucguguucuacaccuccaucuucgggggccucuuccugcugcucgcgcugaucaucaucaucgcccugaaccgggugacggaguaccucaccaacaucaacgucuucuacugccacgagugcagcauguaccacuccaagaagaacaucaaguacaucggggacuucaccaacaagugcggcuucugcacgugcggggagcuggaggaccaggagggccugaagauccacaaggugagccgcaagugcaucuacaaguaccagcucaccugguccaagaucaucaugaucauccuggugugccugcugaucgcccagaacaccauccucaucgucgccgccagcaacgacugcugggcgaagaagucccuggagauggagugcaucggcccccugcagcagauggagagcugcgacgacaaggccucccggagcuacagcggggaggccaagaagcucgugcgcgccuccaagaucagcgaccuggacgccgcgcaggucggccugcucggguccaccaucgagagcgccaucgccuccauccggaagcagcgcaccuaccccacgaugcaccuccuggagagcguguuccucgccaagcacugcgacuacuacaaguccuucgagcacaacagcggcuacucccaggccaaguggcggcugaccgcgaagacccaccacuucgacaucugcagccgccacuccacccaccacuucugccggugcaucagcgacgggaccaagugccagaacggcgacugggacuucgccggcgagaugaacuccacguaccagagcaagaaggacuucuucgagcacgacuucaagcuguucugcacccuccuggagaacgccuucccggggaccaccgaguccuucuacuaccagaugcugcagaagaagaacacgaccggcguggucaagcuccuggacgagcugaccaagaaguucgggaacaacaacauguucgugggcaucuggaaguucgggcaguaccucaugagccugcccuacaucaacgagaccucccugacgccccuccagcugagcaagauccuggaggccagcgaccagcaccaccgcuccaucagcggccgccaggagucccucgcgaacgccgccagcggcgggaaguccaaggagugcgaccacgccaagaaggugagcugcaucagcccccgguucggcgucccgauggaggggcugaucgccugcggcggcucccccaacuacaagaucuacaagaugcccaccaagcuguacaaguccaacaacaagggggagguguggugcagcggcgacgugcacugcuuccaggagcucaaccccgcgcugcaggaguccgucgaccgcaucaagcagaugaccugcuuccugaccgagccggagacgaacgaggacguguucagcaucgccaucuccaugugcaaggugcaggacaagggggucugcaccaucaacgaggagcgguggaacgugaucaagugcgacagcggccucaucuacuacaccgaccagcgcgacgggcaggacaccggcaacgacuucggcgaguacugccugucccacaacugccggaucgagcgcuuccccaucaaccccacgaucaucaacgacugccugugggaguaccacagccggaaguccaaguacaucaccagccucgaccuggagucccuggaggaguucaagcgcgccaucagcgagaagcucagccacacccugaucguguacaacuucaagcccaccgccaaccugccgcacaucaagcccgucuacaaguacaucacggugcaggggguggagaacuccgacggcgucgacagcgccuacaucaccgcguccaugcccgcccucagcgggaccuccaucggcuacaacaucaugagcaaggacaacuucccccuguucgacaucaucaucuucaucaaguccgccgugaucaaggccaccuacaaccacaucuacgacacggggccgaccaucggcaucaacgugaugcacgacgagcacugcaccggccagugccccaccgacaucccccacaaggagaacuggaucacguucagccaggagcggaccucccgcugggggugcgaggaguucggcugccuggccgucaacaccgggugcguguucggcagcugccaggacaucauccggccggagaccaagguguaccgcaaggcgaucgaggaguccguccuccugacggugugcaucaccuaccccgggaagaccuucugcaccgagaucaacgccaucgagcccaagaucacggacgagcuggagcuccaguucaagaccguggacaccaagacccugcccaacauccuggccguccagaaccacaagcucuacagcggccagaucaacgaccugggcuccuucagccaggggugcggcaacauccagaagaccaacuccagcaucaucgggacgggcaccgccaaguucgacuacgugugccacggggcgucccggaaggacaucaucgugcgccggugcuacaacaacaacuacgagagcugccgccugcucaaggaggagcagucccugauguucgccgacaaccacgagaccaucgacgucgccaacgugcggcaccuccugggcgaccugcaguucaagcugaugcucggcgaccugcgcuacaagagcuucgccgaggacccggaccuggagaucgaggccaagugcguggggugccccagcugcuucaccuccuacagcugcaacuuccggaucgucuccaacaucgacacggugugcagcaucgagggccccugcaccaccuuccacaaccgccucaugaucaccuccacgaagcaggacuacgggaucaagaugagcugcaagggcaagcccggcuccaccgaggaguuccagaucugcaagaagaccuacaccgugcuguucacgaccgucgagaagaacgacaagaucgagaucaacaccggggaccagaccagcuucauccaggagcgcgacgaccggugcaagacguggcugugccgcgugcgggacgagggcaucuccguggucuucgagccgauccgcgcguucuucgggagcuacuucuccaucgccuucuacaucguggugggcaucaucguccucuuccuggugaucuacaucuuccugcccauggccuucaagcuccgggacgugcugaagcgcaacgaguaccuguaccuccaggagaucaagcacaaguga

SEQ ID NO: 12527 - RNA, 4305 nt, Artificial Sequence
  derived and/or modified CDS sequence (opt1) from BATV(Italy-2009)__KC168047.1__GP
augcugcuguuccugauccugcucauccccugcuacgccagcgccuccccgguggucacccgcugcuuccacggcgggcagcugaucgcggagagccggucccccaccgccgugagcgaguucugccugaaggacgacguguccacgaucaagagcgagaucaucuacgucaagaacgacaccggccucuucgcccacaacaaggugcugcgcaacuggaucaucaaggacuggaagaacugcaaccccgugcccaccgccgggggcuccaucaacgucaucgaggugaacaccgaccugagccucuccacgaagaccuacgugugcagccgggacugcaccaucaccgucgacaaggaggacgcccagaucaucuuccagacggagaagcugaaccacuucgagguguccgggaccacccugagcuccggcugguucaagaccaaggcgagcgugacgcucgaccggaccugcgagcacaucaaggugaccugcggcaagaagacccugcaguuccacgccugcuucaagcaccacauguccugcauccgcuucuuccacagcacgauccugccggggaccauggccaccuccaucugccagaacaucgagcucaucaucaucaucagccugacccugcucaucuucauccugauggccauccugacgaagaccuacaucugcuaccuccugaugccccuguucaugcccaucgcguaccucuacggcugguccuacaaccgcagcugcaagaagugcagcugcugcgggcuggccuaccaccccuucaccaacugcggcucccacugcgugugcgggcugaaguucgaggccagcgaccggaugcgcauccaccgggaguccggccucugccagggcuacaagagccugcgcguggcccggcugcucugcaaguccaaggggagcucccugaucaucagcauccugcucuccaugcugauccugagcuucgucaccccgaucgagggcacgcucaccaacuaccccgagucccgcaaguacgaccuggaggagaucgccgacgugcuggagggguucaucaccgagaagggcaucaaggaguacguggucuucuacaccagcaucuucggcgggcuguuccugcugcucgcgcugaucaucaucaucgcccugaaccgggugacggaguaccucaccaacaucaacguguucuacugccacgagugcuccauguaccacagcaagaagaacaucaaguacaucggcgacuucaccaacaagugcggguucugcacgugcggcgagcuggaggaccaggaggggcugaagauccacaaggucucccgcaagugcaucuacaaguaccagcucaccuggagcaagaucaucaugaucauccuggugugccugcugaucgcccagaacaccauccucaucguggccgccuccaacgacugcugggcgaagaagucccuggagauggagugcaucggcccccugcagcgggucgagagcugcgacgacaaggccagccgcagcuacuccggcgaggccaagaagcucgugcgggccagcaagaucuccgaccuggacgccgcgcaggucgggcugcucggcagcaccaucgaguccgccaucgccagcauccgcaagcagcggaccuaccccacgaugcaccuccuggaguccguguuccucgccaagcacugcgacuacuacaagagcuucgagcacaacuccggguacagccaggccaaguggcgccugaccgcgaagacccaccacuucgacaucugcucccggcacagcacccaccacuucugccgcugcaucuccgacggcaccaagugccagaacggggacugggacuucgccggcgagaugaacagcacguaccaguccaagaaggacuucuucgagcacgacuucaagcuguucugcacccuccuggagaacgccuucccgggcaccaccgagagcuucuacuaccagaugcugcagaagaagaacacgaccgggguggucaagcuccuggacgagcugaccaagaaguucggcaacaacaacauguucguggggaucuggaaguucggccaguaccucaugucccugcccuacaucaacgagaccagccugacgccccuccagcugagcaagauccuggaggccuccaaccagcaccaccgcagcaucuccgggcggcaggagagccucgcgaacgccgccuccggcggcaagagcaaggagugcgacaacgccaagaagguguccugcaucagcccccgcuucggggucccgauggagggccugaucgccugcggguccagccccaacuacaagaucuacaagaugcccaccaagcuguacaaguccaacaacaagggcgagguguggugcagcggcgacgugcacugcuuccaggagcucaaccccgcgucccaggagagcgucgaccggaucaagcagaugaccugcuuccugaccgagccggagacgaacgaggacguguucuccaucgccaucagcaugugcaaggugcgcgacaagggggucugcaccaucaacgaggagcgguggaacgugaucaagugcgacuccggccugaucuacuacaccgaccagcgcgacgggcaggacaccggcaacgacuucggggaguacugccucagccacaacugccggaucgagcgcuuccccaucaaccccgccaucaucaacgacugccugugggaguaccacucccggcgcagcaaguacaucacgagccuggaccucgagucccuggaggaguucaagcgggccaucagcgagaagcugucccacacccucaucguguacaacuucaagcccaccgccaaccugccgcacaucaagcccgucuacaaguacaucaccgugcagggcguggagaacagcgacggcgucgacuccgcguacaucacggccagcaugcccgcccuguccgggaccagcaucggcuacaacaucauguccaaggacaacuucccccucuucgacaucaucaucuucaucaagagcgccgugaucaaggccaccuacaaccacaucuacgacaccgggccgacgaucggcaucaacgugaugcacgacgagcacugcaccgggcagugccccaccgacaucccccacaaggagaacuggaucaccuucucccaggagcgcacgagccgguggggcugcgaggaguucggcugccuggcggucaacaccgggugcguguucggcuccugccaggacaucauccgcccggagaccaagguguaccggaaggccaucgaggagaacguccugcucaccgugugcaucacguaccccgggaagaccuucugcaccgagaucaacgccaucgagcccaagaucaccgacgagcuggagcugcaguucaagacgguggacaccaagacccuccccaacauccuggccguccagaaccacaagcuguacagcggccagaucaacgaccucggguccuucagccagggcugcggcaacauccagaagaccaacuccagcaucaucgggaccggcacggcgaaguucgacuacgugugccacggggccucccgcaaggacaucaucgugcggcgcugcuacaacaacaacuacgagagcugccggcugcugaaggaggagcagagccucauguucgccgacaaccacgagaccaucgacgucgccaacgugcgccaccuccugggcgaccuccaguucaagcugaugcugggggaccuccgcuacaaguccuucgccgaggacccggaccuggagaucgaggcgaagugcgugggcugccccagcugcuucaccuccuacagcugcaacuuccggaucgucuccaacaucgacaccgugugcagcaucgagggccccugcacgaccuuccacaaccgccugaugaucaccuccaccaagcaggacuacgggaucaagaugagcugcaagggcaagcccggguccacggaggaguuccagaucugcaagaagaccuacaccguccucuucaccacggucgagaagaacgacaagaucgagaucaacaccggcgaccagaccagcuucauccaggagcgggacgaccgcugcaagaccuggcugugccgggugcgcgacgagggcaucuccgugaucuucgagccgauccgggccuucuucgggagcuacuucuccaucgccuucuacaucgucgugggcaucaucgugcuguuccucaugaucuacaucuuccugcccauggccuucaagcugcgcgacguccucaagcggaacgaguaccuguaccugcaggagaucaagcacaaguga

SEQ ID NO: 12528 - RNA, 4305 nt, Artificial Sequence
  derived and/or modified CDS sequence (opt1) from BATV(MM2222)__AB257763.1__GP
augcugcuccugcuggugcuccugaucagcugcugcgucuccgccagccccgugaucacccgcugcuuccacggcgggcagcugaucgccgagcggaagucccagaccgcgaucagcgaguucugccucaaggacgacguguccacgaucaagagcgagaucaucuacgagaagaacgacaccggccuguucgcccacaacaagguccugcgcaacuggaucaucaaggacuggaagaacugcaacccggugcccaccgccgggggcuccaucaacgugaucgaggucaacaccgaccucagccugacgaccaagaccuacgugugcucccgggacugcaccaucacgguggacaaggaggacgcccagaucgucuuccagaccgagaagcugaaccacuucgaggugagcgggaccacccucuccagcggcugguucaagacgaaggccuccgugacccuggaccggaccugcgagcacaucaaggugaccugcggcaagaagacgcugcaguuccacgcgugcuucaagcaccacaugagcugcauccgcuucuuccacgggaccauccuccccggcaccauggccaccuccaucugccagaacaucgagcugaucaucaucaucagccugacgcucaucaucuucauccugauggugauccugaccaagaccuacaucugcuaccuccugaugccccuguucaugccgaucgccuacuucuacgggugguccuacaacaagagcugcaagaagugccccugcugcggccucgccuaccaccccuucaccaacugcgggucccacugcgugugcggccugaaguucgaggcgagcgaccgcaugcggauccaccgcgagagcggccugugccagggguacaagucccuccgggucgcccgccugcugugcaagagcaagggcuccagccucaucaucuccauccugcugagcaugcucauccuguccuucgugacgcccaucgaggggacccugaccaacuacccggagagccggaaguacaaccucgaggagaucgccgacgugcuggagggcuucgucguggagaagggcaucaaggaguacguggucuucuacaccuccaucuucggggcccuguuccuccugauggcccugaucgugaucaucgcgcucaaccgcgugacggaguaccugaccaacaucaacguccuguacugccacgagugcagcauguaccacuccaagaagaacaucaaguacaucggcgacuucaccaacaagugcggguucugcacgugcggcgagcucgaggaccaggaggggcugaagauccacaaggugagccggaagugcaucuacaaguaccagcugaccugguccaagaucaucaugaugauccucgucugccugcugaucgcccagaacaccauccugaucguggccgccagcgacgacugcuggaccaagaagucccucgagauggagugcaucggcccccugcagcaggucgacacgugcgaggacaagaccagccgcuccuacagcggcgaggccaagaagcugguccgggcguccaagaucagcgaccucgacgccgcccagguggggcugcugggcagcaccaucgaguccgccaucgccagcauccgccggcagcgcaccuacuccaccaugcaccuccuggagagcguguuccuggggaagcacugcgacuacuacaaggucuucgagcacaacuccggcuacagccaggcgaaguggcggcucaccgccaagacgcaccacuucgacaucugcucccgccacagcacccaccacuucugccggugcaucuccgacgggaccaagugccagaacggcgacugggacuucgccggcgagaugaacagcaucuaccaguccaagcgcgacuucuucaagcacgacuucaagcuguucugcacccugaucgaggacgccuuccccgggacgaccgagagccucuucuacgagaugcuguccaagaagaacaccaccggcaucacgaagcugcucgacaagcugaccaagaaguucgggaacaacaacauguucgugggcaucuggaaguucgggcaguaccugaugagccuccccuacgugaacgagaccucccugagcccgacccagcuggccaagguccucgaggugacggaccaccaccaccgcuccaucagcggccggcaggagagccuggcguccgccaccagcggcuccaagagcuccgagugcgaccacgccaagaaggugagcugcaucagcccccgcuucgggguccccauggagggccugaucgccugcgggaacucccccaacuacaagaucuacaagaccccggcgaagcucuacaaguccaacaacaagggcgagguguggugcagcggcgacgugcacugcuuccaggagcugauccccgccucccaggagagcgucgaccggaucaagcagaugaccugcuuccugacggagcccgaggugaacgacgacguguucuccaucgccaucagcaugugcaagguccaggacaagggggugugcaccaucaacgaggaccgcuggaacgugaucaagugcgacuccggccucaucuacuacaccgaccagcgggaggggcaggacaccggcaacgacuucggggaguacugccugagccacuccugccgcaucgagcgguuccccaucaacccgacgaucaucagcgacugccugugggaguaccacucccgcaagagcaaguacaucaccagccucgaccuggagucccuggaggaguucaagcgggccaucagcgagaagcucucccacacccugaucgucuacaacuucaagcccaccgccaaccugccccacaucaagcccguguacaaguacaucacggugcagggcgucgagaacagcgacggcguggacuccgcguacaucaccgccagcaugccggcccucuccgggaccagcaucggcuacaacaucaugucccgcgacaacuucccccuguucgacaucaucaucuucaucaagagcgccaucaucaaggccaccuacaaccacaucuacgacacggggcccaccaucggcaucaacgugaugcacgacgagcacugcaccgggcagugccccaccgacaucccgcacaaggagaacuggaucacguucgcgcaggagcggaccucccgcuggggcugcgaggaguucggcugccuggccgucaacaccgggugcguguucggcagcugccaggacaucauccggcccgagaccaagguguaccgcaaggccgucgaggaguccgugcuccugacggugugcaucaccuaccccgggaagaccuucugcaccgagaucaacgccaucgagccgaagaucaccgacgagcuggagcuccaguucaagacggucgacaccaagacccugcccaacauccuggccgugcagaaccacaagcucuacagcggccagaucaacgaccugggguccuucagccagggcugcggcaacauccagaagaccaacuccagcaucaucgggacgggcaccgcgaaguucgacuacgugugccacggggccucccggaaggacaucaucguccgccggugcuacaacaacaacuacgagagcugcaagcugcucaaggaggagcagagccugauguucgccgacaaccacgagaccaucgacguggccaacgugcgccaccuccucggcgaccugcaguucaagcugaugcucggggaccugcgguacaaguccuucgcggagaaccccgaccuggagaucgaggccaagugcgucggcugccccagcugcuucaccuccuacagcugcuccuucaagaucgugagcaacaucgacacggugugcuccaucgagggcccgugcaccaccuuccacaaccgccucaugaucaccagcacgaagcaggacuacgggaucaagauguccugcaagaccaagcccggccccaucgaggaguuccagaucugcaagaagaccuacaccauccuguucacgaccgucgagaagaacgacaagaucgagaucagcaccggggaccagaccuccuucauccaggagaaggacgaccgcugcaagacguggcugugccgggugcgcgacgagggcaucagcgugaucuucgagcccauccgggccuucuucggcuccuacuucagcaucgccuucuacaucgucaucgggaucaucgugcuguuccuggugaucuacaucuuccugccgaugauguucaagcuccgcgacguccugaagcggaacgaguaccuguaccuccaggagaucaagcacaaguga

SEQ ID NO: 12529 - RNA, 4305 nt, Artificial Sequence
  derived and/or modified CDS sequence (opt1) from BATV(MM2222)__AY772534.1__GP
augcugcuccugcuggugcuccugaucagcugcugcgucuccgccagccccgugaucacccgcugcuuccacggcgggcagcugaucgccgagcggaagucccagaccgcgaucagcgaguucugccucaaggacgacguguccacgaucaagagcgagaucaucuacgagaagaacgacaccggccuguucgcccacaacaagguccugcgcaacuggaucaucaaggacuggaagaacugcaacccggugcccaccgccgggggcuccaucaacgugaucgaggucaacaccgaccucagccugacgaccaagaccuacgugugcucccgggacugcaccaucacgguggacaaggaggacgcccagaucgucuuccagaccgagaagcugaaccacuucgaggugagcgggaccacccucuccagcggcugguucaagacgaaggccuccgugacccuggaccggaccugcgagcacaucaaggugaccugcggcaagaagacgcugcaguuccacgcgugcuucaagcaccacaugagcugcauccgcuucuuccacgggaccauccuccccggcaccauggccaccuccaucugccagaacaucgagcugaucaucaucaucagccugacgcucaucaucuucauccugauggugauccugaccaagaccuacaucugcuaccuccugaugccccuguucaugccgaucgccuacuucuacgggugguccuacaacaagagcugcaagaagugccccugcugcggccucgccuaccaccccuucaccaacugcgggucccacugcgugugcggccugaaguucgaggcgagcgaccgcaugcggauccaccgcgagagcggccugugccagggguacaagucccuccgggucgcccgccugcugugcaagagcaagggcuccagccucaucaucuccauccugcugagcaugcucauccuguccuucgugacgcccaucgaggggacccugaccaacuacccggagagccggaaguacaaccucgaggagaucgccgacgugcuggagggcuucgucguggagaagggcaucaaggaguacguggucuucuacaccuccaucuucggggcccuguuccuccugauggcccugaucgugaucaucgcgcucaaccgcgugacggaguaccugaccaacaucaacguccuguacugccacgagugcagcauguaccacuccaagaagaacaucaaguacaucggcgacuucaccaacaagugcggguucugcacgugcggcgagcucgaggaccaggaggggcugaagauccacaaggugagccggaagugcaucuacaaguaccagcugaccugguccaagaucaucaugaugauccucgucugccugcugaucgcccagaacaccauccugaucguggccgccagcgacgacugcuggaccaagaagucccucgagauggagugcaucggcccccugcagcaggucgacacgugcgaggacaagaccagccgcuccuacagcggcgaggccaagaagcugguccgggcguccaagaucagcgaccucgacgccgcccagguggggcugcugggcagcaccaucgaguccgccaucgccagcauccgccggcagcgcaccuacuccaccaugcaccuccuggagagcguguuccuggggaagcacugcgacuacuacaaggucuucgagcacaacuccggcuacagccaggcgaaguggcggcucaccgccaagacgcaccacuucgacaucugcucccgccacagcacccaccacuucugccggugcaucuccgacgggaccaagugccagaacggcgacugggacuucgccggcgagaugaacagcaucuaccaguccaagcgcgacuucuucaagcacgacuucaagcuguucugcacccugaucgaggacgccuuccccgggacgaccgagagccucuucuacgagaugcuguccaagaagaacaccaccggcaucacgaagcugcucgacaagcugaccaagaaguucgggaacaacaacauguucgugggcaucuggaaguucgggcaguaccugaugagccuccccuacgugaacgagaccucccugagcccgacccagcuggccaagguccucgaggugacggaccaccaccaccgcuccaucagcggccggcaggagagccuggcguccgccaccagcggcuccaagagcuccgagugcgaccacgccaagaaggugagcugcaucagcccccgcuucgggguccccauggagggccugaucgccugcgggaacucccccaacuacaagaucuacaagaccccggcgaagcucuacaaguccaacaacaagggcgagguguggugcagcggcgacgugcacugcuuccaggagcugauccccgccucccaggagagcgucgaccggaucaagcagaugaccugcuuccugacggagcccgaggugaacgacgacguguucuccaucgccaucagcaugugcaagguccaggacaagggggugugcaccaucuccgaggaccgcuggaacgugaucaagugcgacagcggccucaucuacuacaccgaccagcgggaggggcaggacaccggcaacgacuucggggaguacugccugucccacagcugccgcaucgagcgguuccccaucaacccgacgaucaucuccgacugccugugggaguaccacagccgcaagagcaaguacaucaccucccucgaccuggagagccuggaggaguucaagcgggccaucuccgagaagcucagccacacccugaucgucuacaacuucaagcccaccgccaaccugccccacaucaagcccguguacaaguacaucacggugcagggcgucgagaacuccgacggcguggacagcgcguacaucaccgccuccaugccggcccucagcgggaccuccaucggcuacaacaucaugagccgcgacaacuucccccuguucgacaucaucaucuucaucaaguccgccaucaucaaggccaccuacaaccacaucuacgacacggggcccaccaucggcaucaacgugaugcacgacgagcacugcaccgggcagugccccaccgacaucccgcacaaggagaacuggaucacguucgcgcaggagcggaccagccgcuggggcugcgaggaguucggcugccuggccgucaacaccgggugcguguucggcuccugccaggacaucauccggcccgagaccaagguguaccgcaaggccgucgaggagagcgugcuccugacggugugcaucaccuaccccgggaagaccuucugcaccgagaucaacgccaucgagccgaagaucaccgacgagcuggagcuccaguucaagacggucgacaccaagacccugcccaacauccuggccgugcagaaccacaagcucuacuccggccagaucaacgaccuggggagcuucucccagggcugcggcaacauccagaagaccaacagcuccaucaucgggacgggcaccgcgaaguucgacuacgugugccacggggccagccggaaggacaucaucguccgccggugcuacaacaacaacuacgagagcugcaagcugcucaaggaggagcagucccugauguucgccgacaaccacgagaccaucgacguggccaacgugcgccaccuccucggcgaccugcaguucaagcugaugcucggggaccugcgguacaagagcuucgcggagaaccccgaccuggagaucgaggccaagugcgucggcugccccuccugcuucaccagcuacuccugcagcuucaagaucguguccaacaucgacacggugugcagcaucgagggcccgugcaccaccuuccacaaccgccucaugaucaccuccacgaagcaggacuacgggaucaagaugagcugcaagaccaagcccggccccaucgaggaguuccagaucugcaagaagaccuacaccauccuguucacgaccgucgagaagaacgacaagaucgagaucuccaccggggaccagaccagcuucauccaggagaaggacgaccgcugcaagacguggcugugccgggugcgcgacgagggcaucuccgugaucuucgagcccauccgggccuucuucggcagcuacuucuccaucgccuucuacaucgucaucgggaucaucgugcuguuccuggugaucuacaucuuccugccgaugauguucaagcuccgcgacguccugaagcggaacgaguaccuguaccuccaggagaucaagcacaaguga

SEQ ID NO: 12530 - RNA, 4305 nt, Artificial Sequence
  derived and/or modified CDS sequence (opt1) from BATV(MM2222)__JX846596.1__GP
augcugcuccugcuggugcuccugaucagcugcugcgucuccgccagccccgugaucacccgcugcuuccacggcgggcagcugaucgccgagcggaagucccagaccgcgaucagcgaguucugccucaaggacgacguguccacgaucaagagcgagaucaucuacgagaagaacgacaccggccuguucgcccacaacaagguccugcgcaacuggaucaucaaggacuggaagaacugcaacccggugcccaccgccgggggcuccaucaacgugaucgaggucaacaccgaccucagccugacgaccaagaccuacgugugcucccgggacugcaccaucacgguggacaaggaggacgcccagaucgucuuccagaccgagaagcugaaccacuucgaggugagcgggaccacccucuccagcggcugguucaagacgaaggccuccgugacccuggaccggaccugcgagcacaucaaggugaccugcggcaagaagacgcugcaguuccacgcgugcuucaagcaccacaugagcugcauccgcuucuuccacgggaccauccuccccggcaccauggccaccuccaucugccagaacaucgagcugaucaucaucaucagccugacgcucaucaucuucauccugauggugauccugaccaagaccuacaucugcuaccuccugaugccccuguucaugccgaucgccuacuucuacgggugguccuacaacaagagcugcaagaagugccccugcugcggccucgccuaccaccccuucaccaacugcgggucccacugcgugugcggccugaaguucgaggcgagcgaccgcaugcggauccaccgcgagagcggccugugccagggguacaagucccuccgggucgcccgccugcugugcaagagcaagggcuccagccucaucaucuccauccugcugagcaugcucauccuguccuucgugacgcccaucgaggggacccugaccaacuacccggagagccggaaguacaaccucgaggagaucgccgacgugcuggagggcuucgucguggagaagggcaucaaggaguacguggucuucuacaccuccaucuucggggcccuguuccuccugauggcccugaucgugaucaucgcgcucaaccgcgugacggaguaccugaccaacaucaacguccuguacugccacgagugcagcauguaccacuccaagaagaacaucaaguacaucggcgacuucaccaacaagugcggguucugcacgugcggcgagcucgaggaccaggaggggcugaagauccacaaggugagccggaagugcaucuacaaguaccagcugaccugguccaagaucaucaugaugauccucgucugccugcugaucgcccagaacaccauccugaucguggccgccagcgacgacugcuggaccaagaagucccucgagauggagugcaucggcccccugcagcaggucgacacgugcgaggacaagaccagccgcuccuacagcggcgaggccaagaagcugguccgggcguccaagaucagcgaccucgacgccgcccagguggggcugcugggcagcaccaucgaguccgccaucgccagcauccgccggcagcgcaccuacuccaccaugcaccuccuggagagcguguuccuggggaagcacugcgacuacuacaaggucuucgagcacaacuccggcuacagccaggcgaaguggcggcucaccgccaagacgcaccacuucgacaucugcucccgccacagcacccaccacuucugccggugcaucuccgacgggaccaagugccagaacggcgacugggacuucgccggcgagaugaacagcaucuaccaguccaagcgcgacuucuucaagcacgacuucaagcuguucugcacccugaucgaggacgccuuccccgggacgaccgagagccucuucuacgagaugcuguccaagaagaacaccaccggcaucacggagcugcucgacaagcugaccaagaaguucgggaacaacaacauguucgugggcaucuggaaguucgggcaguaccugaugagccuccccuacgugaacgagaccucccugagcccgacccagcuggccaagguccucgaggugacggaccaccaccaccgcuccaucagcggccggcaggagagccuggcguccgccaccagcggcuccaagagcuccgagugcgaccacgccaagaaggugagcugcaucagcccccgcuucgggguccccauggagggccugaucgccugcgggaacucccccaacuacaagaucuacaagaccccggcgaagcucuacaaguccaacaacaagggcgagguguggugcagcggcgacgugcacugcuuccaggagcugauccccgccucccaggagagcgucgaccggaucaagcagaugaccugcuuccugacggagcccgaggugaacgacgacguguucuccaucgccaucagcaugugcaagguccaggacaagggggugugcaccaucaacgaggaccgcuggaacgugaucaagugcgacuccggccucaucuacuacaccgaccagcgggaggggcaggacaccggcaacgacuucggggaguacugccugagccacuccugccgcaucgagcgguuccccaucaacccgacgaucaucagcgacugccugugggaguaccacucccgcaagagcaaguacaucaccagccucgaccuggagucccuggaggaguucaagcgggccaucagcgagaagcucucccacacccugaucgucuacaacuucaagcccaccgccaaccugccccacaucaagcccguguacaaguacaucacggugcagggcgucgagaacagcgacggcguggacuccgcguacaucaccgccagcaugccggcccucuccgggaccagcaucggcuacaacaucaugucccgcgacaacuucccccuguucgacaucaucaucuucaucaagagcgccaucaucaaggccaccuacaaccacaucuacgacacggggcccaccaucggcaucaacgugaugcacgacgagcacugcaccgggcagugccccaccgacaucccgcacaaggagaacuggaucacguucgcgcaggagcggaccucccgcuggggcugcgaggaguucggcugccuggccgucaacaccgggugcguguucggcagcugccaggacaucauccggcccgagaccaagguguaccgcaaggccgucgaggaguccgugcuccugacggugugcaucaccuaccccgggaagaccuucugcaccgagaucaacgccaucgagccgaagaucaccgacgagcuggagcuccaguucaagacggucgacaccaagacccugcccaacauccuggccgugcagaaccacaagcucuacagcggccagaucaacgaccugggguccuucagccagggcugcggcaacauccagaagaccaacuccagcaucaucgggacgggcaccgcgaaguucgacuacgugugccacggggccucccggaaggacaucaucguccgccggugcuacaacaacaacuacgagagcugcaagcugcucaaggaggagcagagccugauguucgccgacaaccacgagaccaucgacguggccaacgugcgccaccuccucggcgaccugcaguucaagcugaugcucggggaccugcgguacaaguccuucgcggagaaccccgaccuggagaucgaggccaagugcgucggcugccccagcugcuucaccuccuacagcugcuccuucaagaucgugagcaacaucgacacggugugcuccaucgagggcccgugcaccaccuuccacaaccgccucaugaucaccagcacgaagcaggacuacgggaucaagauguccugcaagaccaagcccggccccaucgaggaguuccagaucugcaagaagaccuacaccauccuguucacgaccgucgagaagaacgacaagaucgagaucagcaccggggaccagaccuccuucauccaggagaaggacgaccgcugcaagacguggcugugccgggugcgcgacgagggcaucagcgugaucuucgagcccauccgggccuucuucggcuccuacuucagcaucgccuucuacaucgucaucgggaucaucgugcuguuccuggugaucuacaucuuccugccgaugauguucaagcuccgcgacguccugaagcggaacgaguaccuguaccuccaggagaucaagcacaaguga

SEQ ID NO: 12531 - RNA, 4305 nt, Artificial Sequence
  derived and/or modified CDS sequence (opt1) from BATV(MS50)__JX846605.1__GP
augaagaugcugacccucaucaucaucgugagcugcugggucgccacccugcagaacccccugaucucccgcugcuuccacggcgggcagcucaucgccgagaagaagucccugacgagcaucagcgaguucugcaucaaggacgacguguccaugcucaagagcgaggugaucuaccagaagaacgacaccggcaucuacgggcacuccaaggucuuccggcacuggaccaucgcggacuggaaguacugcaacccggugcccaccgccggcgggagcaucaacgugaucgagcucgacaagaaccugaaccugaucgccaagaacuacgucugcacgcgcgacugcaccaucaccguggacaaggagaacgcccagaucguguuccagaccgacaagcucaaccacuucgaggucacgggcaccaccaucuccaccggcugguucaagacgaaggccagcguggcgcuggaccggaccugcgagcacaucaagguguccugcgggaagaagacccugcaguuccacgccugcuucaagcagcacaugagcugcguccgcuuccuccaccgguccaugcugcccggcagcauggccaacuccaucugccagaacaucgagcugaucaucaucaucacccucacgcuggugaucuucauccugaugcucaucgccacccgcuucuacaucugcuaccugcugauccccguguucaugccgaucgcguacgccuacgggugggccuacaaccggagcugcaagaagugcuccugcugcggccucgccuaccaccccuucaccaacugcgggagcuacugcgucugcggcgcccgcuucgagaccuccgaccggaugcgccugcaccgggagagcggccugugccagggguucaagagccuccgcauggcgcggcgccugugcaaguccaagggcagcucccuggugaucagcauccuccuggccacgcugauccucuccuucgugacccccaucgaggggaccaugaccaacuaccccacgaacgagaaguacagccuggacgagaucgccgacguccugaaguggaaggagcaggaguccgaguacaaguacuacgccauccucuacgccagcaucaucggcgcgugcuucaccgugcuguucgccggcaccgcccuggcccucaacaucgugcuggagcugcucaccaagaucaacgucaucuacugcgaggagugcuccauguaccacagcaaguccaacaucaaguacaucggggacuucacgaacaagugcggcuucugcacgugcgggcugcuggaggacccggacggcguggugguccacaaggugaagcggagcugcaccuaccaguacaagcucaccugggucaagaccaucaugaucgugcuguccauccuguuccuccugcagaacaucaucgugaucgucgccgcggacagcgacugcuggaccaacgaggagcugaagcccgagugcguggggccccucaucgcccccgccgacugcaccgagaaggacaagaagaccuaccugacggaggccgccgcgcuggugaagaccaagaagaucucccaggucgacgccgacaacguggagauccugggcaagaccaucgagagcgccaucaaggccaucgagaagcagaagaccuaccaccgcaugcaccuccuggaggcgguguuccugaacaagcacugcgacuacuacaagcuguucgagcacaacuccggcuacagccaggucaaguggcggaugcuggccaagacccagcacuucgacaucugcgccuucgccaaggaguccaaguucugcaagugcauggccgggggcgcgugcgccgaggacagcugggacuucgacacgaccaugaacagcaccuacaccuccaagggggacaacuucaagcacgacaugagccuguuccucaagaucuucgaggccgccuucccgggcacguccuacguguacaugcugaacaagaucaaggagaagaagcccuaccagagcgugaccaugaucgacaagaucaagaccaaguaccccaacaacaagaugcuggucgccuaccucgaguucgggaagugccugaugggcgugggccacgcguccaccuucgagcugcagcagagccagcucgagcgccuguaccagcccgccgagcugucccggagcguggggcagcucacgucccugagcaacgcccaggucggcaccaucaccaaggagugcuccaaguacaaggacaucagcugccuguccccgcgcuucgggauccccauggagaacaugguggccugcggcgacagccccaacuacaagaucuacaagaagcccaucaagguguacaaggcccacgaccgggucgagaccuggugcaucaaggaccagcacugccucguggacuacacgccggcggaggccgacguggucaagaagcugaagaccaugaagugcuggcugaacgaccccgggaccgagaccgacgccuacacgaccgccaucaaguccugccgcaucauggacaagggcgugugcaccgugaacggccagaaguggagcaucaucaagugcgacuccgaccuccuguacuacaccgaccacaucgagggggaggacacgggcaacgacaucgggcacuacugcaucagcgucggcugcaagaccgaccgcuaccccaucaaccccgacaucgugaccgacugcaccugggaguucaagagccggaaguccagcuacaucggcaagaucuccaugcagagccuggaggacuacaagaaggcgcucacggacaagcugacccacacccuggagaccuacuccuucgccccgacggccgaccucccccacaucaagcccaucuacaaguacaucaccgcccaggggguggagaacagcgacggcaucgagggggccuacaucaccgcgaccauccccgcccugggcgggacguccaucggcuacagcguccaguccaaggacggcuucccgcugcucgaccugaucaucuacaucaaggccgccgugauccgcagcaccuacauccaccuguacgacaccgggcccaccaucuccaucaacacgaagcacgacgagaagugcaccggccagugccccgccgagaucgagcacgaggcgaacuggcucaccuucagccaggagcggaccucccgcugggggugcgaggaguucggcugccuggccaucaacaccgggugcguguucggcagcugccaggacgucauccggccggagacgaagguguaccgcaaguccguggaggaggaggucgugcugaccgugugcaucaacuaccccggcaacaccuucugcaccgagaucaacgccaucgagcccaagaucacggaggaggucgagcuccaguucaagaccguggacaccaagacccugcccacgcugcucgccgugaccaaccacaagcuguucagcgggcagaucaacgaccugggcaccuucgggcagaugugcggcaacguccagaagaccaacuccagcauccucggguccggcacgccgaaguucgacuacacgugccacggcgccagccggaaggacaucaucgugcgcaagugcuacaacaacaacuacgacagcugcaagcugcugaaggaggagaagcagcucguguucaacgacgaccacgagaccaucaccgucgugaacaaccggcaccuggugggggagcuggcgaucaagcucauccugggcgacauccaguacaagcuguucaccgagaagcucgaccugcagaucgacgccaagugcgucgggugccccgacugcuucgaguccuacgccugcaacuuccagaucgugagcaacaucgacaccgugugcgccaucaacggccccugcgacaucuuccacaaccgcaucuccauccggagcacccagcagaacuacggggucaagauguccugcaagcgcacccccgaccagaacgagaaguucgugaucugcggccgggaguacagcguguucuuccacacgguccagaagaacgacaagaucgagaucaacaccggcgaccagaccuccuacaucaaggagauggacacccgcugcaagacguggcugugccgggugcgcgacgaggggcucagcgucaucuucgagccgaucaaggcguucuucggcuccuacuucagcaucgccuucuacaucgugcuguucaucaucaucgccuuccuggugaucuacaucuucaugcccauguucaugaagcuccgggacauccugaagcagaacgagaagcuguaccuccaggagaucaagcagaaguga

SEQ ID NO: 12532 - RNA, 4305 nt, Artificial Sequence
  derived and/or modified CDS sequence (opt1) from BATV(NM/12)__KJ187039.1__GP
augcugcuccugcuggugcuccugauccccugcugcgucagcgccuccccggccaucacccgcugcuuccacggcgggcagcugaucgcggagcgcaagagccagaccgccaucuccgaguucugccucaaggacgacgugagcacgaucaaguccgagaucaucuacgagaagaacgacaccggccuguucgcccacaacaaggugcugcggaacuggaucaucaaggacuggaagaacugcaaccccguccccaccgccgggggcagcaucaacgugaucgaggugaacaccgaccucucccugacgaccaagaccuacgucugcagccgggacugcaccaucacgguggacaaggaggacgcccagaucaucuuccgcaccgagaagcugaaccacuucgagguguccgggaccacccucagcuccggcugguucaagacgaaggcgagcgucacccuggaccggaccugcgagcacaucaaggugaccugcggcaagaagacgcugcaguuccacgccugcuucaagcaccacauguccugcauccgcuucuuccacgggaccauccuccccggcaccauggccaccagcaucugccagaacaucgagcugaucaucaucaucucccugacgcucaucaucuucauccugauggugauccugacccggaccuacaucugcuaccuccugaugccgcuguucaugcccaucgccuacuucuacggguggagcuacaacaaguccugcaagaagugccagugcugcggccucgcguaccaccccuucaccaacugcgggagccacugcgucugcggccugaaguucgaggccuccgaccgcaugcggauccaccgcgagagcggccugugccagggguacaagagccuccggguggcccgccugcugugcaaguccaagggcagcucccucaucaucagcauccugcuguccaugcucauccugagcuucgugacgcccaucgaggggacccugaccaacuacccggagucccggaaguacgaccucgaggagaucgccgacguccuggagggcuucgugguggagaagggcaucaaggaguacgucguguucuacaccagcaucuucggggcccuguuccuccugauggcgcugaucaucaucaucgcccucaaccgcgugacggaguaccugaccaacaucaacgucuucuacugccacgagugcuccauguaccacagcaagaagaacaucaaguacaucggcgacuucaccaacaagugcggguucugcacgugcggcgagcuggaggaccaggaggggcucaagauccacaaggugucccggaagugcaucuacaaguaccagcugaccuggagcaagaucaucaugaugauccuggugugccuccugaucgcccagaacaccauccugaucgucgccgccuccgacgacugcuggaccaagcgcagccuggagaugggcugcaucggcccccuccagcaggucgacacgugcgacgacaagaccucccggagcuacuccggggaggcgaagaagcuggugcgcgccagcaagaucuccgaccuggacgccgcccaggugggccuccuggggagcaccaucgagagcgccaucgcguccauccggaagcagcgcaccuacagcaccaugcaccuccuggaguccguguuccugggcaagcacugcgacuacuacaaggucuucgagcacaacagcggguacucccaggccaaguggcggcugaccgccaagacgcaccacuucgacaucugcagccgccacuccacccaccacuucugccgcugcaucagcgacggcaccaagugccagaacggcgacugggacuucgccuccgagaugaacagcaccuaccaguccaagcgggacuucuucgagcacgacuucaagcaguucugcacgcucaucgagaacgccuuccccgggaccaccgagagccuguucuacgagaugcuguccaagaagaacaccacgggcaucaccaagcuccuggacaagcugaccaagaaguucgggaacaacaacauguucgugggcaucuggaaguucgggcaguaccucaugagccugcccuacgugaacgagaccucccugagcccgacgcagcucgcgaagguccuggaggugaccgaccaccaccaccgcuccaucagcggccggcaggagagccuggccuccgccgcccccggcagcaaguccagcgagugcgaccacgcgcgccggguguccugcaucagcccccgcuucgggguccccaucgagggccucaccgccugcggguccagcccgaacuacaagaucuacaagacccccgccaagcuguacaaguccaacaacaagggcgagguguggugcagcggcgacgugcacugccugcaggagcucauccccgcgccccaggaguccgucgaccggaucaagcagaugacgugcuuccugaccgagccgggggugaacgacgacaucuucagcaucgccaucuccaugugcaaggugcaggacaagggcgucugcaccaucaacgaggaccgcuggaacguggugaagugcgaccgggggcugaucuacuacaccgaccagcgcgagggccaggacacggggaacgacuucggcaaguacugccucagccacuccugccggaucgagcgcuuccccaucaaccccgccaucaucaacgacugccugugggaguaccacagccggaaguccaaguacaucaccagccuggaccucgagucccuggaggaguucaagcgcgccaucagcgagaagcugagccacacccucaucguccacaacuucaagcccaccgccaaccugccgcacaucaagcccguguacaaguacaucacggugcagggcgucgagaacuccgacgggguggacagcgccuacaucaccgccuccaugcccgcgcugagcggcaccuccaucggguacaacaucaugagccgggacaacuucccccucuucgacaucaucaucuucaucaaguccgccaucaucaaggccaccuacaaccacaucuacgacacgggcccgaccaucgggaucaacgugauccacgacgagcacugcaccggccagugccccaccgacaucccccacaaggagaacuggaucacguucgcccaggagcgcaccagccgguggggcugcgaggaguucgggugccuggccaucaacaccggcugcgucuucggguccugccaggacaucauccgcccggagaccaagguguaccggaaggcgguggaggagagcguccugcucacggugugcaucaccuaccccggcaagaccuucugcaccgagaucaacgccaucgagcccaagaucaccgacgagcuggagcugcaguucaagacgguggacaccaagacccuccccaacauccuggccguccagaaccacaagcuguacuccgggcagaucaacgaccucggcagcuucucccagggcugcgggaacauccagaagaccaacagcuccaucaucggcacggggaccgccaaguucgacuacgugugccacggcgcgagccgcaaggacaucaucgugcgccggugcuacaacaacaacuacgaguccugcaagcugcugaaggaggagcagagccucauguucgccgacaaccacgagaccaucgacgucgccaacgugcgccaccuccugggggaccugcaguucaagcugaugcugggcgaccuccgguacaaguccuucgccgagaacccggaccuggagaucgaggccaagugcgugggcugccccagcugcuucaccagcuacuccugcagcuucaagaucgucuccaacaucgacacggugugcagcaucgaggggcccugcaccaucuuccacucccgccugaugaucaccagcaccaagcaggacuacggcaucaagauguccugcaagacgaagcccgggccgaccgaggaguuccagaucugcaagaagaccuacaccauccucuucacgaccaucgagaagaacgacaagaucgagaucagcaccggcgaccagaccuccuucauccaggagcgggacgaccgcugccggacguggcugugccgcgugcgggacgagggcaucggggucaucuucgagcccauccgcgcguucuucggcagcuacuucuccaucgccuucuacaucgugaucgggaucaucauccuguuccucgugaucuacaucuuccugcccauggucuucaagcugcgggacgugcucaagcgcaacgaguaccuguaccugcaggagaucaagcacaaguga

SEQ ID NO: 12533 - RNA, 4305 nt, Artificial Sequence
  derived and/or modified CDS sequence (opt1) from BATV(ON-1/E/94)__AB257764.1__GP
augcugcuguuccuggugcugcucaucagcugcuacgucuccgccagccccgugaucacccgcugcuuccacggcgggcagcugaucgccgagcggaagucccagaccgcgaucagcgaguucugccugaaggacgacguguccacgaucaagagcgagaucaucuacgagaagaacgacaccggccucuucgcccacuccaagguccugcgcaacuggaucaucaaggacuggaagaacugcaacccggugcccaccgccgggggcagcaucaacgugaucgaggucaacgccgaccugucccucgccaccaagacguacgugugcagccgggacugcaccaucaccguggacaaggaggacgcgcagaucgucuuccagaccgagaagcugaaccacuucgagguguccgggacgacccugagcuccggcugguucaagaccaaggccagcgugacccucgaccgcacgugcgagcacaucaaggugaccugcggcaagaagacccugcaguuccacgccugcuucaagcaccacauguccugcauccgguucuuccacgggaccauccugcccggcacgauggccaccagcaucugccagaacaucgagcucaucaucaucaucucccugacccugaucaucuucauccucauggucauccugaccaagacguacaucugcuaccugcucaugccccuguucaugccgaucgcguacuucuacggguggagcuacaacaaguccugcaagaagugcagcugcugcggccuggccuaccaccccuucaccaacugcgggagccacugcgugugcggccucaaguucgaggccuccgaccgcaugcggauccaccgcgagagcggccugugccagggguacaagucccugcgggucgcccgccuccugugcaagagcaagggcuccagccugaucaucuccauccuccugagcaugcugauccucuccuucgugacccccaucgaggggacccugacgaacuaccccgagagccggaaguacgaccuggaggagaucgccgacgugcucgagggcuucgucguggagaagggcaucaaggaguacguggucuucuacaccuccaucuucggggcgcuguuccugcucauggcccugaucgugaucaucgcccugaaccgcgugaccgaguaccucaccaacaucaacguccuguacugccacgagugcagcauguaccacuccaagaagaacaucaaguacaucggcgacuucacgaacaagugcggguucugcacgugcggcgagcuggaggaccaggaggggcucaagauccacaaggugagccggaagugcaucuacaaguaccagcugaccugguccaagaucaucaugaucauccuggucugccuccugaucgcccagaacaccauccugaucguggccgcgagcgacgacugcuggaccaagaagucccuggagauggagugcgugggcccgcuccagcaggucgacacgugcgaggacaagaccagccgcuccuacagcggcgaggccaagaagcuggugcgggccagcaagaucuccgaccuggacgccgcccagguggggcuccugggcagcaccaucgaguccgcgaucgccagcauccgcaagcagcggaccuacuccaccaugcaccuccucgagagcgucuuccuggggaagcacugcgacuacuacaagguguucgagcacaacuccggcuacagccaggccaaguggcgccugaccgccaagacccaccacuucgacaucugcucccggcacagcacccaccacuucugccgcugcaucuccgacgggacgaagugccagaacggcgacugggacuucgccggcgagaugaacagcaccuaccaguccaagcgggacuucuucgagcacgacuucaagcuguucugcacccugaucgagaacgcguuccccgggaccacggagagccuguucuacgagaugcucuccaagaagaacaccaccggcaucaccaagcugcuggacaagcucacgaagaaguucgggaacaacaacauguucgugggcaucuggaaguucgggcaguaccugaugagccugcccuacgucaacgagaccucccucagccccacccagcuggccaaggugcuggaggugaccgaccaccuccaccgcagcaucuccggccgccaggagcugcugacgagcgccaccccgggcuccaagagcuccgagugcgaccacgccaagaaggucagcugcaucagcccccgguucggggugcccauggagggccucaucgcgugcgggaacucccccuccuacaagaucuacaagaccccgaccaagcuguacaagagcaacaacaagggcgagguguggugcuccggcgacguccacugcuuccaggagcugauccccgccagccaggaguccguggaccgcaucaagcagaugacgugcuuccucaccgagcccgaggugagcgacgacgucuucuccaucgccaucagcaugugcaaggugcaggacaagggggugugcaccaucaacgaggaccgguggaacgucaucaagugcgacuccggccugaucuacuacaccgaccagcgcgaggggcaggacacgggcaacgaccugggggaguacugccucagccacuccugccggaucgagcgcuuccccaucaacccgaucaucaucagcgacugccugugggaguaccacagccggaaguccaaguacaucaccagccuggaccucgagucccuggaggaguucaagcgcgccaucagcgagaagcugucccacacccucaucguguacaacuucaagcccaccgccaaccugccccacaucaagcccguguacaaguacaucacgguccagggcguggagaacagcgacggcguggacuccgcguacaucaccgccagcaugccggcccuguccgggaccagcaucggcuacaacaucaugucccgggacaacuucccccucuucgacaucaucaucuucaucaagagcgccaucaucaaggccaccuacaaccacaucuacgacacggggcccaccaucggcaucaacgucaugcacgacgagcacugcaccgggcagugccccaccgacaucccgcacaaggagaacuggaucacguucgcgcaggagcgcaccucccgguggggcugcgaggaguucggcugccuggccgugaacaccgggugcguguucggcagcugccaggacaucauccgccccgagaccaaggucuaccggaaggccguggaggaguccgugcugcucacggucugcaucaccuaccccgggaagaccuucugcaccgagaucaacgccaucgagccgaagaucaccgacgagcuggagcugcaguucaagacgguggacaccaagacccuccccaacauccuggccgugcagaaccacaagcuguacagcggccagaucaacgaccucggguccuucagccagggcugcggcaacauccagaagaccaacuccagcaucaucgggacgggcaccgcgaaguucgacuacgucugccacggggccagccgcaaggacaucguggugcggcgcugcuacaacaacaacuacgaguccugcaagcugcugaaggaggagcagagccucauguucgccgacaaccacgagaccaucgacgucgccaacgugcggcaccuccugggcgaccuccaguucaagcugaugcugggggaccuccgcuacaaguccuucgcggagaaccccgaccuggagaucgaggccaagugcgugggcugccccagcugcuucaccuccuacagcugcuccuucaagaucgucagcaacaucgacacggugugcuccaucgagggcccgugcaccaccuuccacaaccggcugaugaucaccagcacgaagcaggacuacgggaucaagauguccugcaagaccaagcccggccccaccgaggaguuccagaucugcaagaagaccuacacgauccucuucaccaccguggagaagaacgacaagaucgagaucagcaccggggaccagacguccuucauccaggagaaggacgaccgcugcaagaccuggcugugccgcguccgggacgagggcaucagcgugaucuucgagcccauccgcgccuucuucggcuccuacuucagcaucgccuucuacaucgugaucgggaucaucguccuguuccucgugaucuacaucuuccugccgaugaucuucaagcugcgggacgugcucaagcgcaacgaguaccuguaccugcaggagaucaagcacaaguga

SEQ ID NO: 12534 - RNA, 4305 nt, Artificial Sequence
  derived and/or modified CDS sequence (opt1) from BATV(ON-7/B/01)__AB257765.1__GP
augcugcuccugcuggugcuccugauccccugcugcgucagcgccuccccggugaucacccgcugcuuccacggcgggcagcugaucgccgagcgcaagagccaggcggccaucuccgaguucugccucaaggacgacgugagcaccaucaaguccgagaucaucuacgagaagaacgacacgggccuguucgcccacaacaagguccugcgcaacuggaucaucaaggacuggaagaacugcaaccccgugcccaccgccgggggcagcaucaacgugaucgaggucaacaccgaccucucccugaccacgaagaccuacgugugcagccgggacugcaccaucaccguggacaaggaggacgcccagaucaucuuccagacggagaagcugaaccacuucgaggucuccgggaccacccucagcuccggcugguucaagaccaaggcgagcgugacgcuggaccggaccugcgagcacaucaaggugaccugcggcaagaagacccugcaguuccacgccugcuucaagcaccacauguccugcauccgguucuuccacgggacgauccuccccggcaccauggccaccagcaucugccagaacaucgagcugaucaucaucaucucccugacccucaucaucuucauccugauggucauccugacgaagaccuacaucugcuaccuccugaugccgcuguucaugcccaucgccuacuucuacggguggagcuacaacaaguccugcaagaagugccccugcugcggccucgcguaccaccccuucaccaacugcgggagccacugcgugugcggccugaaguucgaggccuccgaccgcaugcggauccaccgcgagagcggccugugccagggguacaagagccuccggguggcccgccugcugugcaaguccaagggcagcucccucaucaucagcauccugcuguccaugcucauccugagcuucgucaccccgaucgaggggacgcugaccaacuaccccgagucccggaaguacgaccucgaggagaucgccgacgugcuggagggcuucaucguggagaagggcaucaaggaguacgucguguucuacaccagcaucuucggggcccuguuccuccugaucgcgcugaucgugaucaucgcccucaaccgcgucaccgaguaccugacgaacaucaacgugcuguacugccacgagugcuccauguaccacagcaagaagaacaucaaguacaucggcgacuucaccaacaagugcggguucugcacgugcggcgagcucgaggaccaggaggggcugaagauccacaaggugucccggaagugcaucuacaaguaccagcugaccuggagcaaggucaucaugaugauccucgugugccugcugaucgcccagaacaccauccugaucgucgccgccuccgacgacugcuggaccaagaagucccucgagaugggcugcaucggcccccugcagcaggucgacacgugcgacgacaaggcgucccgcagcuacuccggggaggccaagaagcuggugcgggccagcaagaucuccgaccucgacgccgcccaggugggccagcuggggagcaccaucgagagcgcgaucgccuccauccgccggcagcgcaccuacagcaccaugcaccuccuggaguccguguuccugggcaagcacugcgacuacuacaagguguucgagcacaacagcggguacucccaggccaaguggcggcugaccgccaagacccaccacuucgacaucugcagccgccacuccacccaccacuucugccggugcaucagcgacggcacgaagugccagaacggcgacugggacuucgccggggagaugaacuccaccuaccagagcaagcgcgacuucuucgagcacgacuucaaccucuucugcacccugaucgagaacgcguuccccggcaccacggagucccuguucuacgagaugcucagcaagaagaacaccaccgggaucaccaagcugcuggacaagcucacgaagaaguucggcaacaacaacauguucgucgggaucuggaaguucggccaguaccugaucucccugccguacgugaacgagaccagccucucccccacccagcuggccaaggugcuggucgugaccgaccagcaccaccgcagcaucuccggccggcaggagagccucgccagcgccacgcccggguccaagagcuccgagugcggccacgcgaagaaggugagcugcaucagcccccgcuucggggucccgauggagggccugauggccugcggcagcucccccaacuacaagaucuacaagacccccgccaagcuguacaagagcaacaacaagggggagguguggugcuccggcgacgugcacugcuuccaggaccucauccccgccagccaggaguccgucgaccggaucaagcagaugaccugcuuccugaccgagccggaggugaacgacgacguguucagcaucgccaucgcgaugugcaagguccaggacaagggggugugcacgaucaacgaggaccgcuggaaccugaucaagugcgacuccggccucaucuacuacaccgaccagcgggaggggcaggacaccggcaacgacuucggcgaguacugccugagccacaacugcaagauggagcgcuuccccaucaaccccgccaucaucuccgacugccugugggaguaccacagccggaaguccaaguacaucaccagccucgaccuggagucccuggaggaguucaagcgcgccaucagcgagaagcucagccacacgcugguggucuacaacuucaagcccaccgccaaccugccgcacaucaagcccguguacaaguacaucaccgugcagggggucgagaacuccgacggcguggacagcgccuacaucaccgcguccaugcccgcccucagcgggacguccaucggcuacaacaucaugagccgggacaacuucccccuguucgacaucaucaucuucaucaaguccgccaucaucaaggccaccuacaaccacaucuacgacaccgggccgaccaucggcaucaacgugaugcacgacgagcacugcacgggccagugccccaccgacaucccccacaaggagaacuggaucaccuucgcccaggagcgcaccagccggugggggugcgaggaguucggcugccuggcggucaacacggggugcguguucggcuccugccaggacaucauccgcccggagaccaagguguaccggaaggccgucgaggagagcgugcuccugaccgugugcaucaccuaccccgggaagacguucugcaccgagaucaacgccaucgagcccaagaucaccgacgagcuggagcuccaguucaagaccgucgacaccaagacgcugcccaacauccuggccgugcagaaccacaagcucuacuccggccagaucaacgaccugggcagcuucucccaggggugcggcaacauccagaagaccaaccugagcaucaucgggaccggcaccgcgaaguucgacuacgugugccacggggccucccgcaaggacaucaucguccggcgcugcuacaacaacaacuacgagagcugcaagcuccugaaggaggagcagucccugauguucgccgacaaccacgagacgaucgacguggccaacgugcggcaccuccugggcgaccugcaguucaagcucaugcugggcgaccugcgcuacaagagcuucgccgagaacccggaccucgagaucgaggcgaagugcgucgggugccccuccugcuucaccagcuacagcugcaacuucaagaucguguccaacaucgacaccgugugcagcaucgagggccccugcaccacguuccacaaccggcugaugaucaccuccgccaagcaggacuacgggaucaagaugagcugcaagaccaagcccggccugaccgaggaguuccagaucugcaagaagacguacaccguccucuucgccaccguggagaagaacgacgagaucgagaucuccaccggcgaccagacgagcuucauccaggagcgcgacgaccgcugcaagaccuggcugugccgggugcgcgacgaggggaucuccgucaucuucgagccgauccgggccuucuucggcagcuacuucuccaucgccuucuacaucgugaucgggaucaucgugcuguuccucgucaucuacaucuuccugcccaugguguucaagcugcgcgacgugcucaagcggaacgaguaccuguaccugcaggagaucaagcacaaguga

SEQ ID NO: 12535 - RNA, 4305 nt, Artificial Sequence
  derived and/or modified CDS sequence (opt1) from BATV(UgMP-6830)__DQ436460.1__GP
augcugcuccugcuggugcuccugauccccugcuacgucagcgccuccccgguggugacccgcugcuuccacggcgggcagcugaucgccgagaagaagucccagaccgcggucuccgaguucugccucaaggacgacgugagcacgaucaaguccgagaucaccuacgagaagaacaacaccggccuguucgcccacaacaaggugcugcggaacuggaucaucaaggacuggaagaacugcaaccccguccccaccgccgggggcagcaucaacgugaucgaggugaacacggaccucucccugaccaccaagaccuacgucugcagccgcgacugcacgaucaccguggacaaggaggacgcccagaucaucuuccagaccgagaagcugaaccacuucgagguguccgggaccacgcucagcuccggcugguucaagaccaaggccagcgucacccuggaccggaccugcgagcacaucaaggugacgugcggcaagaagacccugcaguuccacgcgugcuucaagcaccacauguccugcauccgcuucuuccacgggaccauccuccccggcaccauggccacgagcaucugccagaacaucgagcugaucaucaucaucucccugacccucaucaucuucauccugauggugauccugaccaagaccuacaucugcuaccuccugaugccgcuguucaugcccaucgccuacuucuacggguggagcuacaacaaguccugcaagaagugcagcugcugcggccucgccuaccaccccuucacgaacugcgggucccacugcgucugcggccugaaguucgaggcgagcgaccggaugcgcauccaccgggagagcggccugugccagggguacaagucccuccgcguggcccggcugcugugcaagagcaagggcuccagccucaucaucuccauccugcugagcaugcucauccuguccuucgugacccccaucgaggggacccugaccaacuacccggagagccgcaaguacgaccucgaggagaucgccgacguccuggagggcuucaucguggagaagggcaucaaggaguacguggucuucuacacguccaucuucggggcccuguuccuccugauggcccuggugaucaucaucgcgcucaacaaggugaccgaguaccugaccaacaucaacguccuguacugccacgagugcagcauguaccacuccaagaagaacaucaaguacaucggcgacuucaccaacaagugcggguucugcacgugcggcgagcucgaggaccaggaggggcugaagauccacaaggugagccggaagugcaucuacaaguaccagcugaccugguccaagaucaucaugaugauccucgucugccugcugaucgcccagaacaccauccugaucguggccgccagcgacgacugcuggaccaagaagucccucgagauggagugcaucggcccccugcagcaggucgacacgugcgacgacaagagcucccgcagcuacuccggcgaggccaagaagcuggugcgggcgagcaagaucagcgaccucaacgccgcccagguggggcugcugggcuccaccaucgagagcgccaucgccuccauccgcaagcagcggaccuacagcaccaugcaccuccuggaguccguguuccuggggaagcacugcgacuacuacaaggcguucgagcacaacagcggcuacucccaggccaaguggcgccucaccgccaagacgcaccacuucgacaucugcagccggcacuccacccaccacuucugccgcugcaucagcgacgggaccaagugccagaacggcgacugggacuucgccggcgagaugaacuccaccuaccagagcaagaaggacuucuucgagcacgaccugaagcuguucugcacgcucgucgagaacgccuuccccgggaccaccgagucccuguucuacgagaugcugagcaagaagaacaccacgggcgugaagaagcuccuggacaagcugaccaagaaguucgggaacaacaacauguucgugggcaucuggaaguucgggcaguaccucaugucccugcccuacgucaacgagaccagccugaccccggcgcagcucgccaagauccuggaggugacggaccagcaccaccgguccaucagcggccgccaggagagccuggccuccgccacccccggcagcaaguccaaggagugcgggcacgcgaagaaggugagcugcaucagcccccgguucggcguccccauggaggggcuccuggccugcggcgacagcccgaacuacaagaucuacaagacccccgccaagcuguacaaguccaacaacaagggcgagguguggugcagcggggacgugcacugcucccaggagcucagccccgccucccaggagagcgucgaccgcaucaagcagaucacgugcuuccugaccgagcccgagguguccgacgacguguucagcaucgccaucuccacgugcaagguccaggacaagggcgugugcaccgugaacgaggaccgcuggaacgucaucaagugcgacagcgggcugaucuacuacaccgaccagcgggacggccaggacaccgggaacgacuucggcgaguacugccucucccacagcugccgcaucgagcgguucccgaucaaccccgcgaucaucuccgacugccugugggaguaccacagccgcaagagcaaguacaucaccucccuggaccucgagagccuggaggaguucaagcgggccaucuccgagaagcugagccacacccucaucguguacaacuucaagcccaccgccaaccugccccacaucaagccgaucuacaaguacaucacggugcagggcgucgagaacuccgacgggguggacagcgccuacaucaccgccuccaugcccgcgcugagcggcaccuccaucggguacaacaucaugagccgcgacaacuucccccucuucgacaucaucaucuucaucaaguccgccaucaucaaggccaccuacaaccacaucuacgacacgggccccaccaucgggaucaacgugaugcacgacgagcacugcaccggccagugcccgaccgacaucccccacaaggagaacuggaucacguucgcccaggagcggaccagccgcuggggcugcgaggaguucgggugccuggccgucaacaccggcugcguguucggguccugccaggacaucauccggcccgagaccaagguguaccgcaaggcggucgaggagagcgugcugcucacggugugcaucaccuacccgggcaagaccuucugcaccgagaucaacgccaucgagcccaagaucaccgacgagcuggagcugcaguucaagacggucgacaccaagacccuccccaacauccuggccgugcagaaccacaagcuguacuccgggcagaucaacgaccucggcagcuucucccagggcugcgggaacauccagaagaccaacagcuccaucaucggcacggggaccgccaaguucgacuacgugugccacggcgcgagccggaaggacaucaucguccgccggugcuacaacaacaacuacgagagcugcaagcugcugaaggaggagcagucccucauguucgccgacaaccacgagaccaucgacguggccaacgugcgccaccuccugggggaccugcaguucaagcugaugcugggcgaccuccgguacaagagcuucgccgagaaccccgaccuggagaucgaggccaagugcgucggcugcccguccugcuucaccagcuacuccugcagcuucaagaucguguccaacaucgacacggugugcagcaucgaggggcccugcaccaccuuccacaaccgccugaugaucaccuccacgaagcaggacuacggcaucaagaugagcugcaagaccaagcccgaggagaccgaggaguuccagaucugcaagaagaccuacacgguccucuucaccaccguggagaagaacgacaagaucgagaucuccaccggggaccagacgagcuucauccaggagcgggacgaccgcugcaagaccuggcugugccgggugcgcgacgagggcaucuccgucaucuucgagcccauccgcgcguucuucggcagcuacuucuccaucgccuucuacgugguggucagcaucaucgugcuguuccucgccaucuacaucuuccugccgaugguguucaagcugcgggacguccucaagaagaacgaguaccuguaccugcaggagaucaagcacaaguga

SEQ ID NO: 12536 - RNA, 4305 nt, Artificial Sequence
  derived and/or modified CDS sequence (opt1) from BATV(ZJ2014)__KU746870.1__GP
augcuggugcuccugguccugcucauccccugcugcgugagcgccuccccggccaucacccgcugcuuccacggcgggcagcugaucgcggagcgcaagagccagaccgccaucuccgaguucugccugaaggacgacgugagcacgaucaaguccgagaucaucuacgagaagaacgacaccggccucuucgcccacaacaagguccugcgcaacuggaucaucaaggacuggaagaacugcaaccccgugcccaccgccgggggcagcaucaacgugaucgaggucaacaccgaccugucccucacgaccaagaccuacgugugcagccgggacugcaccaucacgguggacaaggaggacgcccagaucaucuuccagaccgagaagcugaaccacuucgaggucuccgggaccacccugagcuccggcugguucaagacgaaggcgagcgugacccucgaccggaccugcgagcacaucaaggugaccugcggcaagaagacgcugcaguuccacgccugcuucaagcaccacauguccugcauccgguucuuccacgggaccauccugcccggcaccauggccaccagcaucugccagaacaucgagcucaucaucaucaucucccugacgcugaucaucuucauccucauggucauccugacccgcaccuacaucugcuaccugcucaugccgcuguucaugcccaucgccuacuucuacggguggagcuacaacaaguccugcaagaagugccagugcugcggccuggcguaccaccccuucaccaacugcgggagccacugcgugugcggccucaaguucgaggccuccgaccggaugcgcauccaccgggagagcggccugugccagggguacaagagccugcgcguggcccggcuccugugcaaguccaagggcagcucccugaucaucagcauccuccuguccaugcugauccucagcuucgucacgcccaucgaggggacccugaccaacuacccggagucccgcaaguacgaccuggaggagaucgccgacgugcucgagggcuucguggucgagaagggcaucaaggaguacgugguguucuacaccagcaucuucggggcccuguuccugcucauggcgcugaucgucaucaucgcccugaaccgggugacggaguaccucaccaacaucaacguguucuacugccacgagugcuccauguaccacagcaagaagaacaucaaguacaucggcgacuucaccaacaagugcggguucugcacgugcggcgagcuggaggaccaggaggggcugaagauccacaaggucucccgcaagugcaucuacaaguaccagcucaccuggagcaagaucaucaugaugauccuggugugccugcucaucgcccagaacaccauccugaucgucgccgccuccgacgacugcuggaccaagaagucccuggagaugggcugcaucggcccccugcagcaggucgacacgugcgacgacaagaccagccggagcuacuccggggaggcgaagaagcucgugcgcgccagcaagaucuccgaccuggacgccgcccaggugggccugcucgggagcaccaucgagagcgccaucgcguccauccggaagcagcgcaccuacagcaccaugcaccuccuggaguccguguuccugggcaaguacugcgacuacuacaagguguucgagcacaacagcggguacucccaggccaaguggcggcugaccgccaagacgcaccacuucgacaucugcagccgccacuccacccaccacuucugccggugcaucagcgacggcaccaagugccagaacggcgacugggacuucgccuccgagaugaacagcaccuaccaguccaagcgcgacuucuucgagcacgacuucaaggucuucugcacgcugaucgagaacgccuuccccgggaccaccgagagccucuucuacgagaugcuguccaagaagaacaccacgggcaucaccaagcugcucgacaagcugaccaagaaguucgggaacaacaacauguucgugggcaucuggaaguucgggcaguaccugaugagccuccccuacgugaacgagaccucccugagcccgacgcagcuggcgaagguccucgaggugaccgaccaccaccaccgcuccaucagcggccggcaggagagccuggccuccgccgcccccggcagcaaguccagcgagugcgaccacgcgaagaagguguccugcaucagcccccgcuucgggguccccaucgagggccugaccgccugcggguccagcccgaacuacaagaucuacaagacccccgccaagcucuacaaguccaacagcaagggcgagguguggugcuccggcgacgugcacugccugcaggagcugauccccgccagccaggaguccgucgaccggaucaagcagaugacgugcuuccucaccgagcccggggugaacgacgacaucuucagcaucgccaucuccaugugcaaggugcaggacaagggcgucugcaccaucaacgaggaccgcuggaacguggugaagugcgacagcgggcugaucuacuacaccgaccagcgggagggccaggacacggggaacgacuucggcgaguacugccugucccacagcugccgcaucaagcgguucccgaucaaccccgcgaucaucaacgacugccucugggaguaccacucccgcaagagcaaguacaucaccagccuggaccuggagucccucgaggaguucaagcgggccaucagcgagaagcugucccacacccugaucgucuacaacuucaagcccaccgccaaccucccccacaucaagccgguguacaaguacaucacggugcagggcgucgagaacagcgacgggguggacuccgccuacaucaccgccagcaugcccgcgcuguccggcaccagcaucggguacaacaucaugucccgcgacaacuucccccuguucgacaucaucaucuucaucaagagcgccaucaucaaggccaccuacaaccacaucuacgacacgggccccaccaucgggaucaacgugauccacgacgagcacugcaccggccagugcccgaccgacaucccccacaaggagaacuggaucacguucgcccaggagcggaccucccgcuggggcugcgaggaguucgggugccucgccaucaacaccggcugcgucuucgggagcugccaggacaucauccggcccgagaccaagguguaccgcaaggcgguggaggaguccguccugcugacggugugcaucaccuacccgggcaagaccuucugcaccgagaucaacgccaucgagcccaagaucaccgacgagcucgagcugcaguucaagacgguggacaccaagacccugcccaacauccucgccguccagaaccacaagcuguacagcgggcagaucaacgaccugggcuccuucagccagggcugcgggaacauccagaagaccaacuccagcaucaucggcacggggaccgccaaguucgacuacgugugccacggcgcgucccggaaggacaucaucgugcgccggugcuacaacaacaacuacgagagcugcaagcuccugaaggaggagcagagccugauguucgccgacaaccacgagaccaucgacgucgccaacgugcgccaccuccugggggaccugcaguucaagcucaugcugggcgaccugcgguacaaguccuucgccgagaaccccgaccucgagaucgaggccaagugcgugggcugcccgagcugcuucaccuccuacagcugcuccuucaagaucgucagcaacaucgacacggugugcuccaucgacgggcccugcaccaucuuccacaaccgccugaugaucaccagcaccaagcaggacuacggcaucaagauguccugcaagacgaagcccgggcccaccgaggaguuccagaucugcaagaagaccuacaccauccuguucacgaccaucgagaagaacgacaagaucgagaucagcaccggcgaccagaccuccuucauccaggagcgcgacgaccggugccgcacguggcucugccgggugcgcgacgagggcaucagcgucaucuucgagccgauccgggcguucuucggguccuacuucagcaucgccuucuacaucgugaucggcaucaucauccuguuccuggugaucuacaucuuccuccccauggucuucaagcugcgcgacgugcugaagcggaacgaguaccucuaccugcaggagaucaagcacaaguga

SEQ ID NO: 12537 - RNA, 4305 nt, Artificial Sequence
  derived and/or modified CDS sequence (opt1) from CVV__AF082576.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaucaagaacgacaccgggcuguucggccacaacaagguguuccggagcuggaccaucaaggacuggaagcugugcaacccgauccccaccgccgggggcacgaucaacgucaucgaggugaacaaggaccucucccugaugaccaagaccuacaucugcagccgcgacugcaccaucacgaucgacaaggaggaggcccagaucaucuuccagaccgacaagcugaaccacuucgagguguccggcaccacccucagcuccgggugguucaagagcaaggccuccgucacgcuggaccggaccugcgagcacgugaaggugaccugcggcaagaagucccugcaguuccacgcgugcuucaagcaccacaugagcugcguccgcuucuuccacaacaccauccuccccgggaacaugaucacgagcaugugccagaacaucgagcugaucaucauccugggccucacccuggccaucuucauccugauggugaugcucaccaagaccuacaucugcuaccugcugaugcccaucuucaugccgaucgccuaccucuacgggugggccuacaacaaguccugcaagaagugcaacugcugcggccuggcguaccaccccuucacgaacugcggcagccacugcgugugcgggcugaaguucgaggccagcgaccggaugcgcauccaccgggaguccggccucugccagggguacaagagccugcgcaucgcccggcugcucugcaaguccaagggcagcucccuggucaucagcggccugcucuccaugcugauccugagcuucgugacccccaucgaggggaccaucaccuccuaccccgagagccgcaaguacacgcucgaggagaucaccgacguggucgagggccugguguccgagcagaacaucaaggaguacaucguguucuacaccagccuguucgggucccucauccugcugcucgccuucaucaugagcaucacccuguccaagaucacgagcauccuggccaagcggaacgucaucuacugcgaggagugcuccauguaccacagcaagcgcggcaucaaguacaacggggacuucaccaacaagugcggcuucugcacgugcaacgagcaggaggacaccgagggccucgugauccacaagguguccaagcggugcaccuacaaguaccagcugaagugggcgaagguccugaugaucacccucgugcugcugcugaucgcccagaacaccauccucaucguggccgccgagaccgacugcuggacgaagaagucccuggacaucgacugcaucgggccgaugcuggacaucggcagcugcaccaacaagaacacccgcagcuacgacgccgaggcgcagaagcucgucagccaguccaagaucagccagcuggacgccgaccaggccucccugcucgggaacagcaucgacuccgccaucaaggccauccgggcgcagaagaccuaccccaccaugcaccuccuggagacgaucuuccucaugaagaacugcgacuacuacaccagcuucaaccacaacuccggcuacagccaggccaaguggcgccugaucgccaagaccgggcacuucgacaucugcucccggcacagcacccaccacuucugccagugcaucaacgacggcacgaagugccagaacggcgacugggacuucgccggggagaugaacgagaccuacaacuccaagaacgacuucuacagccacgaccugaaccucuucuacaccaucuucgagaacgccuuccccggcaccacggagucccuguucuaccagcugauccagaagaagaacaccaccggggcgagcaaggugcucggcaagcugaucaccaaguacgggaacaacaacauguucgucggcaucuggaaguucggccaguaccugcucacgcugcccuacaucaacaacaccgagcugucccagaaccgccggcucaccauccuggccacccaggagcugcucagccgcagccacuccgggcggcaggagagcauguccaacgccauccagggcagcaucacgaaggagugccacaacgccaagggggugggcugcaucuccccgcaguucggcauccccaucgggaaccugaccgcgugcggcgacagccccaacuacaagaucuacaagacccccgagaagcuguacaaguccaacaacaagggggagguguggugcagcaacgacguccacugccucaacgacuucgagccggccgacgaggagguggugaacaagaucaagaagcugaccugcuuccugacggacgucuccguggagguggacaucuucagcgucgccgccuccacgugcaagauggccgacaagggcgugugcaccgugaacggggcgaaguggaacaucaucaagugcgacagcggccucuacuacuucaccgaccaccgcgagggccaggacaccgggaacgacuucggcgaguacugcaucucccacagcugcaacaccgagcgcuuccccaucaaccccgacacccugaaggacugcaccugggaguuccacucccgcaagagcaaguacaucuccacgaucagccuggagucccucgaggaguuccggcgggccauggccgagaagcugagccacacccugaccaucuacaacuucaagcccaccgccaaccucccgcacauccgccccacguacaaguucaucaccgccaacggggucgagaacagcgacggcaucgaguccgcguacauccugagcuccauccccgcccucgggggcaucagcgugggcuacaacgugcagaccaaggacaacuucccccugcuggacaucaucgucuucaucaaguccgccgugauccggaccacguacaaccacaucuacgacaccgggccgaccaucggcaucaacacccagcacgacgagcacugcaccgggcccugccccgccguggucccccacaaggagaacuggaugacguucagccaggagcgcaccucccgguggggcugcgaggaguucgggugccuggccaucaacaccggcugcguguucggcagcugccaggacaucauccacccggagaccaagguguaccgcaaggcggucgaggaggagguggugcucacggucugcaucaacuuccccgggaacaacuacugcaccgagaucaacgccaucgagcccaagaucaccgacgagaucgagcugcaguucaagaccguggacacgaagacccugccgaaccuccuggccgugcagaaccacaagcuguacuccggccagaucaacgaccucgggagcuucucccagggcugcgggaacguccagaagaccaaccacagcauccugggcaugggcaccgugaaguucgacuacgugugccacggggccucccggaaggacgucaucgugcgccggugcuacaacaacaacuucgacagcugcaagcugcucaaggaggagacgucccugaucuucgcggacaaccacgagacccuggagguggcccacaccaagcaccucaucggcgagcugcaguucaagaucaugcugggggacauccgcuacaagagcuucgccgagucccccgagcucgagaucgacgccaagugcgucggcugccccagcugcuucgaguccuacagcugcaacuuccagaucgugagcaacaucgacaccgugugcuccgucgagggccccugcacgcuguuccacaaccggaucaucaucagcgccaacaagcaguccuacgggcugaagaugagcugccagaccaagccgaaccagaacgaggaguucaucaucugcaaccgcaaguacuccgugcuguucaccaccaucgacaagaacgacaagaucgaggugaacacgggcgaccagaccagcuacaucuacgagaaggacucccggugcaagaccuggcugugccgcguccgggacgaggggaucagcgugcuguucgagccccucaaggcguucuucggcuccuacuucagcaucaucuucuacguggucguggggaucaucgugcuguuccugaucaucuacaucuuccuccccauguucuucaagcugaaggacguccugaagcgcaacgaguaccucuaccugcaggagcugaagcacaaguga

SEQ ID NO: 12538 - RNA, 4305 nt, Artificial Sequence
  derived and/or modified CDS sequence (opt1) from CVV(Montgomery County/VA/2015 4b)__KX583998.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaccaagaacgacaccgggcuguucggccacaacaagguguuccggagcuggaccaucaaggacuggaagcugugcaacccgauccccacggccgggggcaccaucaacgucaucgaggugaacaaggaccucucccugaugaccaagaccuacaucugcagccgcgacugcacgaucaccaucgacaaggaggaggcccagaucaucuuccagaccgacaagcugaaccacuucgagguguccggcaccacgcucaacagcgggugguucaaguccaaggccagcgucacccuggaccggaccugcgagcacgugaaggugaccugcggcaagaagucccugcaguuccacgcgugcuucaagcaccacaugagcugcguccgcuucuuccacaacacgauccuccccgggaacaugaucaacuccaugugccagaacaucgagcugaucaucauccugggccucacccuggccaucuucauccugauggugaugcucaccaagaccuacaucugcuaccugcugaugcccaucuucaugccgaucgccuaccucuacgggugggccuacaacaagagcugcaagaagugcaacugcugcggccuggcguaccaccccuucacgaacugcggcucccacugcgugugcgggcugaaguucgaggccagcgaccggaugcgcauccaccgggagagcggccucugccagggguacaagucccugcgcaucgcccggcugcucugcaagagcaagggcuccagccuggucaucuccggccugcucagcaugcugauccuguccuucgugacccccaucgaggggaccaucaccagcuaccccgagucccgcaaguacacgcucgaggagaucaccgacguggucgagggccuggugagcgagcagaacaucaaggaguacaucguguucuacaccucccuguucgggagccucauccugcugcucgccuucaucauguccaucacccugagcaagaucacguccauccuggcccggcgcaacgucaucuacugcgaggagugcagcauguaccacuccaagcggggcaucaaguacaacggggacuucaccaacaagugcggcuucugcacgugcaacgagcaggaggacgcggagggccucgugauccacaaggugagcaagcgcugcaccuacaaguaccagcugaagugggccaagguccugauggugacccucgugcugcugcugaucgcccagaacaccauccucaucgucgccgccgggaccgacugcugggcgaagaagucccuggacauggacugcaucggcccgaugcuggacaucgggagcugcaccaacaagaacacgcggaacuacgacaccgaggcccagaagcucgugagccaguccaaggucagccagcuggacgccgaccaggccucccugcucggcaacagcaucgacuccgccaucaaggcgauccgcgcccagaagaccuaccccaccaugcaccuccuggagaccaucuuccucaugaagaacugcgacuacuacacgagcuucaaccacaacuccggguacagccaggccaaguggcggcugaucgccaagaccggccacuucgacaucugcucccgccacagcacccaccacuucugccggugcaucaacgacggcaccaagugccagaacggggacugggacuucgccggcgagaugaacgagacguacaacuccaagaacgacuucuacagccacgaccugaaccucuucuacaccaucuucgagaacgcguuccccgggaccaccgagucccuguucuaccagcugauccagaagaagaacacgaccggcgccagcaagauccucgggaagcugaucaccaaguacggcaacaacaacauguucgugggcguguggaaguucgggcaguaccugcucacccugcccuacaucaacaacacggagcugucccagaaccgccggcagaccauccucgccacccaggagagccugucccgcagccacagcggccgccaggaguccaugagcuccgccauccaggggagcgucaccaaggagugccacaacgcgaaggacgugggcugcaucuccccgcgguucggcauccccaucgggaaccugacggccugcggcgacagccccaacuacaagaucuacaagacccccgagaagcucuacaaguccaacaacaagggggagguguggugcagcaacgacguccacugccugaacgacuucgagccggccgacgaggagguggugaacaaggucaagaagcugaccugcuuccucaccgacguguccgugaagacggacaucuucagcgucgccguguccacgugcaagauggccgacaaggggaccugcaccgugaaggacgcgaaguggaacaucaucaagugcgacagcggccuguacuacuucaccgaccaccgcgagggccaggacaccggcaacgacuucggggaguacugcaucucccacagcugcaacaccgagcgguuccccaucaaccccgacauccugaaggacugcaccugggaguuccacucccgcaagagcaaguacaucuccacgaucagccucgagucccuggaggaguuccggcgcgccaugaccgagaagcugagccacacccucaccaucuacaacuucaagcccacggccaaccugccgcacauccggcccaccuacaaguucaucaccgccaacggcgucgagaacagcgacgggaucgaguccgccuacauccugagcuccauccccgcgcucggcgggaucagcgugggcuacaacgugcagaccaaggacaacuucccccugcuggacaucaucgucuucaucaaguccgccgugauccgcacgaccuacaaccacaucuacgacaccggcccgaccaucgggaucaacacccagcacgacgagcacugcacgggccccugccccgccguggucccccacaaggagaacuggaucaccuucagccaggagcggaccucccgcugggggugcgaggaguucggcugccucgccaucaacaccgggugcguguucggcagcugccaggacaucauccacccggagacgaagguguaccggaaggccgucgaggaggagguggugcugaccgucugcaucaacuuccccggcaacaacuacugcaccgagaucaacgcgguggagcccaagaucaccgacgagaucgagcugcaguucaagacgguggacaccaagacccucccgaaccugcuggccguccagaaccgcaagcucuacuccgggcagaucaacgaccugggcagcuucucccaggggugcggcaacgugcagaagaccaaccacagcauccuggggaugggcacggccaaguucgacuacgugugccacggcgccucccggaaggacgucaucgugcgccggugcuacaacaacaacuucgacagcugccgccuccugaaggaggagaccucccugaucuucgcggacaaccacgagacccucgagguggcccacaccaagcaccugaucggggagcugcaguucaagaucaugcucggcgacauccgguacaagagcuucgccgagucccccgagcuggagaucgacgccaagugcgucgggugccccagcugcuucgaguccuacagcugcaacuuccagaucgugacgaacaucgacaccgugugcagcgucgagggccccugcacccuguuccacaaccgcaucaucaucuccgccaacaagcagagcuacggccucaagauguccugccagaccaagccgaaccagaacgaggaguucaucaucugcaaccggaaguacagcgugcuguucacgaccaucgacaagaacgacaagaucgaggugaacaccggggaccagaccuccuacaucuacgagaaggacagccgcugcaagacguggcugugccgcguccgggacgagggcaucuccgugcuguucgagccccugaaggcguucuucgggagcuacuucuccaucaucuucuacguggucgugggcaucaucgugcuguuccucaucaucuacaucuuccugcccauguucuucaagcugaaggacguccucaagcgcaacgaguaccuguaccugcaggagcucaagcacaaguga

SEQ ID NO: 12539 - RNA, 4305 nt, Artificial Sequence
  derived and/or modified CDS sequence (opt1) from CVV(Montgomery County/VA/2015 K)__KX583999.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaccaagaacgacaccgggcuguucggccacaacaagguguuccggagcuggaccaucaaggacuggaagcugugcaacccgauccccacggccgggggcaccaucaacgucaucgaggugaacaaggaccucucccugaugaccaagaccuacaucugcagccgcgacugcacgaucaccaucgacaaggaggaggcccagaucaucuuccagaccgacaagcugaaccacuucgagguguccggcaccacgcucaacagcgggugguucaaguccaaggccagcgucacccuggaccggaccugcgagcacgugaaggugaccugcggcaagaagucccugcaguuccacgcgugcuucaagcaccacaugagcugcguccgcuucuuccacaacacgauccuccccgggaacaugaucaacuccaugugccagaacaucgagcugaucaucauccugggccucacccuggccaucuucauccugauggugaugcucaccaagaccuacaucugcuaccugcugaugcccaucuucaugccgaucgccuaccucuacgggugggccuacaacaagagcugcaagaagugcaacugcugcggccuggcguaccaccccuucacgaacugcggcucccacugcgugugcgggcugaaguucgaggccagcgaccggaugcgcauccaccgggagagcggccucugccagggguacaagucccugcgcaucgcccggcugcucugcaagagcaagggcuccagccuggucaucuccggccugcucagcaugcugauccuguccuucgugacccccaucgaggggaccaucaccagcuaccccgagucccgcaaguacacgcucgaggagaucaccgacguggucgagggccuggugagcgagcagaacaucaaggaguacaucguguucuacaccucccuguucgggagccucauccugcugcucgccuucaucauguccaucacccugagcaagaucacguccauccuggcccggcgcaacgucaucuacugcgaggagugcagcauguaccacuccaagcggggcaucaaguacaacggggacuucaccaacaagugcggcuucugcacgugcaacgagcaggaggacgcggagggccucgugauccacaaggugagcaagcgcugcaccuacaaguaccagcugaagugggccaagguccugauggugacccucgugcugcugcugaucgcccagaacaccauccucaucgucgccgccgggaccgacugcugggcgaagaagucccuggacauggacugcaucggcccgaugcuggacaucgggagcugcaccaacaagaacacgcggaacuacgacaccgaggcccagaagcucgugagccaguccaaggucagccagcuggacgccgaccaggccucccugcucggcaacagcaucgacuccgccaucaaggcgauccgcgcccagaagaccuaccccaccaugcaccuccuggagaccaucuuccugaugaagaacugcgacuacuacacgagcuucaaccacaacuccggguacagccaggccaaguggcggcugaucgccaagaccggccacuucgacaucugcucccgccacagcacccaccacuucugccggugcaucaacgacggcaccaagugccagaacggggacugggacuucgccggcgagaugaacgagacguacaacuccaagaacgacuucuacagccacgaccugaaccucuucuacaccaucuucgagaacgcguuccccgggaccaccgagucccuguucuaccagcugauccagaagaagaacacgaccggcgccagcaagauccucgggaagcugaucaccaaguacggcaacaacaacauguucgugggcguguggaaguucgggcaguaccugcucacccugcccuacaucaacaacacggagcugucccagaaccgccggcagaccauccucgccacccaggagagccugucccgcagccacagcggccgccaggaguccaugagcuccgccauccaggggagcgucaccaaggagugccacaacgcgaaggacgugggcugcaucuccccgcgguucggcauccccaucgggaaccugacggccugcggcgacagccccaacuacaagaucuacaagacccccgagaagcucuacaaguccaacaacaagggggagguguggugcagcaacgacguccacugccugaacgacuucgagccggccgacgaggagguggugaacaaggucaagaagcugaccugcuuccucaccgacguguccgugaagacggacaucuucagcgucgccgccuccacgugcaagauggcggacaaggggaccugcaccgugaacgacgccaaguggaacaucaucaagugcgacagcggccuguacuacuucaccgaccaccgcgagggccaggacaccggcaacgacuucggggaguacugcaucucccacagcugcaacaccgagcgguuccccaucaaccccgacauccugaaggacugcaccugggaguuccacucccgcaagagcaaguacaucuccacgaucagccucgagucccuggaggaguuccggcgcgccaugaccgagaagcugagccacacccucaccaucuacaacuucaagcccacggccaaccugccgcacauccggcccaccuacaaguucaucaccgccaacggcguggagaacagcgacgggaucgaguccgcguacauccugagcuccauccccgcccucggcgggaucagcgucggcuacaacgugcagaccaaggacaacuucccccugcuggacaucaucguguucaucaaguccgccgucauccgcacgaccuacaaccacaucuacgacaccggcccgaccaucgggaucaacacccagcacgacgagcacugcacgggccccugccccgccguggugccccacaaggagaacuggaucaccuucagccaggagcggaccucccgcugggggugcgaggaguucggcugccucgccaucaacaccgggugcgucuucggcagcugccaggacaucauccacccggagacgaagguguaccggaaggcgguggaggaggaggucgugcugaccgugugcaucaacuuccccggcaacaacuacugcaccgagaucaacgccgucgagcccaagaucaccgacgagaucgagcugcaguucaagacgguggacaccaagacccucccgaaccugcuggccgugcagaaccacaagcucuacuccgggcagaucaacgaccugggcagcuucucccaggggugcggcaacguccagaagaccaaccacagcauccuggggaugggcacggccaaguucgacuacgugugccacggcgcgucccgcaaggacgugaucguccggcgcugcuacaacaacaacuucgacagcugccggcuccugaaggaggagaccucccugaucuucgccgacaaccacgagacccucgagguggcccacaccaagcaccugaucggggagcugcaguucaagaucaugcucggcgacauccgcuacaagagcuucgccgagucccccgagcuggagaucgacgccaagugcguggggugccccagcugcuucgaguccuacagcugcaacuuccagaucgucacgaacaucgacaccgugugcagcguggagggccccugcacccuguuccacaaccggaucaucaucuccgcgaacaagcagagcuacggccucaagauguccugccagaccaagccgaaccagaacgaggaguucaucaucugcaaccgcaaguacagcguccuguucacgaccaucgacaagaacgacaagaucgaggugaacaccggggaccagaccuccuacaucuacgagaaggacagccggugcaagacguggcugugccgcgugcgcgacgagggcaucuccguccucuucgagccccugaaggccuucuucgggagcuacuucuccaucaucuucuacgugguggucggcaucaucgugcuguuccucaucaucuacaucuuccugcccauguucuucaagcugaaggacgugcucaagcggaacgaguaccuguaccugcaggagcucaagcacaaguga

SEQ ID NO: 12540 - RNA, 4305 nt, Artificial Sequence
  derived and/or modified CDS sequence (opt1) from CVV(1156)__EU583730.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaucaagaacgacaccgggcuguucggccacaacaagguguuccggagcuggaccaucaaggacuggaagcugugcaacccgauccccaccgccgggggcacgaucaacgucaucgaggugaacaaggaccucucccugaugaccaagaccuacaucugcagccgcgacugcaccaucacgaucgacaaggaggaggcccagaucaucuuccagaccgacaagcugaaccacuucgagguguccggcaccacccucagcuccgggugguucaagagcaaggccuccgucacgcuggaccggaccugcgagcacgugaaggugaccugcggcaagaagucccugcaguuccacgcgugcuucaagcaccacaugagcugcguccgcuucuuccacaacaccauccuccccgggaacaugaucacgagcaugugccagaacaucgagcugaucaucauccugggccucacccuggccaucuucauccugauggugauccucaccaagaccuacaucugcuaccugcugaugcccaucuucaugccgaucgccuaccucuacgggugggccuacaacaaguccugcaagaagugcaacugcugcggccuggcguaccaccccuucacgaacugcggcagccacugcgugugcgggcugaaguucgaggccagcgaccggaugcgcauccaccgggaguccggccucugccagggguacaagagccugcgcaucgcccggcugcucugcaaguccaagggcagcucccuggucaucagcggccugcucuccaugcugauccugagcuucgugacccccaucgaggggaccaucaccuccuaccccgagagccgcaaguacacgcucgaggagaucaccgacguggucgagggccugguguccgagcagaacaucaaggaguacaucguguucuacaccagccuguucgggucccucauccugcugcucgccuucaucaugagcaucacccuguccaagaucacgagcauccuggccaagcggaacgucaucuacugcgaggagugcuccauguaccacagcaagcgcggcaucaaguacaacggggacuucaccaacaagugcggcuucugcacgugcaacgagcaggaggacaccgagggccucgugauccacaagaucuccaagcggugcaccuacaaguaccagcugaagugggcgaaggugcugaugaucacccucguccugcugcugaucgcccagaacaccauccucaucguggccgccgagaccgacugcuggacgaagaagucccuggacaucgacugcaucgggccgaugcuggacaucggcagcugcaccaacaagaacacccgcagcuacgacgccgaggcgcagaagcucgugagccaguccaagaucagccagcuggacgccgaccaggucucccugcucgggaacagcaucgacuccgccaucaaggccauccgggcccagaagaccuaccccaccaugcaccuccuggagacgaucuuccucaugaagaacugcgacuacuacaccagcuucaaccacaacuccggcuacagccaggcgaaguggcgccugaucgccaagaccgggcacuucgacaucugcucccggcacagcacccaccacuucugccgcugcaucaacgacggcacgaagugccagaacggcgacugggacuucgccggggagaugaacgagaccuacaacuccaagaacgacuucuacagccacgaccugaaccucuucuacaccaucuucgagaacgccuuccccggcaccacggagucccuguucuaccagcugauccagaagaagaacaccaccggggccagcaaggugcucggcaagcugaucaccaaguacgggaacaacaacauguucgucggcguguggaaguucggccaguaccugcucacgcugcccuacaucaacaacaccgagcugucccagaaccggcgccucaccauccugaccacgcaggagcugcucagccggagccacuccgggcgccaggagagcauguccaacgcgauccagggcagcaucaccaaggagugccacaacgccaagggggugggcugcaucuccccgcgcuucggcauccccaucgggaaccugaccgccugcggcgacagccccaacuacaagaucuacaagacccccgagaagcuguacaaguccaacaacaagggggaggucuggugcagcaacgacgugcacugccucaacgacuucgagccggccgacgaggagguggucaacaagaucaagaagcugacgugcuuccugaccgacguguccguggaggucgacaucuucagcguggcggccuccacgugcaagauggccgacaagggcgugugcaccgucaacggggccaaguggaacaucaucaagugcgacagcggccucuacuacuucaccgaccaccgggagggccaggacaccgggaacgacuucggcgaguacugcaucucccacagcugcaacaccgagcgcuuccccaucaaccccgacauccugaaggacugcaccugggaguuccacucccgcaagagcaaguacaucuccacgaucagccuggagucccucgaggaguuccggcgggccauggcggagaagcugagccacacccugaccaucuacaacuucaagcccaccgccaaccucccgcacauccgccccacguacaaguucaucaccgccaacgggguggagaacagcgacggcaucgaguccgccuacauccugagcuccauccccgcccucgggggcaucagcgugggcuacaacguccagaccaaggacaacuucccccugcuggacaucaucguguucaucaaguccgcggugauccggaccacguacaaccacaucuacgacaccgggccgaccaucggcaucaacacccagcacgacgagcacugcaccgggcccugccccgccgucgugccccacaaggagaacuggaugacguucagccaggagcgcaccucccgguggggcugcgaggaguucgggugccuggccaucaacaccggcugcguguucggcagcugccaggacaucauccacccggagaccaaggucuaccgcaaggccguggaggaggaggugguccucacggugugcaucaacuuccccgggaacaacuacugcaccgagaucaacgccaucgagcccaagaucaccgacgagaucgagcugcaguucaagaccguggacacgaagacccugccgaaccuccuggcgguccagaaccacaagcuguacuccggccagaucaacgaccucgggagcuucucccagggcugcgggaacgugcagaagaccaaccacagcauccugggcaugggcaccgugaaguucgacuacgucugccacggggccucccggaaggacgugaucgugcgccggugcuacaacaacaacuucgacagcugcaagcugcucaaggaggagacgucccugaucuucgccgacaaccacgagacccuggaggucgcccacaccaagcaccucaucggcgagcugcaguucaagaucaugcugggggacauccgcuacaagagcuucgcggagucccccgagcucgagaucgacgccaagugcgugggcugccccagcugcuucgaguccuacagcugcaacuuccagaucgugaccaacaucgacacggucugcagcguggagggccccugcacccuguuccacaaccggaucaucaucuccgccaacaagcagagcuacgggcugaagauguccugccagaccaagccgaaccagaacgaggaguucaucaucugcaaccgcaaguacagcgugcuguucaccacgaucgacaagaacgacaagaucgaggucaacaccggcgaccagaccuccuacaucuacgagaaggacagccggugcaagaccuggcugugccgcgugcgggacgaggggaucuccgugcuguucgagccccucaaggccuucuucggcagcuacuucuccaucaucuucuacgucgugaucgggaucaucgugcuguuccugaucaucuacaucuuccuccccauguucuucaagcugaaggacguccugaagcgcaacgaguaccucuaccugcaggagcugaagcacaaguga

SEQ ID NO: 12541 - RNA, 4305 nt, Artificial Sequence
  derived and/or modified CDS sequence (opt1) from CVV(6V633)__KX100134.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaucaagaacgacaccgggcuguucggccacaacaagguguuccggagcuggaccaucaaggacuggaagcugugcaacccgauccccaccgccgggggcacgaucaacgucaucgaggugaacaaggaccucucccugaugaccaagaccuacaucugcagccgcgacugcaccaucacgaucgacaaggaggaggcccagaucaucuuccagaccgacaagcugaaccacuucgagguguccggcaccacccucagcuccgggugguucaagagcaaggccuccgucacgcuggaccggaccugcgagcacgugaaggugaccugcggcaagaagucccugcaguuccacgcgugcuucaagcaccacaugagcugcguccgcuucuuccacaacaccauccuccccgggaacaugaucacgagcaugugccagaacaucgagcugaucaucauccugggccucacccuggccaucuucauccugauggugaugcucaccaagaccuacaucugcuaccugcugaugcccaucuucaugccgaucgccuaccucuacgggugggccuacaacaaguccugcaagaagugcaacugcugcggccuggcguaccaccccuucacgaacugcggcagccacugcgugugcgggcugaaguucgaggccagcgaccggaugcgcauccaccgggaguccggccucugccagggguacaagagccugcgcaucgcccggcugcucugcaaguccaagggcagcucccuggucaucagcggccugcucuccaugcugauccugagcuucgugacccccaucgaggggaccaucaccuccuaccccgagagccgcaaguacacgcucgaggagaucaccgacguggucgagggccugguguccgagcagaacaucaaggaguacaucguguucuacaccagccuguucgggucccucauccugcugcucgccuucaucaugagcaucacccuguccaagaucacgagcauccuggccaagcggaacgucaucuacugcgaggagugcuccauguaccacagcaagcgcggcaucaaguacaacggggacuucaccaacaagugcggcuucugcacgugcaacgagcaggaggacaccgagggccucgugauccacaagguguccaagcggugcaccuacaaguaccagcugaagugggcgaagguccugaugaucacccucgugcugcugcugaucgcccagaacaccauccucaucguggccgccgagaccgacugcuggacgaagaagucccuggacaucgacugcaucgggccgaugcuggacaucggcagcugcaccaacaagaacacccgcagcuacgacgccgaggcgcagaagcucgucagccaguccaagaucagccagcuggacgccgaccaggccucccugcucgggaacagcaucgacuccgccaucaaggccauccgggcgcagaagaccuaccccaccaugcaccuccuggagacgaucuuccucaugaagaacugcgacuacuacaccagcuucaaccacaacuccggcuacagccaggccaaguggcgccugaucgccaagaccgggcacuucgacaucugcucccggcacagcacccaccacuucugccgcugcaucaacgacggcacgaagugccagaacggcgacugggacuucgccggggagaugaacgagaccuacaacuccaagaacgacuucuacagccacgaccugaaccucuucuacaccaucuucgagaacgccuuccccggcaccacggagucccuguucuaccagcugauccagaagaagaacaccaccggggcgagcaaggugcucggcaagcugaucaccaaguacgggaacaacaacauguucgucggcaucuggaaguucggccaguaccugcucacgcugcccuacaucaacaacaccgagcugucccagaaccggcgccucaccauccuggccacccaggagcugcucagccggagccacuccgggcgccaggagagcauguccaacgccauccagggcagcaucacgaaggagugccacaacgccaagggggugggcugcaucuccccgcgcuucggcauccccaucgggaaccugaccgcgugcggcgacagccccaacuacaagaucuacaagacccccgagaagcuguacaaguccaacaacaagggggagguguggugcagcaacgacguccacugccucaacgacuucgagccggccgacgaggagguggugaacaagaucaagaagcugaccugcuuccugacggacgucuccguggagguggacaucuucagcgucgccgccuccacgugcaagauggccgacaagggcgugugcaccgugaacggggcgaaguggaacaucaucaagugcgacagcggccucuacuacuucaccgaccaccgggagggccaggacaccgggaacgacuucggcgaguacugcaucucccacagcugcaacaccgagcgcuuccccaucaaccccgacacccugaaggacugcaccugggaguuccacucccgcaagagcaaguacaucuccacgaucagccuggagucccucgaggaguuccggcgggccauggccgagaagcugagccacacccugaccaucuacaacuucaagcccaccgccaaccucccgcacauccgccccacguacaaguucaucaccgccaacggggucgagaacagcgacggcaucgaguccgcguacauccugagcuccauccccgcccucgggggcaucagcgugggcuacaacgugcagaccaaggacaacuucccccugcuggacaucaucgucuucaucaaguccgccgugauccggaccacguacaaccacaucuacgacaccgggccgaccaucggcaucaacacccagcacgacgagcacugcaccgggcccugccccgccguggucccccacaaggagaacuggaugacguucagccaggagcgcaccucccgguggggcugcgaggaguucgggugccuggccaucaacaccggcugcguguucggcagcugccaggacaucauccacccggagaccaagguguaccgcaaggcggucgaggaggagguggugcucacggucugcaucaacuuccccgggaacaacuacugcaccgagaucaacgccaucgagcccaagaucaccgacgagaucgagcugcaguucaagaccguggacacgaagacccugccgaaccuccuggccgugcagaaccacaagcuguacuccggccagaucaacgaccucgggagcuucucccagggcugcgggaacguccagaagaccaaccacagcauccugggcaugggcaccgugaaguucgacuacgugugccacggggccucccggaaggacgucaucgugcgccggugcuacaacaacaacuucgacagcugcaagcugcucaaggaggagacgucccugaucuucgcggacaaccacgagacccuggagguggcccacaccaagcaccucaucggcgagcugcaguucaagaucaugcugggggacauccgcuacaagagcuucgccgagucccccgagcucgagaucgacgccaagugcgucggcugccccagcugcuucgaguccuacagcugcaacuuccagaucgugaccaacaucgacacggugugcagcgucgagggccccugcacccuguuccacaaccggaucaucaucuccgccaacaagcagagcuacgggcugaagauguccugccagaccaagccgaaccagaacgaggaguucaucaucugcaaccgcaaguacagcgugcuguucaccacgaucgacaagaacgacaagaucgaggugaacaccggcgaccagaccuccuacaucuacgagaaggacagccggugcaagaccuggcugugccgcguccgggacgaggggaucuccgugcuguucgagccccucaaggcguucuucggcagcuacuucuccaucaucuucuacguggucguggggaucaucgugcuguuccugaucaucuacaucuuccuccccauguucuucaagcugaaggacguccugaagcgcaacgaguaccucuaccugcaggagcugaagcacaaguga

SEQ ID NO: 12542 - RNA, 4305 nt, Artificial Sequence
  derived and/or modified CDS sequence (opt1) from CVV(807270)__AF186243.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaucaagaacgacaccgggcuguucggccacaacaagguguuccggagcuggaccaucaaggacuggaagcugugcaacccgauccccaccgccgggggcacgaucaacgucaucgaggugaacaaggaccucucccugaugaccaagaccuacaucugcagccgcgacugcaccaucacgaucgacaaggaggaggcccagaucaucuuccagaccgacaagcugaaccacuucgagguguccggcaccacccucagcuccgggugguucaagagcaaggccuccgucacgcuggaccggaccugcgagcacgugaaggugaccugcggcaagaagucccugcaguuccacgcgugcuucaagcaccacaugagcugcguccgcuucuuccacaacaccauccuccccgggaacaugaucacgagcaugugccagaacaucgagcugaucaucauccugggccucacccuggccaucuucauccugauggugauccucaccaagaccuacaucugcuaccugcugaugcccaucuucaugccgaucgccuaccucuacgggugggccuacaacaaguccugcaagaagugcaacugcugcggccuggcguaccaccccuucacgaacugcggcagccacugcgugugcgggcugaaguucgaggccagcgaccggaugcgcauccaccgggaguccggccucugccagggguacaagagccugcgcaucgcccggcugcucugcaaguccaagggcagcucccuggucaucagcggccugcucuccaugcugauccugagcuucgugacccccaucgaggggaccaucaccuccuaccccgagagccgcaaguacacgcucgaggagaucaccgacguggucgagggccugguguccgagcagaacaucaaggaguacaucguguucuacaccagccuguucgggucccucauccugcugcucgccuucaucaugagcaucacccuguccaagaucacgagcauccuggccaagcggaacgucaucuacugcgaggagugcuccauguaccacagcaagcgcggcaucaaguacaacggggacuucaccaacaagugcggcuucugcacgugcaacgagcaggaggacaccgagggccucgugauccacaagguguccaagcggugcaccuacaaguaccagcugaagugggcgaagguccugaugaucacccucgugcugcugcugaucgcccagaacaccauccucaucguggccgccgagaccgacugcuggacgaagaagucccuggacaucgacugcaucgggccgaugcuggacaucggcagcugcaccaacaagaacacccgcagcuacgacgccgaggcgcagaagcucgucagccaguccaagaucagccagcuggacgccgaccaggugucccugcucgggaacagcaucgacuccgccaucaaggccauccgggcccagaagaccuaccccaccaugcaccuccuggagacgaucuuccugaugaagaacugcgacuacuacaccagcuucaaccacaacuccggcuacagccaggcgaaguggcgccugaucgccaagaccgggcacuucgacaucugcucccggcacagcacccaccacuucugccagugcaucaacgacggcacgaagugccagaacggcgacugggacuucgccggggagaugaacgagaccuacaacuccaagaacgacuucuacagccacgaccugaaccucuucuacaccaucuucgagaacgccuuccccggcaccacggagucccuguucuaccagcugauccagaagaagaacaccaccggggccagcaagguccucggcaagcugaucaccaaguacgggaacaacaacauguucgugggcguguggaaguucggccaguaccugcucacgcugcccuacaucaacaacaccgagcugucccagaaccgccggcucaccauccuggcgacccaggagcugcucagccgcagccacuccgggcggcaggagagcauguccaacgccauccagggcagcaucacgaaggagugccacaacgccaagggggucggcugcaucuccccgcgcuucggcauccccaucgggaaccugaccgccugcggcgacagccccaacuacaagaucuacaagacccccgagaagcuguacaaguccaacaacaagggggagguguggugcagcaacgacgugcacugccucaacgacuucgagccggcggacgaggaggucgugaacaagaucaagaagcugaccugcuuccugacggacguguccgucgagguggacaucuucagcguggccgccuccacgugcaagauggccgacaagggcgucugcaccgugaacggggccaaguggaacaucaucaagugcgacagcggccucuacuacuucaccgaccaccgcgagggccaggacaccgggaacgacuucggcgaguacugcaucucccacagcugcaacaccgagcgguuccccaucaaccccgacauccugaaggacugcaccugggaguuccacucccgcaagagcaaguacaucuccaccaucagccuggagucccucgaggaguuccggcgcgcgauggccgagaagcugagccacacgcugaccaucuacaacuucaagcccaccgccaaccucccgcacauccggcccaccuacaaguucaucacggccaacgggguggagaacagcgacggcaucgaguccgccuacauccugagcuccauccccgcgcucgggggcaucagcgucggcuacaacgugcagaccaaggacaacuucccccugcuggacaucaucguguucaucaaguccgccgucauccgcaccaccuacaaccacaucuacgacacggggccgaccaucggcaucaacacccagcacgacgagcacugcaccgggcccugccccgccguggugccccacaaggagaacuggaugaccuucagccaggagcggacgucccgcuggggcugcgaggaguucgggugccuggccaucaacaccggcugcgucuucggcagcugccaggacaucauccacccggagaccaagguguaccggaaggccguggaggaggaggucgugcucaccgugugcaucaacuuccccgggaacaacuacugcacggagaucaacgcgaucgagcccaagaucaccgacgagaucgagcugcaguucaagaccgucgacaccaagacgcugccgaaccuccuggccgugcagaaccacaagcuguacuccggccagaucaacgaccucgggagcuucucccagggcugcgggaacgugcagaagaccaaccacagcauccugggcaugggcaccgucaaguucgacuacgugugccacggggccucccgcaaggacgugaucguccggcgcugcuacaacaacaacuucgacagcugcaagcugcucaaggaggagaccucccugaucuucgccgacaaccacgagacgcuggagguggcgcacaccaagcaccucaucggcgagcugcaguucaagaucaugcugggggacauccgguacaagagcuucgccgagucccccgagcucgagaucgacgccaagugcgugggcugccccagcugcuucgaguccuacagcugcaacuuccagaucgucaccaacaucgacaccgugugcagcguggagggccccugcacgcuguuccacaaccgcaucaucaucuccgccaacaagcagagcuacgggcugaagauguccugccagaccaagccgaaccagaacgaggaguucaucaucugcaaccggaaguacagcguccucuucaccaccaucgacaagaacgacaagaucgaggugaacacgggcgaccagaccuccuacaucuacgagaaggacagccgcugcaagaccuggcugugccgggugcgcgacgaggggaucuccguccuguucgagccccucaaggccuucuucggcagcuacuucuccaucaucuucuacgugguggucgggaucaucgugcuguuccugaucaucuacaucuuccuccccauguucuucaagcugaaggacgugcugaagcggaacgaguaccucuaccugcaggagcugaagcacaaguga

SEQ ID NO: 12543 - RNA, 4305 nt, Artificial Sequence
  derived and/or modified CDS sequence (opt1) from CVV(856 clone 1)__EU583732.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaucaagaacgacaccgggcuguucggccacaacaagguguuccggagcuggaccaucaaggacuggaagcugugcaacccgauccccaccgccgggggcacgaucaacgucaucgaggugaacaaggaccucucccugaugaccaagaccuacaucugcagccgcgacugcaccaucacgaucgacaaggaggaggcccagaucaucuuccagaccgacaagcugaaccacuucgagguguccggcaccacccucagcuccgggugguucaagagcaaggccuccgucacgcuggaccggaccugcgagcacgugaaggugaccugcggcaagaagucccugcaguuccacgcgugcuucaagcaccacaugagcugcguccgcuucuuccacaacaccauccuccccgggaacaugaucgccagcaugugccagaacaucgagcugaucaucauccugggccucacgcuggccaucuucauccugauggugauccucaccaagaccuacaucugcuaccugcugaugcccaucuucaugccgaucgccuaccucuacgggugggcguacaacaaguccugcaagaagugcaacugcugcggccuggccuaccaccccuucaccaacugcggcagccacugcgugugcgggcugaaguucgaggccagcgaccggaugcgcauccaccgggaguccggccucugccagggguacaagagccugcgcaucgcccggcugcucugcaaguccaagggcagcucccuggucaucagcggccugcucuccaugcugauccugagcuucgugacgcccaucgaggggaccaucaccuccuaccccgagagccgcaaguacacccucgaggagaucacggacguggucgagggccugguguccgagcagaacaucaaggaguacaucguguucuacaccagccuguucgggucccucauccugcugcucgccuucaucaugagcaucacccuguccaagaucaccagcauccuggcgaagcggaacgucaucuacugcgaggagugcuccauguaccacagcaagcgcggcaucaaguacaacggggacuucacgaacaagugcggcuucugcacgugcaacgagcaggaggacaccgagggccucgugauccacaagguguccaagcggugcaccuacaaguaccagcugaagugggccaagguccugaugaucacccucgugcugcugcugaucgcccagaacaccauccucaucguggccgccgagaccgacugcuggaucaagaagucccuggacaucgacugcaucgggccgaugcuggacaucggcagcugcaccaacaagaacacgcgcagcuacgacgcggaggcccagaagcucgucagccaguccaagaucagccagcuggacgccgaccaggugucccugcucgggaacagcaucgacuccgccaucaaggccauccgggcgcagaagaccuaccccaccaugcaccuccuggagaccaucuuccugaugaagaacugcgacuacuacaccagcuucaaccacaacuccggcuacagccaggccaaguggcgccugaucgccaagacggggcacuucgacaucugcucccggcacagcacccaccacuucugccgcugcaucaacgacggcaccaagugccagaacggcgacugggacuucgccggggagaugaacgagaccuacaacuccaagaacgacuucuacagccacgaccugaaccucuucuacacgaucuucgagaacgccuuccccggcaccaccgagucccuguucuaccagcugauccagcggaagaacaccacgggggcgagcaagguccucggcaagcugaucaccaaguacgggaacaacaacauguucgugggcguguggaaguucggccaguaccugcucacccugcccuacaucaacaacaccgagcugucccagaaccgccggcucacgauccugaccacccaggagcugcucagccgcagccacuccgggcgccaggagagcauguccaacgccauccagggcagcaucaccaaggagugccacaacgccaagggggucggcugcaucuccccgcgguucggcauccccaucgggaaccugacggccugcggcgacagccccaacuacaagaucuacaagacccccgagaagcuguacaaguccaacaacaagggggagguguggugcagcaacgacgugcacugccucaacgacuucgagccggcggacgaggaggucgugaacaagaucaagaagcugaccugcuuccugaccgacguguccgucgagguggacaucuucagcguggccgccuccacgugcaagauggccgacaagggcgucugcaccgugaacggggccaaguggaacaucaucaagugcgacagcggccucuacuacuucaccgaccaccgcgagggccaggacaccgggaacgacuucggcgaguacugcaucucccacagcugcaacacggagcgguuccccaucaaccccgacauccugaaggacugcaccugggaguuccacucccgcaagagcaaguacaucuccaccaucagccuggagucccucgaggaguuccggcgcgcgauggccgagaagcugagccacacccugacgaucuacaacuucaagcccaccgccaaccucccgcacauccggcccaccuacaaguucaucaccgccaacgggguggagaacagcgacggcaucgaguccgccuacauccugagcuccauccccgcgcucgggggcaucagcgucggcuacaacgugcagacgaaggacaacuucccccugcuggacaucaucguguucaucaaguccgccgucauccgcaccaccuacaaccacaucuacgacaccgggccgacgaucggcaucaacacccagcacgacgagcacugcaccgggcccugccccgccguggugccccacaaggagaacuggaugaccuucagccaggagcggaccucccgcuggggcugcgaggaguucgggugccuggccaucaacacgggcugcgucuucggcagcugccaggacaucauccacccggagaccaagguguaccggaaggccguggaggaggaggucgugcucaccgugugcaucaacuuccccgggaacaacuacugcaccgagaucaacgcgaucgagcccaagaucacggacgagaucgagcugcaguucaagaccgucgacaccaagacccugccgaaccuccuggccgugcagaaccacaagcuguacuccggccagaucaacgaccucgggagcuucucccagggcugcgggaacgugcagaagacgaaccacagcauccugggcaugggcaccgucaaguucgacuacgugugccacggggccucccgcaaggacgugaucguccggcgcugcuacaacaacaacuucgacagcugcaagcugcucaaggaggagaccucccugaucuucgccgacaaccacgagacccuggagguggcgcacacgaagcaccucaucggcgagcugcaguucaagaucaugcugggggacauccgguacaagagcuucgccgagucccccgagcucgagaucgacgccaagugcgugggcugccccagcugcuucgaguccuacagcugcaacuuccagaucgucaccaacaucgacaccgugugcagcguggagggccccugcacccuguuccacaaccgcaucaucaucuccgccaacaagcagagcuacgggcugaagauguccugccagacgaagccgaaccagaacgaggaguucaucaucugcaaccggaaguacagcguccucuucaccaccaucgacaagaacgacaagaucgaggugaacaccggcgaccagacguccuacaucuacgagaaggacagccgcugcaagaccuggcugugccgggugcgcgacgaggggaucuccguccuguucgagccccucaaggccuucuucggcagcuacuucuccaucaucuucuacguggugaucgggaucaucguccuguuccugaucaucuacaucuuccuccccauguucuucaagcugaaggacgugcugaagcgcaacgaguaccucuaccugcaggagcugaagcacaaguga

SEQ ID NO: 12544 - RNA, 4305 nt, Artificial Sequence
  derived and/or modified CDS sequence (opt1) from CVV(856 clone 3)__EU583731.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaucaagaacgacaccgggcuguucggccacaacaagguguuccggagcuggaccaucaaggacuggaagcugugcaacccgauccccaccgccgggggcacgaucaacgucaucgaggugaacaaggaccucucccugaugaccaagaccuacaucugcagccgcgacugcaccaucacgaucgacaaggaggaggcccagaucaucuuccagaccgacaagcugaaccacuucgagguguccggcaccacccucagcuccgggugguucaagagcaaggccuccgucacgcuggaccggaccugcgagcacgugaaggugaccugcggcaagaagucccugcaguuccacgcgugcuucaagcaccacaugagcugcguccgcuucuuccacaacaccauccuccccgggaacaugaucgccagcaugugccagaacaucgagcugaucaucauccugggccucacgcuggccaucuucauccugauggugauccucaccaagaccuacaucugcuaccugcugaugcccaucuucaugccgaucgccuaccucuacgggugggcguacaacaaguccugcaagaagugcaacugcugcggccuggccuaccaccccuucaccaacugcggcagccacugcgugugcgggcugaaguucgaggccagcgaccggaugcgcauccaccgggaguccggccucugccagggguacaagagccugcgcaucgcccggcugcucugcaaguccaagggcagcucccuggucaucagcggccugcucuccaugcugauccugagcuucgugacgcccaucgaggggaccaucaccuccuaccccgagagccgcaaguacacccucgaggagaucacggacguggucgagggccugguguccgagcagaacaucaaggaguacaucguguucuacaccagccuguucgggucccucauccugcugcucgccuucaucaugagcaucacccuguccaagaucaccagcauccuggcgaagcggaacgucaucuacugcgaggagugcuccauguaccacagcaagcgcggcaucaaguacaacggggacuucacgaacaagugcggcuucugcacgugcaacgagcaggaggacaccgagggccucgugauccacaagguguccaagcggugcaccuacaaguaccagcugaagugggccaagguccugaugaucacccucgugcugcugcugaucgcccagaacaccauccucaucguggccgccgagaccgacugcuggaucaagaagucccuggacaucgacugcaucgggccgaugcuggacaucggcagcugcaccaacaagaacacgcgcagcuacgacgcggaggcccagaagcucgucagccaguccaagaucagccagcuggacgccgaccaggugucccugcucgggaacagcaucgacuccgccaucaaggccauccgggcgcagaagaccuaccccaccaugcaccuccuggagaccaucuuccugaugaagaacugcgacuacuacaccagcuucaaccacaacuccggcuacagccaggccaaguggcgccugaucgccaagacggggcacuucgacaucugcucccggcacagcacccaccacuucugccgcugcaucaacgacggcaccaagugccagaacggcgacugggacuucgccggggagaugaacgagaccuacaacuccaagaacgacuucuacagccacgaccugaaccucuucuacacgaucuucgagaacgccuuccccggcaccaccgagucccuguucuaccagcugauccagcggaagaacaccacgggggcgagcaagguccucggcaagcugaucaccaaguacgggaacaacaacauguucgugggcguguggaaguucggccaguaccugcucacccugcccuacaucaacaacaccgagcugucccagaaccgccggcucacgauccugaccacccacgagcugcucagccgcagccacuccgggcgccaggagagcauguccaacgccauccagggcagcaucaccaaggagugccacaacgccaagggggucggcugcaucuccccgcgguucggcauccccaucgggaaccugacggccugcggcgacagccccaacuacaagaucuacaagacccccgagaagcuguacaaguccaacaacaagggggagguguggugcagcaacgacgugcacugccucaacgacuucgagccggcggacgaggaggucgugaacaagaucaagaagcugaccugcuuccugaccgacguguccgucgagguggacaucuucagcguggccgccuccacgugcaagauggccgacaagggcgucugcaccgugaacggggccaaguggaacaucaucaagugcgacagcggccucuacuacuucaccgaccaccgcgagggccaggacaccgggaacgacuucggcgaguacugcaucucccacagcugcaacacggagcgguuccccaucaaccccgacauccugaaggacugcaccugggaguuccacucccgcaagagcaaguacaucuccaccaucagccuggagucccucgaggaguuccggcgcgcgauggccgagaagcugagccacacccugacgaucuacaacuucaagcccaccgccaaccucccgcacauccggcccaccuacaaguucaucaccgccaacgggguggagaacagcgacggcaucgaguccgccuacauccugagcuccauccccgcgcucgggggcaucagcgucggcuacaacgugcagacgaaggacaacuucccccugcuggacaucaucguguucaucaaguccgccgucauccgcaccaccuacaaccacaucuacgacaccgggccgacgaucggcaucaacacccagcacgacgagcacugcaccgggcccugccccgccguggugccccacaaggagaacuggaugaccuucagccaggagcggaccucccgcuggggcugcgaggaguucgggugccuggccaucaacacgggcugcgucuucggcagcugccaggacaucauccacccggagaccaagguguaccggaaggccguggaggaggaggucgugcucaccgugugcaucaacuuccccgggaacaacuacugcaccgagaucaacgcgaucgagcccaagaucacggacgagaucgagcugcaguucaagaccgucgacaccaagacccugccgaaccuccuggccgugcagaaccacaagcuguacuccggccagaucaacgaccucgggagcuucucccagggcugcgggaacgugcagaagacgaaccacagcauccugggcaugggcaccgucaaguucgacuacgugugccacggggccucccgcaaggacgugaucguccggcgcugcuacaacaacaacuucgacagcugcaagcugcucaaggaggagaccucccugaucuucgccgacaaccacgagacccuggagguggcgcacacgaagcaccucaucggcgagcugcaguucaagaucaugcugggggacauccgguacaagagcuucgccgagucccccgagcucgagaucgacgccaagugcgugggcugccccagcugcuucgaguccuacagcugcaacuuccagaucgucaccaacaucgacaccgugugcagcguggagggccccugcacccuguuccacaaccgcaucaucaucuccgccaacaagcagagcuacgggcugaagauguccugccagacgaagccgaaccagaacgaggaguucaucaucugcaaccggaaguacagcguccucuucaccaccaucgacaagaacgacaagaucgaggugaacaccggcgaccagacguccuacaucuacgagaaggacagccgcugcaagaccuggcugugccgggugcgcgacgaggggaucuccguccuguucgagccccucaaggccuucuucggcagcuacuucuccaucaucuucuacguggugaucgggaucaucguccuguuccugaucaucuacaucuuccuccccauguucuucaagcugaaggacgugcugaagcgcaacgaguaccucuaccugcaggagcugaagcacaaguga

SEQ ID NO: 12545 - RNA, 4305 nt, Artificial Sequence
  derived and/or modified CDS sequence (opt1) from CVV(CK102)__AF186242.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaucaagaacgacaccgggcuguucggccacaacaagguguuccggagcuggaccaucaaggacuggaagcugugcaacccgauccccaccgccgggggcacgaucaacgucaucgaggugaacaaggaccucucccugaugaccaagaccuacaucugcagccgcgacugcaccaucacgaucgacaaggaggaggcccagaucaucuuccagaccgacaagcugaaccacuucgagguguccggcaccacccucagcuccgggugguucaagagcaaggccuccgucacgcuggaccggaccugcgagcacgugaaggugaccugcggcaagaagucccugcaguuccacgcgugcuucaagcaccacaugagcugcguccgcuucuuccacaacaccauccuccccgggaacaugaucacgagcaugugccagaacaucgagcugaucaucauccugggccucacccuggccaucuucauccugauggugauccucaccaagaccuacaucugcuaccugcugaugcccaucuucaugccgaucgccuaccucuacgggugggccuacaacaaguccugcaagaagugcaacugcugcggccuggcguaccaccccuucacgaacugcggcagccacugcgugugcgggcugaaguucgaggccagcgaccggaugcgcauccaccgggaguccggccucugccagggguacaagagccugcgcaucgcccggcugcucugcaaguccaagggcagcucccuggucgugagcggccugcucuccaugcugauccugagcuucgugacccccaucgaggggaccaucaccuccuaccccgagagccgcaaguacacgcucgaggagaucaccgacgucguggagggccugguguccgagcagaacaucaaggaguacaucgucuucuacaccagccuguucgggucccucauccugcugcucgccuucaucaugagcaucacccuguccaagaucacgagcauccuggccaagcggaacgugaucuacugcgaggagugcuccauguaccacagcaagcgcggcaucaaguacaacggggacuucaccaacaagugcggcuucugcacgugcaacgagcaggaggacaccgagggccucgugauccacaaggucuccaagcggugcaccuacaaguaccagcugaagugggcgaaggugcugaugaucacccucgugcugcugcugaucgcccagaacaccauccucaucgucgccgccgagaccgacugcuggacgaagaagucccuggacaucgacugcaucgggccgaugcuggacaucggcagcugcaccaacaagaacacccgcagcuacgacaccgaggcccagaagcucgugagccaguccaagaucagccagcuggacgcggaccaggucucccugcucgggaacagcaucgacuccgccaucaaggccauccgggcccagaagaccuaccccacgaugcaccuccuggagaccaucuuccucaugaagaacugcgacuacuacaccagcuucaaccacaacuccggcuacagccaggccaaguggcgccugaucgcgaagaccgggcacuucgacaucugcucccggcacagcacgcaccacuucugccgcugcaucaacgacggcaccaagugccagaacggcgacugggacuucgccggggagaugaacgagaccuacaacuccaagaacgacuucuacagccacgaccugaaccucuucuacaccaucuucgagaacgccuuccccggcacgaccgagucccuguucuaccagcugauccagaagaagaacaccaccggggccagcaaggugcucggcaagcugaucacgaaguacgggaacaacaacauguucgugggcgucuggaaguucggccaguaccugcucacccugcccuacaucaacaacaccgagcugucccagaaccggcgccucaccauccuggccacgcaggagcugcucagccggagccacuccgggcgccaggagagcauguccaacgcgauccagggcagcaucaccaaggagugccacaacgccaagggggugggcugcaucuccccgcgcuucggcauccccaucgggaaccugaccgccugcggcgacagccccaacuacaagaucuacaagacccccgagaagcuguacaaguccaacaacaagggggagguguggugcagcaacgacguccacugccucaacgacuucgagccggccgacgaggagguggugaacaagaucaagaagcugacgugcuuccugaccgacgucuccguggagguggacaucuucagcgucgcggccuccacgugcaagauggccgacaagggcgugugcaccgugaacggggccaaguggaacaucaucaagugcgacagcggccucuacuacuucaccgaccaccgggagggccaggacaccgggaacgacuucggcgaguacugcaucucccacagcugcaacaccgagcgcuuccccaucaaccccgacauccugaaggacugcaccugggaguuccacucccgcaagagcaaguacaucuccacgaucagccuggagucccucgaggaguuccggcgggccauggcggagaagcugagccacacccugaccaucuacaacuucaagcccaccgccaaccucccgcacauccgccccacguacaaguucaucaccgccaacggggucgagaacagcgacggcaucgaguccgccuacauccugagcuccauccccgcccucgggggcaucagcgugggcuacaacgugcagaccaaggacaaccugccccugcuggacaucaucgucuucaucaaguccgcggugauccggaccacguacaaccacaucuacgacaccgggccgaccaucggcaucaacacccagcacgacgagcacugcaccgggcccugccccgccguggucccccacaaggagaacuggaugacguucagccaggagcgcaccucccgguggggcugcgaggaguucgggugccucgccaucaacaccggcugcguguucggcagcugccaggacaucauccacccggagaccaagguguaccgcaaggccgucgaggaggagguggugcugacggucugcaucaacuuccccgggaacaacuacugcaccgagaucaacgccaucgagcccaagaucaccgacgagaucgagcugcaguucaagaccguggacacgaagacccucccgaaccugcuggcggugcagaaccacaagcucuacuccggccagaucaacgaccuggggagcuucucccagggcugcgggaacguccagaagaccaaccacagcauccugggcaugggcaccgugaaguucgacuacgugugccacggggccucccggaaggacgucaucgugcgccggugcuacaacaacaacuucgacagcugcaagcuccugaaggaggagacgucccugaucuucgccgacaaccacgagacccucgagguggcccacaccaagcaccugaucggcgagcugcaguucaagaucaugcucggggacauccgcuacaagagcuucgcggagucccccgagcuggagaucgacgccaagugcgucggcugccccagcugcuucgaguccuacagcugcaacuuccagaucgugaccaacaucgacacggugugcagcgucgagggccccugcacccuguuccacaaccggaucaucaucuccgccaacaagcagagcuacgggcucaagauguccugccagaccaagccgaaccagaacgaggaguucaucaucugcaaccgcaaguacagcgugcuguucaccacgaucgacaagaacgacaagaucgaggugaacaccggcgaccagaccuccuacaucuacgagaaggacagccggugcaagaccuggcugugccgcguccgggacgaggggaucuccgugcuguucgagccccugaaggccuucagcggcuccuacuucagcaucaucuucuacguggucguggggaucaucgugcuguuccucaucaucuacaucuuccugcccauguucuucaagcugaaggacguccucaagcgcaacgaguaccuguaccugcaggagcucaagcacaaguga

SEQ ID NO: 12546 - RNA, 4305 nt, Artificial Sequence
  derived and/or modified CDS sequence (opt1) from CVV(CK-102)__KX100146.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaucaagaacgacaccgggcuguucggccacaacaagguguuccggagcuggaccaucaaggacuggaagcugugcaacccgauccccaccgccgggggcacgaucaacgucaucgaggugaacaaggaccucucccugaugaccaagaccuacaucugcagccgcgacugcaccaucacgaucgacaaggaggaggcccagaucaucuuccagaccgacaagcugaaccacuucgagguguccggcaccacccucagcuccgggugguucaagagcaaggccuccgucacgcuggaccggaccugcgagcacgugaaggugaccugcggcaagaagucccugcaguuccacgcgugcuucaagcaccacaugagcugcguccgcuucuuccacaacaccauccuccccgggaacaugaucacgagcaugugccagaacaucgagcugaucaucauccugggccucacccuggccaucuucauccugauggugauccucaccaagaccuacaucugcuaccugcugaugcccaucuucaugccgaucgccuaccucuacgggugggccuacaacaaguccugcaagaagugcaacugcugcggccuggcguaccaccccuucacgaacugcggcagccacugcgugugcgggcugaaguucgaggccagcgaccggaugcgcauccaccgggaguccggccucugccagggguacaagagccugcgcaucgcccggcugcucugcaaguccaagggcagcucccuggucgugagcggccugcucuccaugcugauccugagcuucgugacccccaucgaggggaccaucaccuccuaccccgagagccgcaaguacacgcucgaggagaucaccgacgucguggagggccugguguccgagcagaacaucaaggaguacaucgucuucuacaccagccuguucgggucccucauccugcugcucgccuucaucaugagcaucacccuguccaagaucacgagcauccuggccaagcggaacgugaucuacugcgaggagugcuccauguaccacagcaagcgcggcaucaaguacaacggggacuucaccaacaagugcggcuucugcacgugcaacgagcaggaggacaccgagggccucgugauccacaaggucuccaagcggugcaccuacaaguaccagcugaagugggcgaaggugcugaugaucacccucgugcugcugcugaucgcccagaacaccauccucaucgucgccgccgagaccgacugcuggacgaagaagucccuggacaucgacugcaucgggccgaugcuggacaucggcagcugcaccaacaagaacacccgcagcuacgacaccgaggcccagaagcucgugagccaguccaagaucagccagcuggacgcggaccaggucucccugcucgggaacagcaucgacuccgccaucaaggccauccgggcccagaagaccuaccccacgaugcaccuccuggagaccaucuuccucaugaagaacugcgacuacuacaccagcuucaaccacaacuccggcuacagccaggccaaguggcgccugaucgcgaagaccgggcacuucgacaucugcucccggcacagcacgcaccacuucugccgcugcaucaacgacggcaccaagugccagaacggcgacugggacuucgccggggagaugaacgagaccuacaacuccaagaacgacuucuacagccacgaccugaaccucuucuacaccaucuucgagaacgccuuccccggcacgaccgagucccuguucuaccagcugauccagaagaagaacaccaccggggccagcaaggugcucggcaagcugaucacgaaguacgggaacaacaacauguucgugggcgucuggaaguucggccaguaccugcucacccugcccuacaucaacaacaccgagcugucccagaaccggcgccucaccauccuggccacgcaggagcugcucagccggagccacuccgggcgccaggagagcauguccaacgcgauccagggcagcaucaccaaggagugccacaacgccaaggggguggagugcaucuccccgcgcuucggcauccccaucggcaaccugaccgccugcggggacagccccaacuacaagaucuacaagacccccgagaagcuguacaaguccaacaacaagggcgagguguggugcagcaacgacguccacugccucaacgacuucgagccggccgacgaggagguggugaacaagaucaagaagcugacgugcuuccugaccgacgucuccguggagguggacaucuucagcgucgcggccuccacgugcaagauggccgacaagggggugugcaccgugaacggcgccaaguggaacaucaucaagugcgacagcgggcucuacuacuucaccgaccaccgggagggccaggacaccggcaacgacuucggggaguacugcaucucccacagcugcaacaccgagcgcuuccccaucaaccccgacauccugaaggacugcaccugggaguuccacucccgcaagagcaaguacaucuccacgaucagccuggagucccucgaggaguuccggcgggccauggcggagaagcugagccacacccugaccaucuacaacuucaagcccaccgccaaccucccgcacauccgccccacguacaaguucaucaccgccaacggcgucgagaacagcgacgggaucgaguccgccuacauccugagcuccauccccgcccugggcgggaucagcgugggcuacaacgugcagaccaaggacaaccucccccugcuggacaucaucgucuucaucaaguccgcggugauccggaccacguacaaccacaucuacgacaccggcccgaccaucgggaucaacacccagcacgacgagcacugcaccggccccugccccgccguggucccccacaaggagaacuggaugacguucagccaggagcgcaccucccggugggggugcgaggaguucggcugccucgccaucaacaccgggugcguguucggcagcugccaggacaucauccacccggagaccaagguguaccgcaaggccgucgaggaggagguggugcugacggucugcaucaacuuccccggcaacaacuacugcaccgagaucaacgccaucgagcccaagaucaccgacgagaucgagcugcaguucaagaccguggacacgaagacccucccgaaccugcuggcggugcagaaccacaagcucuacuccgggcagaucaacgaccugggcagcuucucccaggggugcggcaacguccagaagaccaaccacagcauccuggggaugggcaccgugaaguucgacuacgugugccacggcgccucccggaaggacgucaucgugcgccggugcuacaacaacaacuucgacagcugcaagcuccugaaggaggagacgucccugaucuucgccgacaaccacgagacccucgagguggcccacaccaagcaccugaucggggagcugcaguucaagaucaugcucggcgacauccgcuacaagagcuucgcggagucccccgagcuggagaucgacgccaagugcgucgggugccccagcugcuucgaguccuacagcugcaacuuccagaucgugaccaacaucgacacggugugcagcgucgagggccccugcacccuguuccacaaccggaucaucaucuccgccaacaagcagagcuacggccucaagauguccugccagaccaagccgaaccagaacgaggaguucaucaucugcaaccgcaaguacagcgugcuguucaccacgaucgacaagaacgacaagaucgaggugaacaccggggaccagaccuccuacaucuacgagaaggacagccggugcaagaccuggcugugccgcguccgggacgagggcaucuccgugcuguucgagccccugaaggccuucuucgggagcuacuucuccaucaucuucuacguggucgugggcaucaucgugcuguuccucaucaucuacaucuuccugcccauguucuucaagcugaaggacguccucaagcgcaacgaguaccuguaccugcaggagcucaagcacaaguga

SEQ ID NO: 12547 - RNA, 4305 nt, Artificial Sequence
  derived and/or modified CDS sequence (opt1) from CVV(MI80-1-450)__AF186241.1__GP
augcuguuccuccugauccuggccuuccucggcuucagcaccuccaaccccaucgccacccgcugcuuccacgggggccaccugaucgcggagagcaaguccgccacgagcaucuccgaguucugccugaaggacgacgugagcaugcucaaguccgaggucguguacaucaagaacgacaccgggcuguucggccacaacaagguguuccggagcuggaccaucaaggacuggaagcugugcaacccgauccccaccgccgggggcacgaucaacgucaucgaggugaacaaggaccucucccugaugaccaagaccuacaucugcagccgcgacugcaccaucacgaucgacaaggaggaggcccagaucaucuuccagaccgacaagcugaaccacuucgagguguccggcaccacccucagcuccgggugguucaagagcaaggccuccgucacgcuggaccggaccugcgagcacgugaaggugaccugcggcaagaagucccugcaguuccacgcgugcuucaagcaccacaugagcugcguccgcuucuuccacaacaccauccuccccgggaacaugaucacgagcaugugccagaacaucgagcugaucaucauccugggccucacccuggccaucuucauccugauggugauccucaccaagaccuacaucugcuaccugcugaugcccaucuucaugccgaucgccuaccucuacgggugggccuacaacaaguccugcaagaagugcaacugcugcggccuggcguaccaccccuucacgaacugcggcagccacugcgugugcgggcugaaguucgaggccagcgaccggaugcgcauccaccgggaguccggccucugccagggguacaagagccugcgcaucgcccggcugcucugcaaguccaagggcagcucccuggucaucagcggccugcucuccaugcugauccugagcuucgugacccccaucgaggggaccaucaccuccuaccccgagagccgcaaguacacgcucgaggagaucaccgacguggucgagggccugguguccgagcagaacaucaaggaguacaucguguucuacaccagccuguucgggucccucauccugcugcucgccuucaucaugagcaucacccuguccaagaucacgagcauccuggccaagcggaacgucaucuacugcgaggagugcuccauguaccacagcaagcgcggcaucaaguacaacggggacuucaccaacaagugcggcuucugcacgugcaacgagcaggaggacaccgagggccucgugauccacaagguguccaagcggugcaccuacaaguaccagcugaagugggcgaagguccugaugaucacccucgugcugcugcugaucgcccagaacaccauccucaucguggccgccgagaccgacugcuggacgaagaagucccuggacaucgacugcaucgggccgaugcuggacaucggcagcugcaccaacaagaacacccgcagcuacgacgccgaggcgcagaagcucgucagccaguccaagaucagccagcuggacgccgaccaggugucccugcucgggaacagcaucgacuccgccaucaaggccauccgggcccagaagaccuaccccaccaugcaccuccuggagacgaucuuccugaugaagaacugcgacuacuacaccagcuucaaccacaacuccggcuacagccaggcgaaguggcgccugaucgccaagaccgggcacuucgacaucugcucccggcacagcacccaccacuucugccgcugcaucaacgacggcacgaagugccagaacggcaacugggacuucgccggggagaugaacgagaccuacaacuccaagaacgacuucuacagccacgaccugaaccucuucuacaccaucuucgagaacgccuuccccggcaccacggagucccuguucuaccagcugauccagaagaagaacaccaccggggccagccagguccucggcaagcugaucaccaaguacgggaacaacaacauguucgugggcguguggaaguucggccaguaccugcucacgcugcccuacaucaacaacaccgagcugucccagaaccggcgccucaccauccuggcgacccaggagcugcucagccggagccacuccgggcgccaggagagcauguccaacgccauccagggcagcaucacgaaggagugccacaacgccaagggggucggcugcaucuccccgcgcuucggcauccccaucgggaaccugaccgccugcggcgacagccccaacuacaagaucuacaagacccccgagaagcuguacaaguccaacaacaagggggagguguggugcagcaacgacgugcacugccucaacgacuucgagccggcggacgaggaggucgugaacaagaucaagaagcugaccugcuuccugacggacguguccgucgagguggacaucuucagcguggccgccuccacgugcaagauggccgacaagggcgucugcaccgugaacggggccaaguggaacaucaucaagugcgacagcggccucuacuacuucaccgaccaccgggagggccaggacaccgggaacgacuucggcgaguacugcaucucccacagcugcaacaccgagcgcuuccccaucaaccccgacauccugaaggacugcaccugggaguuccacucccgcaagagcaaguacaucuccaccaucagccuggagucccucgaggaguuccggcgggcgauggccgagaagcugagccacacgcugaccaucuacaacuucaagcccaccgccaaccucccgcacauccgccccaccuacaaguucaucacggccaacgggguggagaacagcgacggcaucgaguccgccuacauccugagcuccauccccgcgcucgggggcaucagcgucggcuacaacgugcagaccaaggacaacuucccccugcuggacaucaucguguucaucaaguccgccgucauccggaccaccuacaaccacaucuacgacacggggccgaccaucggcaucaacacccagcacgacgagcacugcaccgggcccugccccgccguggugccccacaaggagaacuggaugaccuucagccaggagcgcacgucccgguggggcugcgaggaguucgggugccuggccaucaacaccggcugcgucuucggcagcugccaggacaucauccacccggagaccaagguguaccgcaaggccguggaggaggaggucgugcucaccgugugcaucaacuuccccgggaacaacuacugcacggagaucaacgcgaucgagcccaagaucaccgacgagaucgagcugcaguucaagaccgucgacaccaagacgcugccgaaccuccuggccgugcagaaccacaagcuguacuccggccagaucaacgaccucgggagcuucucccagggcugcgggaacgugcagaagaccaaccacagcauccugggcaugggcaccgucaaguucgacuacgugugccacggggccucccggaaggacgugaucguccgccggugcuacaacaacaacuucgacagcugcaagcugcucaaggaggagaccucccugaucuucgccgacaaccacgagacgcuggagguggcgcacaccaagcaccucaucggcgagcugcaguucaagaucaugcugggggacauccgcuacaagagcuucgccgagucccccgagcucgagaucgacgccaagugcgugggcugccccagcugcuucgaguccuacagcugcaacuuccagaucgucaccaacaucgacaccgugugcagcguggagggccccugcacgcuguuccacaaccggaucaucaucuccgccaacaagcagagcuacgggcugaagauguccugccagaccaagccgaaccagaacgaggaguucaucaucugcaaccgcaaguacagcguccucuucaccaccaucgacaagaacgacaagaucgaggugaacacgggcgaccagaccuccuacaucuacgagaaggacagccggugcaagaccuggcugugccgcgugcgggacgaggggaucuccguccuguucgagccccucaaggccuucuucggcagcuacuucuccaucaucuucuacgugguggucgggaucaucgugcuguuccugaucaucuacaucuuccuccccauguucuucaagcugaaggacgugcugaagcgcaacgaguaccucuaccugcaggagcugaagcacaaguga

SEQ ID NO: 12548 - RNA, 4305 nt, Artificial Sequence
  derived and/or modified CDS sequence (opt1) from CVV(MI80-1-450)__KX100149.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaucaagaacgacaccgggcuguucggccacaacaagguguuccggagcuggaccaucaaggacuggaagcugugcaacccgauccccaccgccgggggcacgaucaacgucaucgaggugaacaaggaccucucccugaugaccaagaccuacaucugcagccgcgacugcaccaucacgaucgacaaggaggaggcccagaucaucuuccagaccgacaagcugaaccacuucgagguguccggcaccacccucagcuccgggugguucaagagcaaggccuccgucacgcuggaccggaccugcgagcacgugaaggugaccugcggcaagaagucccugcaguuccacgcgugcuucaagcaccacaugagcugcguccgcuucuuccacaacaccauccuccccgggaacaugaucacgagcaugugccagaacaucgagcugaucaucauccugggccucacccuggccaucuucauccugauggugauccucaccaagaccuacaucugcuaccugcugaugcccaucuucaugccgaucgccuaccucuacgggugggccuacaacaaguccugcaagaagugcaacugcugcggccuggcguaccaccccuucacgaacugcggcagccacugcgugugcgggcugaaguucgaggccagcgaccggaugcgcauccaccgggaguccggccucugccagggguacaagagccugcgcaucgcccggcugcucugcaaguccaagggcagcucccuggucaucagcggccugcucuccaugcugauccugagcuucgugacccccaucgaggggaccaucaccuccuaccccgagagccgcaaguacacgcucgaggagaucaccgacguggucgagggccugguguccgagcagaacaucaaggaguacaucguguucuacaccagccuguucgggucccucauccugcugcucgccuucaucaugagcaucacccuguccaagaucacgagcauccuggccaagcggaacgucaucuacugcgaggagugcuccauguaccacagcaagcgcggcaucaaguacaacggggacuucaccaacaagugcggcuucugcacgugcaacgagcaggaggacaccgagggccucgugauccacaagguguccaagcggugcaccuacaaguaccagcugaagugggcgaagguccugaugaucacccucgugcugcugcugaucgcccagaacaccauccucaucguggccgccgagaccgacugcuggacgaagaagucccuggacaucgacugcaucgggccgaugcuggacaucggcagcugcaccaacaagaacacccgcagcuacgacgccgaggcgcagaagcucgucagccaguccaagaucagccagcuggacgccgaccaggugucccugcucgggaacagcaucgacuccgccaucaaggccauccgggcccagaagaccuaccccaccaugcaccuccuggagacgaucuuccugaugaagaacugcgacuacuacaccagcuucaaccacaacuccggcuacagccaggcgaaguggcgccugaucgccaagaccgggcacuucgacaucugcucccggcacagcacccaccacuucugccgcugcaucaacgacggcacgaagugccagaacggcaacugggacuucgccggggagaugaacgagaccuacaacuccaagaacgacuucuacagccacgaccugaaccucuucuacaccaucuucgagaacgccuuccccggcaccacggagucccuguucuaccagcugauccagaagaagaacaccaccggggccagccagguccucggcaagcugaucaccaaguacgggaacaacaacauguucgugggcguguggaaguucggccaguaccugcucacgcugcccuacaucaacaacaccgagcugucccagaaccggcgccucaccauccuggcgacccaggagcugcucagccggagccacuccgggcgccaggagagcauguccaacgccauccagggcagcaucacgaaggagugccacaacgccaagggggucggcugcaucuccccgcgcuucggcauccccaucgggaaccugaccgccugcggcgacagccccaacuacaagaucuacaagacccccgagaagcuguacaaguccaacaacaagggggagguguggugcagcaacgacgugcacugccucaacgacuucgagccggcggacgaggaggucgugaacaagaucaagaagcugaccugcuuccugacggacguguccgucgagguggacaucuucagcguggccgccuccacgugcaagauggccgacaagggcgucugcaccgugaacggggccaaguggaacaucaucaagugcgacagcggccucuacuacuucaccgaccaccgggagggccaggacaccgggaacgacuucggcgaguacugcaucucccacagcugcaacaccgagcgcuuccccaucaaccccgacauccugaaggacugcaccugggaguuccacucccgcaagagcaaguacaucuccaccaucagccuggagucccucgaggaguuccggcgggcgauggccgagaagcugagccacacgcugaccaucuacaacuucaagcccaccgccaaccucccgcacauccgccccaccuacaaguucaucacggccaacgggguggagaacagcgacggcaucgaguccgccuacauccugagcuccauccccgcgcucgggggcaucagcgucggcuacaacgugcagaccaaggacaacuucccccugcuggacaucaucguguucaucaaguccgccgucauccggaccaccuacaaccacaucuacgacacggggccgaccaucggcaucaacacccagcacgacgagcacugcaccgggcccugccccgccguggugccccacaaggagaacuggaugaccuucagccaggagcgcacgucccgguggggcugcgaggaguucgggugccuggccaucaacaccggcugcgucuucggcagcugccaggacaucauccacccggagaccaagguguaccgcaaggccguggaggaggaggucgugcucaccgugugcaucaacuuccccgggaacaacuacugcacggagaucaacgcgaucgagcccaagaucaccgacgagaucgagcugcaguucaagaccgucgacaccaagacgcugccgaaccuccuggccgugcagaaccacaagcuguacuccggccagaucaacgaccucgggagcuucucccagggcugcgggaacgugcagaagaccaaccacagcauccugggcaugggcaccgucaaguucgacuacgugugccacggggccucccggaaggacgugaucguccgccggugcuacaacaacaacuucgacagcugcaagcugcucaaggaggagaccucccugaucuucgccgacaaccacgagacgcuggagguggcgcacaccaagcaccucaucggcgagcugcaguucaagaucaugcugggggacauccgcuacaagagcuucgccgagucccccgagcucgagaucgacgccaagugcgugggcugccccagcugcuucgaguccuacagcugcaacuuccagaucgucaccaacaucgacaccgugugcagcguggagggccccugcacgcuguuccacaaccggaucaucaucuccgccaacaagcagagcuacgggcugaagauguccugccagaccaagccgaaccagaacgaggaguucaucaucugcaaccgcaaguacagcguccucuucaccaccaucgacaagaacgacaagaucgaggugaacacgggcgaccagaccuccuacaucuacgagaaggacagccggugcaagaccuggcugugccgcgugcgggacgaggggaucuccguccuguucgagccccucaaggccuucuucggcagcuacuucuccaucaucuucuacgugguggucgggaucaucgugcuguuccugaucaucuacaucuuccuccccauguucuucaagcugaaggacgugcugaagcgcaacgaguaccucuaccugcaggagcugaagcacaaguga

SEQ ID NO: 12549 - RNA, 4305 nt, Artificial Sequence
  derived and/or modified CDS sequence (opt1) from CVV(MNZ-92011)__KC436107.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaccaagaacgacaccgggcuguucggccacaacaagguguuccggagcuggaccaucaaggacuggaagcugugcaacccgauccccacggccgggggcaccaucaacgucaucgaggugaacaaggaccucucccugaugaccaagaccuacaucugcagccgcgacugcacgaucaccaucgacaaggaggaggcccagaucaucuuccagaccgacaagcugaaccacuucgagguguccggcaccacgcucaacagcgggugguucaaguccaaggccagcgucacccuggaccggaccugcgagcacgugaaggugaccugcggcaagaagucccugcaguuccacgcgugcuucaagcaccacaugagcugcguccgcuucuuccacaacacgauccuccccgggaacaugaucaacuccaugugccagaacaucgagcugaucaucauccugggccucacccuggccaucuucauccugauggugaugcucaccaagaccuacaucugcuaccugcugaugcccaucuucaugccgaucgccuaccucuacgggugggccuacaacaagagcugcaagaagugcaacugcugcggccuggcguaccaccccuucacgaacugcggcucccacugcgugugcgggcugaaguucgaggccagcgaccggaugcgcauccaccgggagagcggccucugccagggguacaagucccugcgcaucgcccggcugcucugcaagagcaagggcuccagccuggucaucuccggccugcucagcaugcugauccuguccuucgugacccccaucgaggggaccaucaccagcuaccccgagucccgcaaguacacgcucgaggagaucaccgacguggucgagggccuggugagcgagcagaacaucaaggaguacaucguguucuacaccucccuguucgggagccucauccugcugcucgccuucaucauguccaucacccugagcaagaucacguccauccuggcccggcgcaacgucaucuacugcgaggagugcagcauguaccacuccaagcggggcaucaaguacaacggggacuucaccaacaagugcggcuucugcacgugcaacgagcaggaggacgcggagggccucgugauccacaaggugagcaagcgcugcaccuacaaguaccagcugaagugggccaagguccugauggugacccucgugcugcugcugaucgcccagaacaccauccucaucgucgccgccgggaccgacugcugggcgaagaagucccuggacauggacugcaucggcccgaugcuggacaucgggagcugcaccaacaagaacacgcggaacuacgacaccgaggcccagaagcucgugagccaguccaaggucagccagcuggacgccgaccaggccucccugcucggcaacagcaucgacuccgccaucaaggcgauccgcgcccagaagaccuaccccaccaugcaccuccuggagaccaucuuccugaugaagaacugcgacuacuacacgagcuucaaccacaacuccggguacagccaggccaaguggcggcugaucgccaagaccggccacuucgacaucugcucccgccacagcacccaccacuucugccggugcaucaacgacggcaccaagugccagaacggggacugggacuucgccggcgagaugaacgagacguacaacuccaagaacgacuucuacagccacgaccugaaccucuucuacaccaucuucgagaacgcguuccccgggaccaccgagucccuguucuaccagcugauccagaagaagaacacggccggcgccagcaagauccucgggaagcugaucaccaaguacggcaacaacaacauguucgugggcguguggaaguucgggcaguaccugcucacccugcccuacaucaacaacaccgagcugucccagaaccgccggcagacgauccucgccacccaggagagccugucccgcagccacagcggccgccaggaguccaugagcuccgcgauccaggggagcgucaccaaggagugccacaacgccaaggacgugggcugcaucuccccgcgguucggcauccccaucgggaaccugaccgccugcggcgacagccccaacuacaagaucuacaagacgcccgagaagcucuacaaguccaacaacaagggggagguguggugcagcaacgacguccacugccugaacgacuucgagccggccgacgaggagguggugaacaaggucaagaagcugaccugcuuccucaccgacguguccgugaagaccgacaucuucagcgucgccgcguccacgugcaagauggccgacaagggcaucugcaccgugaacgacgccaaguggaacaucaucaagugcgacagcgggcuguacuacuucaccgaccaccgcgagggccaggacaccggcaacgacuucggggaguacugcaucucccacagcugcaacacggagcgguuccccaucaaccccgacauccugaaggacugcaccugggaguuccacucccgcaagagcaaguacaucuccaccaucagccucgagucccuggaggaguuccggcgcgccaugaccgagaagcugagccacacgcucaccaucuacaacuucaagcccaccgccaaccugccgcacauccggcccaccuacaaguucaucacggcgaacggcguggagaacagcgacgggaucgaguccgccuacauccugagcuccauccccgcccucggcgggaucagcgucggcuacaacgugcagaccaaggacaacuucccccugcuggacaucaucguguucaucaaguccgccgucauccgcaccaccuacaaccacaucuacgacacgggcccgaccaucgggaucaacacccagcacgacgagcacugcaccggccccugccccgccguggugccccacaaggagaacuggaucaccuucagccaggagcggacgucccgcugggggugcgaggaguucggcugccucgcgaucaacaccgggugcgucuucggcagcugccaggacaucauccacccggagaccaagguguaccggaaggccguggaggaggaggucgugcugaccgugugcaucaacuuccccggcaacaacuacugcacggagaucaacgccgucgagcccaagaucaccgacgagaucgagcugcaguucaagaccguggacaccaagacgcucccgaaccugcuggccgugcagaaccacaagcucuacuccgggcagaucaacgaccugggcagcuucucccaggggugcggcaacguccagaagaccaaccacagcauccuggggaugggcaccgcgaaguucgacuacgugugccacggcgccucccgcaaggacgugaucguccggcgcugcuacaacaacaacuucgacagcugccggcuccugaaggaggagaccucccugaucuucgccgacaaccacgagacgcucgagguggcccacaccaagcaccugaucggggagcugcaguucaagaucaugcucggcgacauccgcuacaagagcuucgccgagucccccgagcuggagaucgacgcgaagugcguggggugccccagcugcuucgaguccuacagcugcaacuuccagaucgucaccaacaucgacaccgugugcagcguggagggccccugcacgcuguuccacaaccggaucaucaucuccgccaacaagcagagcuacggccucaagauguccugccagaccaagccgaaccagaacgaggaguucaucaucugcaaccgcaaguacagcguccuguucaccaccaucgacaagaacgacaagaucgaggugaacacgggggaccagaccuccuacaucuacgagaaggacagccggugcaagaccuggcugugccgcgugcgcgacgagggcaucuccguccucuucgagccccugaaggccuucuucgggagcuacuucuccaucaucuucuacgugguggucggcaucaucgugcuguuccucaucaucuacaucuuccugcccauguucuucaagcugaaggacgugcucaagcggaacgaguaccuguaccugcaggagcucaagcacaaguga

SEQ ID NO: 12550 - RNA, 4305 nt, Artificial Sequence
  derived and/or modified CDS sequence (opt1) from CVV(MPB1-1551)__KX100143.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaucaagaacgacaccgggcuguucggccacaacaagguguuccggagcuggaccaucaaggacuggaagcugugcaacccgauccccaccgccgggggcacgaucaacgucaucgaggugaacaaggaccucucccugaugaccaagaccuacaucugcagccgcgacugcaccaucacgaucgacaaggaggaggcccagaucaucuuccagaccgacaagcugaaccacuucgagguguccggcaccacccucagcuccgggugguucaagagcaaggccuccgucacgcuggaccggaccugcgagcacgugaaggugaccugcggcaagaagucccugcaguuccacgcgugcuucaagcaccacaugagcugcguccgcuucuuccacaacaccauccuccccgggaacaugaucacgagcaugugccagaacaucgagcugaucaucauccugggccucacccuggccaucuucauccugauggugaugcucaccaagaccuacaucugcuaccugcugaugcccaucuucaugccgaucgccuaccucuacgggugggccuacaacaaguccugcaagaagugcaacugcugcggccuggcguaccaccccuucacgaacugcggcagccacugcgugugcgggcugaaguucgaggccagcgaccggaugcgcauccaccgggaguccggccucugccagggguacaagagccugcgcaucgcccggcugcucugcaaguccaagggcagcucccuggucaucagcggccugcucuccaugcugauccugagcuucgugacccccaucgaggggaccaucaccuccuaccccgagagccgcaaguacacgcucgaggagaucaccgacguggucgagggccugguguccgagcagaacaucaaggaguacaucguguucuacaccagccuguucgggucccucauccugcugcucgccuucaucaugagcaucacccuguccaagaucacgagcauccuggccaagcggaacgucaucuacugcgaggagugcuccauguaccacagcaagcgcggcaucaaguacaacggggacuucaccaacaagugcggcuucugcacgugcaacgagcaggaggacaccgagggccucgugauccacaagguguccaagcggugcaccuacaaguaccagcugaagugggcgaagguccugaugaucacccucgugcugcugcugaucgcccagaacaccauccucaucguggccgccgagaccgacugcuggacgaagaagucccuggacaucgacugcaucgggccgaugcuggacaucggcagcugcaccaacaagaacacccgcagcuacgacgccgaggcgcagaagcucgucagccaguccaagaucagccagcuggacgccgaccaggccucccugcucgggaacagcaucgacuccgccaucaaggccauccgggcgcagaagaccuaccccaccaugcaccuccuggagacgaucuuccucaugaagaacugcgacuacuacaccagcuucaaccacaacuccggcuacagccaggccaaguggcgccugaucgccaagaccgggcacuucgacaucugcucccggcacagcacccaccacuucugccgcugcaucaacgacggcacgaagugccagaacggcgacugggacuucgccggggagaugaacgagaccuacaacuccaagaacgacuucuacagccacgaccugaaccucuucuacaccaucuucgagaacgccuuccccggcaccacggagucccuguucuaccagcugauccagaagaagaacaccaccggggcgagcaaggugcucggcaagcugaucaccaaguacgggaacaacaacauguucgucggcguguggaaguucggccaguaccugcucacgcugcccuacaucaacaacaccgagcugucccagaaccggcgccucaccauccuggccacccaggagauccugagccggagccacuccgggcgccaggagagcauguccaacgccauccagggcagcaucacgaaggagugccacaacgccaagggggugggcugcaucuccccgcgcuucggcauccccaucgggaaccucaccgcgugcggcgacagccccaacuacaagaucuacaagacccccgagaagcuguacaaguccaacaacaagggggaggucuggugcagcaacgacgugcacugccugaacgacuucgagccggccgacgaggaggugaucaacaagaucaagaagcugaccugcuuccugacggacgucuccguggagguggacaucuucagcgucgccgccuccacgugcaagauggccgacaagggcgugugcaccgugaacggggcgaaguggaacaucaucaagugcgacagcggccuguacuacuucaccgaccaccgggagggccaggacaccgggaacgacuucggcgaguacugcaucucccacagcugcaacaccgagcgcuuccccaucaaccccgacacccucaaggacugcaccugggaguuccacucccgcaagagcaaguacaucuccacgaucagccuggagucccuggaggaguuccggcgggccauggccgagaagcucagccacacccugaccaucuacaacuucaagcccaccgccaaccugccgcacauccgccccacguacaaguucaucaccgccaacggggucgagaacagcgacggcaucgaguccgcguacauccucagcuccauccccgcccucgggggcaucagcgugggcuacaacgugcagaccaaggacaacuucccccugcucgacaucaucgucuucaucaaguccgccgugauccggaccacguacaaccacaucuacgacaccgggccgaccaucggcaucaacacccagcacgacgagcacugcaccgggcccugccccgccguggucccccacaaggagaacuggaugacguucagccaggagcgcaccucccgguggggcugcgaggaguucgggugccuggccaucaacaccggcugcguguucggcagcugccaggacaucauccacccggagaccaagguguaccgcaaggcggucgaggaggagguggugcugacggucugcaucaacuuccccgggaacuccuacugcaccgagaucaacgccaucgagcccaagaucaccgacgagaucgagcuccaguucaagaccguggacacgaagacccugccgaaccugcucgccgugcagaaccacaagcuguacagcggccagaucaacgaccugggguccuucagccagggcugcgggaacguccagaagaccaaccacuccauccucggcaugggcaccgugaaguucgacuacgugugccacggggccagccggaaggacgucaucgugcgccggugcuacaacaacaacuucgacuccugcaagcugcugaaggaggagacgagccucaucuucgcggacaaccacgagacccuggagguggcccacaccaagcaccugaucggcgagcuccaguucaagaucaugcugggggacauccgcuacaaguccuucgccgagagccccgagcuggagaucgacgccaagugcgucggcugccccuccugcuucgagagcuacagcugcaacuuccagaucgugaccaacaucgacacggugugcuccgucgagggccccugcacccucuuccacaaccggaucaucaucagcgccaacaagcaguccuacgggcugaagaugagcugccagaccaagccgaaccagaacgaggaguucaucaucugcaaccgcaaguacuccgugcuguucaccacgaucgacaagaacgacaagaucgaggugaacaccggcgaccagaccagcuacaucuacgagaaggacucccggugcaagaccuggcucugccgcguccgggacgaggggaucagcgugcuguucgagccccugaaggcguucuucggcuccuacuucagcaucaucuucuacguggucguggggaucaucgugcuguuccugaucaucuacaucuuccugcccauguucuucaagcucaaggacguccugaagcgcaacgaguaccuguaccuccaggagcugaagcacaaguga

SEQ ID NO: 12551 - RNA, 4305 nt, Artificial Sequence
  derived and/or modified CDS sequence (opt1) from CVV(W308-67)__KX100140.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaucaagaacgacaccgggcuguucggccacaacaagguguuccggagcuggaccaucaaggacuggaagcugugcaacccgauccccaccgccgggggcacgaucaacgucaucgaggugaacaaggaccucucccugaugaccaagaccuacaucugcagccgcgacugcaccaucacgaucgacaaggaggaggcccagaucaucuuccagaccgacaagcugaaccacuucgagguguccggcaccacccucagcuccgggugguucaagagcaaggccuccgucacgcuggaccggaccugcgagcacgugaaggugaccugcggcaagaagucccugcaguuccacgcgugcuucaagcaccacaugagcugcguccgcuucuuccacaacaccauccuccccgggaacaugaucacgagcaugugccagaacaucgagcugaucaucauccugggccucacccuggccaucuucauccugauggugacccucaccaagacguacaucugcuaccugcugaugcccaucuucaugccgaucgccuaccucuacgggugggccuacaacaaguccugcaagaagugcaacugcugcggccuggcguaccaccccuucaccaacugcggcagccacugcgugugcgggcugaaguucgaggccagcgaccggaugcgcauccaccgggaguccggccucugccagggguacaagagccugcgcaucgcccggcugcucugcaaguccaagggcagcucccuggucaucagcggccugcucuccaugcugauccugagcuucgugacccccaucgaggggaccaucacguccuaccccgagagccgcaaguacacccucgaggagaucaccgacguggucgagggccugguguccgagcagaacaucaaggaguacaucguguucuacaccagccuguucgggucccucauccugcugcucgccuucaucaugagcaucacgcuguccaagaucaccagcauccuggccaagcggaacgucaucuacugcgaggagugcuccauguaccacagcaagcgcggcaucaaguacaacggggacuucaccaacaagugcggcuucugcacgugcaacgagcaggaggacaccgagggccucgugauccacaagguguccaagcggugcaccuacaaguaccagcugaagugggcgaagguccugaugaucacccucgugcugcugcugaucgcccagaacaccauccucaucguggccgccgagacggacugcuggaccaagaagucccuggacaucgacugcaucgggccgaugcuggacaucggcagcugcaccaacaagaacacccgcagcuacgacgccgaggcgcagaagcucgucagccaguccaagaucagccagcuggacgccgaccaggccucccugcucgggaacagcaucgacuccgccaucaaggccauccgggcgcagaagaccuaccccacgaugcaccuccuggagaccaucuuccucaugaagaacugcgacuacuacaccagcuucaaccacaacuccggcuacagccaggccaaguggcgccugaucgccaagaccgggcacuucgacaucugcucccggcacagcacgcaccacuucugccgcugcaucaacgacgagaccaagugccagaacggcgacugggacuucgccggcgagaugaacgagaccuacaaguccaagaacgacuucuacagccacgaccugaaccucuucuacaccaucuucgagaacgccuuccccgggacgaccgagucccuguucuaccagcugauccagaagaagaacaccaccggcgcgagcaaggugcucgggaagcugaucacgaaguacggcaacaacaacauguucgucgggguguggaaguucggccaguaccugcucacccugcccuacaucaacaacaccgagcugucccagaaccggcgccucaccauccuggccacgcaggagauccugagccggagcuacuccggccgccaggagagcauguccaacgccauccaggggagcaucaccaaggagugccacaacgccaagggcguggggugcaucuccccgcgcuucggcauccccaucggcaaccucaccgcgugcggggacagccccaacuacaagaucuacaagacccccgagaagcuguacaaguccaacaacaagggcgaggucuggugcagcaacgacgugcacugccugaacgacuucgagccggccgacgaggaggugaucaacaagaucaagaagcucacgugcuuccugaccgacgucuccguggagguggacaucuucagcgucgccgccuccacgugcaagauggccgacaagggggugugcaccgugaacggcgcgaaguggaacaucaucaagugcgacagcgggcuguacuacuucaccgaccaccgggagggccaggacaccggcaacgacuucggggaguacugcaucucccacagcugcaacaccgagcgcuuccccaucaaccccgacacccucaaggacugcacgugggaguuccacucccgcaagagcaaguacaucuccaccaucagccuggagucccuggaggaguuccggcgggccauggccgagaagcucagccacacccugaccaucuacaacuucaagcccacggccaaccugccgcacauccgccccaccuacaaguucaucaccgccaacggcgucgagaacagcgacgggaucgaguccgcguacauccucagcuccauccccgcccugggcgggaucagcgugggcuacaacgugcagaccaaggacaacuucccccugcucgacaucaucgucuucaucaaguccgccgugauccggacgaccuacaaccacaucuacgacaccggcccgaccaucgggaucaacacccagcacgacgagcacugcacgggccccugccccgccguggucccccacaaggagaacuggaugaccuucagccaggagcgcaccucccggugggggugcgaggaguucggcugccuggccaucaacaccgggugcguguucggcagcugccaggacaucauccacccggagacgaagguguaccgcaaggcggucgaggaggagguggugcugaccgucugcaucaacuuccccggcaacaacuacugcaccgagaucaacgccaucgagcccaagaucaccgacgagaucgagcuccaguucaagacgguggacaccaagacccugccgaaccugcucgccgugcagaaccacaagcuguacuccgggcagaucaacgaccugggcagcuucucccaggggugcggcaacguccagaagaccaaccacagcauccucgggaugggcacggugaaguucgacuacgugugccacggcgccucccggaaggacgucaucgugcgccggugcuacaacaacaacuucgacagcugcaagcugcugaaggaggagaccucccucaucuucgcggacaaccacgagacccuggagguggcccacaccaagcaccugaucggggagcuccaguucaagaucaugcugggcgacauccgcuacaagagcuucgccgagucccccgagcuggagaucgacgccaagugcgucgggugccccagcugcuucgaguccuacagcugcuacuuccagaucgugacgaacaucgacaccgugugcagcgucgagggccccugcacccucuuccacaaccggaucaucaucuccgccaacaagcagagcuacggccugaagauguccugccagaccaagccgaaccagaacgaggaguucaucaucugcaaccgcaaguacagcgugcuguucacgaccaucgacaagaacgacaagaucgaggugaacaccggggaccagaccuccuacaucuacgagaaggacagccggugcaagacguggcucugccgcguccgggacgagggcaucuccgugcuguucgagccccugaaggcguucuucgggagcuacuucuccaucaucuucuacguggucgugggcaucaucgugcuguuccugaucaucuacaucuuccugcccauguucuucaagcucaaggacguccugaagcgcaacgaguaccuguaccuccaggagcugaagcacaaguga

SEQ ID NO: 12552 - RNA, 4305 nt, Artificial Sequence
  derived and/or modified CDS sequence (opt1) from CVV(W728-67)__KX100137.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaucaagaacgacaccgggcuguucggccacaacaagguguuccggagcuggaccaucaaggacuggaagcugugcaacccgauccccaccgccgggggcacgaucaacgucaucgaggugaacaaggaccucucccugaugaccaagaccuacaucugcagccgcgacugcaccaucacgaucgacaaggaggaggcccagaucaucuuccagaccgacaagcugaaccacuucgagguguccggcaccacccucagcuccgggugguucaagagcaaggccuccgucacgcuggaccggaccugcgagcacgugaaggugaccugcggcaagaagucccugcaguuccacgcgugcuucaagcaccacaugagcugcguccgcuucuuccacaacaccauccuccccgggaacaugaucacgagcaugugccagaacaucgagcugaucaucauccugggccucacccuggccaucuucauccugauggugaugcucaccaagaccuacaucugcuaccugcugaugcccaucuucaugccgaucgccuaccucuacgggugggccuacaacaaguccugcaagaagugcaacugcugcggccuggcguaccaccccuucacgaacugcggcagccacugcgugugcgggcugaaguucgaggccagcgaccggaugcgcauccaccgggaguccggccucugccagggguacaagagccugcgcaucgcccggcugcucugcaaguccaagggcagcucccuggucaucagcggccugcucuccaugcugauccugagcuucgugacccccaucgaggggaccaucaccuccuaccccgagagccgcaaguacacgcucgaggagaucaccgacguggucgagggccugguguccgagcagaacaucaaggaguacaucguguucuacaccagccuguucgggucccucauccugcugcucgccuucaucaugagcaucacccuguccaagaucacgagcauccuggccaagcggaacgucaucuacugcgaggagugcuccauguaccacagcaagcgcggcaucaaguacaacggggacuucaccaacaagugcggcuucugcacgugcaacgagcaggaggacaccgagggccucgugauccacaagguguccaagcggugcaccuacaaguaccagcugaagugggcgaagguccugaugaucacccucgugcugcugcugaucgcccagaacaccauccucaucguggccgccgagaccgacugcuggacgaagaagucccuggacaucgacugcaucgggccgaugcuggacaucggcagcugcaccaacaagaacacccgcagcuacgacgccgaggcgcagaagcucgucagccaguccaagaucagccagcuggacgccgaccaggccucccugcucgggaacagcaucgacuccgccaucaaggccauccgggcgcagaagaccuaccccaccaugcaccuccuggagacgaucuuccucaugaagaacugcgacuacuacaccagcuucaaccacaacuccggcuacagccaggccaaguggcgccugaucgccaagaccgggcacuucgacaucugcucccggcacagcacccaccacuucugccgcugcaucaacgacggcacgaagugccagaacggcgacugggacuucgccggggagaugaacgagaccuacaacuccaagaacgacuucuacagccacgaccugaaccucuucuacaccaucuucgagaacgccuuccccggcaccacggagucccuguucuaccagcugauccagaagaagaacaccaccggggcgagcaagauccucggcaagcugaucaccaaguacgggaacaacaacaugguggucggcguguggaaguucggccaguaccugcucacgcugcccuacaucaacaacaccgagcugucccagaaccggcgccucaccauccuggccacccaggagcugcucagccggagccacuccgggcgccaggagagcauguccaacgccauccagggcagcaucacgaaggagugccacaacgccaagggggugggcugcaucuccccgcgcuucggcauccccaucgggaaccugaccgcgugcggcgacagccccaacuacaagaucuacaagacccccgagaagcuguacaaguccaacaacaagggggaggucuggugcagcaacgacgugcacugccucaacgacuucgagccggccgacgaggagguggucaacaagaucaagaagcugaccugcuuccugacggacguguccguggaggucgacaucuucagcguggccgccuccacgugcaagauggccgacaagggcgugugcaccgucaacggggcgaaguggaacaucaucaagugcgacagcggccucuacuacuucaccgaccaccgggagggccaggacaccgggaacgacuucggcgaguacugcaucucccacagcugcaacaccgagcgcuuccccaucaaccccgacacccugaaggacugcaccugggaguuccacucccgcaagagcaaguacaucuccacgaucagccuggagucccucgaggaguuccggcgggccauggccgagaagcugagccacacccugaccaucuacaacuucaagcccaccgccaaccucccgcacauccgccccacguacaaguucaucaccgccaacgggguggagaacagcgacggcaucgaguccgcguacauccugagcuccauccccgcccucgggggcaucagcgugggcuacaacguccagaccaaggacaacuucccccugcuggacaucaucguguucaucaaguccgccgugauccggaccacguacaaccacaucuacgacaccgggccgaccaucggcaucaacacccagcacgacgagcacugcaccgggcccugccccgccgucgugccccacaaggagaacuggaugacguucagccaggagcgcaccucccgguggggcugcgaggaguucgggugccuggccaucaacaccggcugcguguucggcagcugccaggacaucauccacccggagaccaaggucuaccgcaaggcgguggaggaggaggugguccucacggugugcaucaacuuccccgggaacaacuacugcaccgagaucaacgccaucgagcccaagaucaccgacgagaucgagcugcaguucaagaccguggacacgaagacccugccgaaccuccuggccguccagaaccacaagcuguacuccggccagaucaacgaccucgggagcuucucccagggcugcgggaacgugcagaagaccaaccacagcauccugggcaugggcaccgugaaguucgacuacgucugccacggggccucccggaaggacgugaucgugcgccggugcuacaacaacaacuucgacagcugcaagcugcucaaggaggagacgucccugaucuucgcggacaaccacgagacccuggaggucgcccacaccaagcaccucaucggcgagcugcaguucaagaucaugcugggggacauccgcuacaagagcuucgccgagucccccgagcucgagaucgacgccaagugcgugggcugccccagcugcuucgaguccuacagcugcaacuuccagaucgugaccaacaucgacacggucugcagcguggagggccccugcacccuguuccacaaccggaucaucaucuccgccaacaagcagagcuacgggcugaagauguccugccagaccaagccgaaccagaacgaggaguucaucaucugcaaccgcaaguacagcgugcuguucaccacgaucgacaagaacgacaagaucgaggucaacaccggcgaccagaccuccuacaucuacgagaaggacagccggugcaagaccuggcugugccgcgugcgggacgaggggaucuccgugcuguucgagccccucaaggcguucuucggcagcuacuucuccaucaucuucuacgucgugguggggaucaucguccuguuccugaucaucuacaucuuccuccccauguucuucaagcugaaggacgugcugaagcgcaacgaguaccucuaccugcaggagcugaagcacaaguga

SEQ ID NO: 12553 - RNA, 4305 nt, Artificial Sequence
  derived and/or modified CDS sequence (opt1) from CVV(WI-03BS7669)__KX100152.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaucaagaacgacaccgggcuguucggccacaacaagguguuccggagcuggaccaucaaggacuggaagcugugcaacccgauccccaccgccgggggcacgaucaacgucaucgaggugaacaaggaccucucccugaugaccaagaccuacaucugcagccgcgacugcaccaucacgaucgacaaggaggaggcccagaucaucuuccagaccgacaagcugaaccacuucgagguguccggcaccacccucagcuccgggugguucaagagcaaggccuccgucacgcuggaccggaccugcgagcacgugaaggugaccugcggcaagaagucccugcaguuccacgcgugcuucaagcaccacaugagcugcguccgcuucuuccacaacaccauccuccccgggaacaugaucacgagcaugugccagaacaucgagcugaucaucauccugggccucacccuggccaucuucauccugauggugauccucaccaagaccuacaucugcuaccugcugaugcccaucuucaugccgaucgccuaccucuacgggugggccuacaacaaguccugcaagaagugcaacugcugcggccuggcguaccaccccuucacgaacugcggcagccacugcgugugcgggcugaaguucgaggccagcgaccggaugcgcauccaccgggaguccggccucugccagggguacaagagccugcgcaucgcccggcugcucugcaaguccaagggcagcucccuggucaucagcggccugcucuccaugcugauccugagcuucgugacccccaucgaggggaccaucaccuccuaccccgagagccgcaaguacacgcucgaggagaucaccgacguggucgagggccugguguccgagcagaacaucaaggaguacaucguguucuacaccagccuguucgggucccucauccugcugcucgccuucaucaugagcaucacccuguccaagaucacgagcauccuggccaagcggaacgucaucuacugcgaggagugcuccauguaccacagcaagcgcggcaucaaguacaacggggacuucaccaacaagugcggcuucugcacgugcaacgagcaggaggacaccgagggccucgugauccacaagguguccaagcggugcaccuacaaguaccagcugaagugggcgaagguccugaugaucacccucgugcugcugcugaucgcccagaacaccauccucaucguggccgccgagaccgacugcuggaucaagaagucccuggacaucgacugcaucgggccgaugcuggacaucggcagcugcacgaacaagaacacccgcagcuacgacaccgaggcccagaagcucgucagccaguccaagaucagccagcuggacgcggaccaggugucccugcucgggaacagcaucgacuccgccaucaaggccauccgggcccagaagaccuacagcaccaugcaccuccuggagacgaucuuccugaugaagaacugcgacuacuacaccuccuucaaccacaacagcggcuacucccaggccaaguggcgccugaucgcgaagaccgggcacuucgacaucugcagccggcacuccacccaccacuucugccgcugcaucaacgacggcacgaagugccagaacggcgacugggacuucgccggggagaugaacgagaccuacaacagcaagaacgacuucuacucccacgaccugaaccucuucuacaccaucuucgagaacgccuuccccggcaccacggagagccuguucuaccagcugauccagaagaagaacaccaccggggccuccaagguccucggcaagcugaucaccaaguacgggaacaacaacauguucgugggcguguggaaguucggccaguaccugcucacgcugcccuacaucaacaacaccgagcugagccagaaccggcgccucaccauccugaccacgcaggagcugcucagccggucccacagcgggcgccaggaguccaugagcaacgccauccagggcuccaucaccaaggagugccacaacgcgaagggggucggcugcaucagcccccgcuucggcaucccgaucgggaaccugaccgccugcggcgacucccccaacuacaagaucuacaagacccccgagaagcuguacaagagcaacaacaagggggagguguggugcuccaacgacgugcacugccucaacgacuucgagcccgccgacgaggaggucgugaacaagaucaagaagcugacgugcuuccugaccgacgugagcgucgagguggacaucuucuccguggccgcgagcacgugcaagauggccgacaagggcgucugcaccgugaacggggccaaguggaacaucaucaagugcgacuccggccucuacuacuucaccgaccaccgggagggccaggacaccgggaacgacuucggcgaguacugcaucagccacuccugcaacaccgagcgcuucccgaucaaccccgacauccugaaggacugcaccugggaguuccacagccggaaguccaaguacaucagcacgaucucccuggagagccucgaggaguuccgccgggccauggccgagaagcugagccacacccugaccaucuacaacuucaagcccaccgcgaaccucccccacauccgcccgacguacaaguucaucaccgccaacgggguggagaacuccgacggcaucgagagcgccuacauccuguccagcauccccgcccucgggggcaucuccgucggcuacaacgugcagaccaaggacaacuucccccugcuggacaucaucguguucaucaagagcgccgucauccggaccacguacaaccacaucuacgacaccgggcccaccaucggcaucaacacccagcacgacgagcacugcaccgggccgugccccgcgguggugccccacaaggagaacuggaugacguucucccaggagcgcaccagccgguggggcugcgaggaguucgggugccuggccaucaacaccggcugcgucuucggcuccugccaggacaucauccaccccgagaccaagguguaccgcaaggccguggaggaggaggucgugcucacggugugcaucaacuucccggggaacaacuacugcaccgagaucaacgccaucgagcccaagaucaccgacgagaucgagcugcaguucaagaccgucgacacgaagacccugcccaaccuccuggccgugcagaaccacaagcuguacagcggccagaucaacgaccucggguccuucagccagggcugcgggaacgugcagaagaccaaccacuccauccugggcaugggcaccgucaaguucgacuacgugugccacggggcgagccggaaggacgugaucguccgccggugcuacaacaacaacuucgacuccugcaagcugcucaaggaggagacgagccugaucuucgccgacaaccacgagacccuggagguggcccacaccaagcaccucaucggcgagcugcaguucaagaucaugcugggggacauccgcuacaaguccuucgccgagagcccggagcucgagaucgacgcgaagugcgugggcugccccuccugcuucgagagcuacagcugcaacuuccagaucgucaccaacaucgacacggugugcuccguggagggccccugcacccuguuccacaaccggaucaucaucagcgccaacaagcaguccuacgggcugaagaugagcugccagaccaagcccaaccagaacgaggaguucaucaucugcaaccgcaaguacuccguccucuucaccacgaucgacaagaacgacaagaucgaggugaacaccggcgaccagaccagcuacaucuacgagaaggacucccggugcaagaccuggcugugccgcgugcgggacgaggggaucagcguccuguucgagccgcucaaggccuucuucggcuccuacuucagcaucaucuucuacgugguggucgggaucaucgugcuguuccugaucaucuacaucuuccuccccauguucuucaagcugaaggacgugcugaagcgcaacgaguaccucuaccugcaggagcugaagcacaaguga

SEQ ID NO: 12554 - RNA, 4317 nt, Artificial Sequence
  derived and/or modified CDS sequence (opt1) from CHLV(CHLV-Mex07)__JN808310.1__GP
auggagcccagcaucaagcuguuccucauccuggccaucgccgcggccgccgugcacucccugccggccagccgcugcuucuccgagggcaucgucaucaaggagaagcaggacagcaaggccguguccgaguucugccucaaggacgacgugagcaugaucaagucccacgucguguacagcaagaacgaguccgggaucuucgcgaacagccagauccugcggaaguggaucaucaaggacuggaagcugugcagcccccuccccaccgccggcgggcagaucaacgugaucgagaucaaccacgaccugacccugagcacgaagaccuacgucugcaccaccgacugcacgaucggcaucgacaaggagaacgcccagaucaccuuccagaccaacaagcucaacuacuucgagguguccgggaccacgaucagcuccggcugguucaagagcaagaccuccgugagccuggaccagaccugcgagcaccugaaggucuccugcggcaagaaguccaugcaguuccacgccugcuucaagcagcacaugagcugcauccgcuaccuccaccggaccgcgcugcccggguacauggccgccuccaucugcagcaacaucgagcugaucaucaugacgacccucacccuggccaucuucauccugcucugcaucaucaccaagacguacaucugcuaccugcugaugccccucuucaugccgaucgccuacaucuacggcuggcuguacaacaaguccugcaagaagugcaacugcugcgggcugagcuaccaccccuucaccaacugcggcuccuacugcgugugcggggcgaaguucgagaccagcgaccgcaugcggauccaccgcgaguccggccucugccagggcuacaagagccugcggguggcccgcaagcugugcaaguccaaggggagcucccucgucaucagcaucacccuguccguguucaucuucagcuucaucacgcccaucggcggggccaucaucaacgacaagcuguccgaggagaaguacagcaucaaccagaugauggacgccaucguggaccucgagaacuucucccacaacgucagcggcacccagcaggucaucuccgugaucuuccugcugaucagcugccucuuccugcugcucaccuaccaccugaacaagaucauccagcaccuggcccgguucggccuccuguucugcgaggagugcagcauguaccacuccaagaaggacaucaaguacaacggggacuucaccaacaagugcggcuucugcacgugcgggcagccggaggaccccgagggccugaaccuccacauccugagccagaacugcaccuacaagcagcaguucaagugggugaagaucaucaucuccauccugcucagccugaucaucaucgagaacuccaugauccuggcggccgccgagaccgacugcuucagcgagaagcagaucuccgaguucugccucgggccccugcugagcaucuccagcugcgaggacaagaacucccgcaccuucaagggcgaggcccagaagcugguggcccucaagaagaucacgagcgacgaggcgaugcugaucgaguccaugggcgccaacguggagggggcccuggagaugauccaggcccagaagucccccgacagcauguacaccauggaguacgucuuccucaacaccuacugcgacuacuacagccuguucgagcacaacuccggcuacagccaggugaaguggcgguacauccugaagacccaccaguucgacgccugcgcgcgccacagcaacucccacuucugccggugcaugagcgacgggaugcacugcccguccagcgacugggacaucgccgacgagcucgacaacacguacaucaccaagcccaacuucuucaagcacgacuacaaccugcugcucgacgugaucaccgccgccuuccccggcaccggggcggucuucgugaucgacgccugcaagaaggccaacgccacggccaucaagaccuucuccaacaacaucaucgcgcgcuuccccuacaacaaccugcugaagggcgucaugaaguuccuccaguacaucagcaagcacccguccuucaagaaguaccagcccgacacccggcacuacgaccugauccccguggcccccaccgcccgcggccggagccuggggcgcuccaacagcuacaacaacgcccagaucggcuccccgaccaaggacugccagaugcucaaggagguggggugccugagccccaaguucggccugccccucgaguccaucaucagcugcggguccagccccaacuacaagcuguacaagaagccgcagaaguacuacaaguccaacaacaaggagaacacguggugcagcaaggacguccacugccugcacgacuucgagcccaucaccgaggacgugcucgagaaggugaaggucaugaccugcugggagaucgagcccggcaccaucgaggacaucuucacgaucgccuccgagaccugcaagaucaacgaccggggcgugugcgaggugaacgcggccaaguggaagaucgucaagugcgagaccgggcuguacuacuacaccgaccaccgcgagggcgacgacacggggagcgaccugggccacuacugccucacccacaagugcgccggcgggcgguaccccaucaacccggagauccugcagaacugcgugugggaguuccacagccagaagucccaguacaucaaccagguggaccuggagcagaucgaggaguacaagaaggcccucaccgagaagcugacccacacgcugaaccacuacaacuuccuccccaccaagaaccugccccacaucagcccgaacuacaaguacgucacccugaacggccaggagaccuccgacgggaucgagaacagcuacaucguguccgagauccccgccaucgcgggcacgagcaucgggcucaaggugcagaccaagaccaacgacgacaucuucgaccugaucaucuacgucaagcgcgccgacaucaucgccuccuacaaccacaucuacgacaccggccccacgaucggccacaacguggagcacgaggagcugugcaccgggcagugcccccagcacaucccggccaaggcgaacuggcucaccuucagccaggagcgcaccucccgguggggcugcgaggaguucgggugccuggccaucaacacgggcugcguguacgggagcugccaggacaucaucaagcccgucgccaagguguaccgcaaguccaccgaggagaagguggagcuggagcucugcaucguccugcccgacaagaacuucugcaccacccugaacgcccucgagcccaagaucacggaggagaucgagcugcaguucaagaccaucgaccagaugagccugccgaacaucgugcuccugcgggaccacaagcuguucaagggccagaucaacgaccucggcaccuucgggcagaacugcggcaacgugcagaagaccaaccaguccauccugggggccggcacgguccgcuucgacuaccugugccacagcgcgucccggaaggacaucaucauccgccggugcuacaacaacaacuacgacagcugcaaccaccuccagcuggccgagucccugaucuuccucgacaaccacgagacccuggaggugcgcaagcccaaccacauccuggggacccucagcaugaagcugaugcugggcgacuuccaguacaagaccuucgccaaggacaucgagcucgacuucacgggccggugcguggggugcaucggcugcuucgagggguucgucugcgagaugcacaucaccaccaccguggaggcgaccugcaaccuggaggccuccugccaguucuuccacaaccagcugcacaucaagcccgacgugcucaaguacuacacgaagaugaccugccagaccgacgaguacauccccagcaagaucaagaucugcaacaaggaguacaagaucaccgucggcaaggugcagaagaacgacaagaucgagaucgacaacagcgaccagacguccuacaucaaggagaaggacgagcgcugcaagaccuggcugugccgggugcgcgacgaggggaucagcgucaucuucgagccgcugcucaacaucuucggcaacuacggccggaucgccguggccgugaucuccgccauccuggcccugaucauccucgucuacauccugaugcccaucugcaugcgcauccgggacauccugaagaccaacgagcgcgaguuccucaucgagagcaaguacaaguga

SEQ ID NO: 12555 - RNA, 4305 nt, Artificial Sequence
  derived and/or modified CDS sequence (opt1) from FSV(86MSP18)__KX100131.1__GP
augcugagccuccugauccuggcccuccugggccuguccaccagcaaccccaucgccacccgcugcuuccacgggggccagcucaucgcggaguccaagagcgccacguccaucagcgaguucugccugaaggacgacguguccaugcucaagagcgaggucaucuacaccaagaacgacaccgggcuguucggccacaacaagguguuccgguccuggaccaucaaggacuggaagcugugcaacccgauccccacggccgggggcaccaucaacgugaucgaggucaacaaggaccugagccucaugaccaagaccuacaucugcucccgcgacugcacgaucaccaucgacaaggaggaggcccagaucaucuuccagaccgacaagcugaaccacuucgaggugagcggcaccacgcuguccagcgggugguucaaguccaaggccagcgugacccucgaccggaccugcgagcacgucaaggugaccugcggcaagaagucccugcaguuccacgcgugcuucaagcaccacaugagcugcgugcgcuucuuccacaacacgauccugcccgggaacaugaucaccuccaugugccagaacaucgagcucaucaucauccugggccugacccucgccaucuucauccugauggucaugaucaccaagacguacaucugcuaccugcucaugcccaucuucaugccgaucgccuaccuguacgggugggccuacaacaagagcugcaagaagugcaacugcugcggccuggcguaccaccccuucaccaacugcggcagccacugcgugugcgggcucaaguucgaggccuccgaccggaugcgcauccaccgggagagcggccugugccagggguacaagucccugcgcaucgcccggcuccugugcaagagcaagggcuccagccuggugaucuccggccuccugagcaugcugauccucuccuucgucacccccaucgaggggaccaucacgaacuaccccgacagccgcaaguacacccuggaggagaucaccgacgugguggagggccugaucuccgagcagaacaucaaggaguacaucgucuucuacaccagccucuucgggucccugauccugcuccuggccuucaucaugagcaucacgcuguccaagaucaccagcauccucgcccggcgcaacgugaucuacugcgaggagugcuccauguaccacagcaagcggggcaucaaguacaacggggacuucaccaacaagugcggcuucugcacgugcaacgagcaggaggacgcggagggcguggucauccacaagguguccaagcgcugcaccuacaaguaccagcugaagugggccaaggugcugaugaucacccucguccugcugcugaucgcccagaacaccauccucaucguggccgccgagaccgacugcugggcgaagaagucccuggacaucaacugcaucgggccgaugcugaacaucggcagcugcacgaacaagaacacccggagcuacgacaccgaggcccagaagcucgugagccaguccaaggucagccagcuggacgccgaccaggccucccugcucgggagcuccaucgacagcgccaucaaggcgauccgcgcccagaagaccuaccccgccaugcaccuccuggagaccaucuuccucaugaagaacugcgacuacuacacguccuucaaccacaacagcggcuacucccaggccaaguggcggcugaucgccaagaccgggcacuucgacaucugcagccgccacuccacccaccacuucugccggugcaucaacgacggcaccaagugccagaacggcgacugggacuucgcgggggagaugaacgagacguacaacagcaagaacgacuucuaccugcacgaccucaaccuguucuacaccaucuucgagaacgccuuccccggcaccaccgagucccuguucuaccagcucauccagaagcgcaacacgaucggggccagcaaggugcugggcaagcugaucaccaaguacggggacaacaacauguucgucggcguguggaaguucggccaguaccuccugacccugcccuacaucaacaacaccgagcucucccagaaccggcgccagacgauccuggccgcgcaggagcugagcagccgcucccacccggggcggcaggagagcauguccagcgccauccagggcuccgugaccaaggagugccacaacgccaaggacgucgggugcaucagcccccgcuucggcauccccaucggcaaccucaccgccugcggggacucccccaacuacaagaucuacaagaccccggagaagcuguacaagagcaacaacaagggcgagguguggugcuccaacgacgugcacugccugaacgacuucgagcccgccgacgaggaggucgugaacaaggugaagaagcucacgugcuuccugaccgacgucagcgugaagaccgacaucuucuccguggcggccagcacgugcaagauggccgacaagggggucugcaccgugaacgacgccaaguggaacaucaucaagugcgacuccggccuguacuacuucaccgaccaccgggaggggcaggacaccggcaacgacuucggcgaguacugcaucagccacuccugcaacaccgagcgcuuccccaucaaccccgacauccucaaggacugcacgugggaguuccacagccggaaguccaaguacaucagcaccaucucccuggagagccuggaggaguuccgccgggccaugaccgagaagcucagccacacccugacgaucuacaacuucaagccgaccgcgaaccugccccacauccgccccaccuacaaguucaucaccgccaacgggguggagaacuccgacggcaucgagagcgccuacauccucuccagcauccccgcccucgggggcaucuccgucggguacaacgugcagacgaaggacaacuucccgcugcuggacaucaucguguucgucaagagcgccgugauccggaccaccuacaaccacaucuacgacaccggccccacgaucggcaucaacacccagcacgacgagcacugcaccgggcccugccccgcgguggucccgcacaaggagaacuggaucaccuucucccaggagcgcaccagccgguggggcugcgaggaguucgggugccuggccaucaacacgggcugcguguucggguccugccaggacaucauccaccccgagaccaagguguaccgcaaggccgucgaggaggagguggugcugaccgucugcaucaacuuccccggcaacaacuacugcaccgagaucaacgccaucgagccgaagaucacggacgagaucgagcuccaguucaagaccguggacaccaagacccugcccaaccugcucgcggugcagaaccacaagcuguacagcggccagaucaacgaccugggguccuucagccagggcugcgggaacguccagaagacgaaccacuccauccucggcauggggaccgccaaguucgacuacgugugccacggcgccagccggaaggacgugaucguccgccggugcuacaacaacaacuucgacuccugcaagcugcugaaggaggagaccagccucguguucgccgacaaccacgagacccuggagguggcccacacgaagcaccugaucggcgagcuccaguucaagaucaugcugggggacauccgcuacaaguccuucgcggagagccccgagcuggagaucgacgccaagugcgucggcugccccuccugcuucgagagcuacagcugcaacuuccagaucgugaccaacaucgacaccgugugcuccgucgaggggccgugcacccucuuccacaaccggaucaucaucagcgccuccaagcagagcuacggccugaagauguccugccagacgaagcccagccagaacgaggaguucaucaucugcaaccgcaaguacuccgugcuguucaccaccaucgacaagaacgacaagaucgaggugaacaccggcgaccagacgagcuacaucuacgagaaggacucccggugcaagaccuggcucugcaagguccgcgacgaggggaucagcgugcuguucgagccccugaaggccuucuucggcuccuacuucagcaucaucuucuacguggucguggggaucaucgugcuguuccuggucaucuacaucuuccugcccauguucuucaagcucaaggacgugcugaagaagaacgaguaccuguaccuccaggagcugaagcaccgcuga

SEQ ID NO: 12556 - RNA, 4314 nt, Artificial Sequence
  derived and/or modified CDS sequence (opt1) from GERV__M21951.1__GP
auggccaucagcaccucccugcucaucguggcccugcugaucaagcucugccuggucaacaccgcgcccccgaucagcaagugcuuccaggacggcauccugaucgccgagcucaaguccagcuccgggaucagcgaguucugcaucaaggacgacaucuccauccucaagagcgagaucacguacuccaagaacgacaccggcaucuucaugcacagcaagguguuccgccacuggaccguggccgacuggaagcagugcaaccacaccuccgccgggggcagcacgaacguccuggagguggacaagaaccucaaccugguggccaagaacuacaugugcacccggcccugcgucaucaccaucgacaaggagaacgcgcagcugcuguuccagaccgagcagcugaaccaguucgaggugacggggaccaccaucuccaccggcugguucaagagcaagacguccgugagccuggacaacacgugcgagcacaucaaggugaccugcggcaagaagucccuccaguuccacgccugcuucaagcagcacaugagcugcguccgcuuccugcaccgguccgugcugcccggguacauggccagcagcaucugccagaacaucgagcucaucaucaucaucauccugacccuggccaucuucaucuucaugugcaucaucacgcgcaccuacaucugcuaccucaugcugccccuguucgcgccgaucgccuaccucuacggcuggcuguacaaccgguccugcaagaagugcaucugcugcgggcuggccuaccaccccuucaccaacugcggcagcuacugcgucugcgggucccgcuucgagaccagcgaccggaugcgccuccaccgggaguccggccugugccagggcuucaagagccugcgcguggcccggucccucugcaagagcaagggguccagccuggugaucuccauccugacggccaugcucauccugagcuucaucacgccccuggaggcgaugaccaccaacuaccccgacgacaagaaguucacccucaaggaggucaacgacaucgugcugggccgcgacauggagcaggagcugaaguccagcauccucauccugauguccaucugcgggaucggcaucauccugaucuucuucggccucaccgugcugcuggagaucguccucgagcugaucgccaagcggagcaccaucuucugcaaggagugcaaccugauccacgacaagaaguccaugaccuaccgcggggacuucacgaacaagugcggcuucugcccgugcggggagcucgaggaccccgagggccuggugauccacaccacccgcaagagcugcaccuacuacaucaagauccggaaccugaagcugaucaugcucaucuucuccaucgugauccugaugcagaacgccacgaugcuggucguggccggggagaacugcuggaccaacaccgagaucaaggccgacugcgugggcccccucaucggccccagcgcgugcaccaacaaggggagcaagacguacaagaccgucgcccaggagcuggugaccgccuccaagaucacccagcuggacgccgacaaguacguccuccugggcgacaccaucgagagcgcccuggacgcgaucacgucccagaagcacuacagcgccaugcaccuccuggagaccauguuccugaugaagcacugcgacuacuacaagguguacgagcacaacuccggguacagccagaccaaguggcggcucaucgccaucgccaacuccuucgacaucugcaccaacacgccgacccccaacuucugcaagugccugagcgacuccagcugcuccaccaccacgcugaacuucgccaccagcaugaacgcgaccuacaccuccaagguggaguucuucaaccacgacuucacccucuuccuggacaucuucgaggccgccuuccccggcagcgccaccgcguuccuguucaagaagaucaaggagaagaaccccuaccaggccuucgagaugauggggaagaucgccaacaaguacccgaacaacaagcuccuggucgugauccugaaguacggccaguacauggugggccucucccacgccagcaccuaccagcugaagcaggagugggucgccaagucccugagccucacccgcgcgcagcggacggggcugaagaugagcauggccaacgccgagcccggccccgccaccaaggagugcuccgacgccaagaccaucgcgugccugacccccaaguuccagguggaggugaacaaccucaugagcugcggggccuccccgaacuucaagaucuacgucaagacgggcgagcuguacaaggcccacgaccgcaacagcguguggugccugaacgacaugcacugccucacccccuacacccccgccaacgccgagaucaucaccacgaugaagaagauggacugcuggcaggacaaccccaagcagccgaccgacgaguacgcgauccccaagcgguccugccagaugaaggaccgcgggcugugcaacagcggcgccgacaaguggaagaucaucaagugcgacaaccacaagcuguucuacaccgacgcccucgagcgccgggaccccgccuccaucgugggcagcaaccacugcuucuccgagaagugccagaucgagcgcuaccccaucaacccgaccagccugacgaacugcgaguggcuguaccgggcgguccgccccgaguacaucaagaagcucucccugcagaccaucgaggaguacaagaaggccaucgccgacaagcugacccacacccuccagcuguaccacuucgcgccccugcucgagaaccugccgcacaucaagcccacguacaaguacaucaccgcccaggggaccuacaccgccgacggcaucgagggggccagcaucacgaccuccauccccgcccugagcggcaccuccgugggcuucaagaucaacgccaaggacgggaccgaccuccuggacaucguggucuacaucaaggccagcguggugaaguccaucuacaaccacaucuacgacaccggccccacgaucaacaucaacagcaagcacgacgagcugugcaccgggcagugcccgaagaagauccccgcggaccccaacuggcucaccuucucccaggagcggaccagccgcuggggcugcgaggaguucgggugccuggccaucaacacgggcugcgucuacggcagcugccaggacgugauccggaccgagaccaagguguaccgcaaggccaacgaggagaccgucaugcugacggugugcaucaccuaccccgggcacaccuucugcaccgacgugaacgcccacgagccgaagaucacggacgagcucgagcugcaguucaagaccaucgacaucaagucccugcccaaccucgucgccgugaccaaccacaagcuguacaccggccagaucaacgaccuggggacguucggccagaugugcgggaacgugcagaagaccaacaccagccacaccggcgcgggcacgcccaaguucgacuacacgugcuacuccgccagccggaaggacaucaucauccgccggugcuacaacaacaacuacgacuccugccgccuccugaaccaggagagcgaccuccuguucgacgacaaccacgagacccuggucguguacaacaacaagcggcugaacggggagcucgcccugaagcugcuccugggcgacauccaguacaagcuguacaccgagaacauggagcucgagcuggaggccaagugcguggggugcgucggcugcuucgaguccuaccagugcaaccugcagaucaccagcucccucgacgagaccgcgcuguaccuggugcccgugagccacuuccacgaccgcauccagaucaagaccaccaagaaggacuacgccaugaagaucuccugcacgcgggacccgggggacaaggccagcuuccgcgucugcggcaaguccuacgacuucaacuuccacaccgugcccaagaacgacaagaucgaggugaacgucggcgacgagaccagcuacaucaaggagaaggacaaccggugcgggcgcuggcucugccgggugcgcgacgagggccuguccgugaucuucgagccccugaacaacuucuucgggaacuaccucaacauguuccuguacauccugggcgggaucauccuccuguuccuggcccucuacauccugaugcccaugugcgcccgccugcgggacgagcucaagcgcaacgagcggcugcaccagauggagaugaagaagcgcuga

SEQ ID NO: 12557 - RNA, 4260 nt, Artificial Sequence
  derived and/or modified CDS sequence (opt1) from IACOV(BeAn314206)__JN572066.1__GP
augcgcgugaucgcccuguuccaccucgucauggugaucaccgccaaccccguguuccaccggugcuuccagggcgggcagcugauccuggagaagaagucccacgucagcaugagcgaguucugccucaaggacgacguguccauggucaagagcgugguggaguacgagaagaccaacaacuccaucgugggcacgaacaaggucuaccgccaguggguggugagcgacuggaagcugugccacccgaucaaggcggagggcggcgggaucaacaucaucgaggucgagaaggaccugaccaucaaguccaacaccuacaucugcaccacggacugcaccaucaccguggacaaggagaacgcccagaucaucuuccagaccagcaagcucaaccacuucgaggugacggggaccacccuguccaccggcugguucaagacgaaggccgccgucacccuggaccagaccugcgagcacauccgggugagcugcgggaagaaguccauccaguuccacgccugcuuccgccagcacaugaccugcgugcgguuccuccaccgcagccugcugcccggcuccauggcgaacagcaucugccagaacgucgagcucaucaucaucaucgugcugacgcugcucaucuucaucgugcugaacaucaucgccaagaccuacaucugcuaccugaugcuccccaucuucaugcccaucgccuacaucuacggguggaucuacaaccgguccugcaagaagugcgucaacugcggccuggccuaccacccguucagcaacugcgggucccacugcgugugcggcgcgaucuuccagaccagcgaccgcaugcggaugcaccgcgaguccggccugugcagcggguucaagagccuccggguggcccgcguccugugcaaguccaagagcuccagccuggugaucgccauccucuccagccugcugauccucuccuucgucacccccaucgagggccuggaccuggaggagaagaaguacagccucuccgaccugcccgacaucuacacgaaggagcugaacacccucagcgagaagaucgccaucaacuucuacaucuccaucaccaacaugcugaucaccaucauccugcucaucguggccuucugcagccacugcaucacgaacaagaucgugaaguacaaggcguuccugugcaccgagugcgacauguaccacaccuacaagaacauccgguacaacggggacuucugcaacaagugcggcuccugcacgugcggcaccauggaggaccccaacuacaccaccaugcacaaggucagcgaccugugccucgccgagccgaagcgcaucauccagaagaagcugaugaucauccugaucaucuucgugaucaucgagaacggggccugccucgccuccgccgaggagaagugcuucaaggagcacgacuacaacaucgagugcaucggcccccugaucaccaugcggcccugcacgaagaagaccauccaggagguggcgcgcacccuggucaccgacaagcagaucgcccaggaggacacggagaagaucgagcuccugcccgacagcaucgugcaggccuggaacaugaucgacaaccagcugaacuacgaccagauguuccucauggaguacgccuuccugaagcgggagugcuccuucuucgaggaguucgagcacaacagcggggugaaccagaucauguggcgcaccaucgccaagaccggccacuucgacaucugcgcgauccgguccagccagcgcuucugcaagugcaugagcgaguccgucuacugcaaggacgccaacugggacaucgccaacgagaugaacgacaccuacagcuucaagccgcuguucuaccggcacgacgugaagcuguacuccaagaucuucaaggccgccuuccaggggaccacgcucaagaccuacgagaaguuccugaacgcgaagaacaagaccgagcugaucaacaugcucaagaagcugggcaagcgcuuccccuacaacaaccugcucaugggcuuccugaaguucggggagcuccucuucgaccugacccuguucgacgcccuccccaaggacaagacgagccgcaccuccagcaccaccgccaagcgggaguacgagaaccugcaggacgccaaggugggcgagcccacguccgagugcaaggacaugaagcugcuccagugcaucagcccgcgcuaccaggucuccguggggagcgugaucaagugcggcgacaccgagaagaagaucuacgacuuccacacccccgucuacaagcuggcgaccgacgagacgaaguggugccgguucgacaagcacugccugcacgagugggugcccaucgacaacgcccgccucgagaugcugaagaagcugaacugcugguacaccgaccccaccgagaugguggacaucuacaccacgucccgcaagagcugccggaugaucaacaaggggaccugcaacaucaagaacgccccgaugaccgucaugcagugcgacgacgaccucaucuucuacaccgaccaccgguccagcgccgacacgcagggcgacaucggcgaguacugccugucccagaacugcgacgugagccgcuaccccaucaacgugauggacgggaugaccugcaccugggaguacaacaccgucaagcccaaguaccuguccaagacggagcucaagacccuggaggaguacaagcggacccugcaggacaagcucagccacaaccuggagguguaccacuuccacaugaccgccaacuucccccacaucaagccgguguacaaguacaucacggcgggcggggucgagaccagcgacggcaucgagggggccuucauccugguggaccuccccgcccuguccggcaccagcgugggccugaccguccucuccaaggacgacgugccccugauggacgugaucaucuacaucaagagcgccgucaucaaggccacguacaaccacaucuacgacaccgggcccaccaucggcaucaacgugaagcacgaggagcugugcaccgggccgugcccccagaacaucccccaccaggagcaguggcucacguucucccaggagcgcaccagccgguggggcugcgaggaguucggcugccuggcggugggggagggcugcgucuacggguccugccaggacaucaucaagaaggagacccgcguguacaagaaggugagcgaggagaucaacgagaucaccuucugcaucaucuuccagaccaacacguacugccagaccaugaacgccaucgagccgcagaucacccccucccuggagguccagcucgagggccuggacaccaagauccugcccaacauccucgcccugcagaaccacaagcuguacagcgggcagaucaacgaccucggcuccuucggccuggccugcgggaacgugcagcaggucaacaagacgaucuacggcgccgggcagcccaaguucgacuaccugugccacggcgcgaagcggaaggacaucaucgugcgcaagugcuacaacaacaacuucgggagcugcaagcuccugaccaucgaggacaaccugaucguggaggacaacuacaacaccaucaacgugaucaacaccaagcaccucaucggcacggucaaguccaagcugaaccugggcgacauccgguacaagcuguucaacaagaagccggaguucgagcuggaggcccacugcguggggugcgugggcugcuucgccaacuacaacugcgagaucaagaucgagagcaccaucgacaugaccugccccaucuccgggcccugcgaguucuuccacaacaacaucuucauccaggccgagcacaccaaguacgcgaugaagaugaucugcaagaagcagcccgaccagacgaccgaguucaccaucugcgacaagaaguaccacuucaucaucgacaccgucgagaagcacgaccagaucgagaucgacgugggcgaccagacgagcuacauccuggagaaggacaaccgcugcgggaccuggaugugcaaggugcucgacgagggccuguccgucaucuucgagccgcugaagcuccugcugggcaacuacuuccacauggccaucgugaucaucaucgggcucaucgcccuggccgugaucaucuacauccugcuccccauguucaugaagcugcgggacacccugaaggccaacgagaucgcguaccagaaggagaugaagaucaaguga

SEQ ID NO: 12558 - RNA, 4305 nt, Artificial Sequence
  derived and/or modified CDS sequence (opt1) from ILEV(KO/2)__AY859372.1__GP
augcuguuccccaucauccuccugaugauccagcuggugagcuccaccccgcucagcacccgcugcuuccacgagggcacgcuggucaaggagaagaucuccaccaccagcaucuccgaguucugccugaaggacgacgugagcaugaucaaguccgagaucaccuaccagaagaacgacacggggguguacggccacagcaagaucuaccggaacuggaucgucaaggaguggaaggccugcaaccccgugcccuccgccgggggcagcaucaacgugaucgaggucaacgaggacaugucccucgcgaccaagaacuacaucugcacccgcgacugcgugaucaccguggacaaggaggacgcccagaucgucuuccagacggacaaccugaaccacuucgaggugagcgggaccacccuguccagcggcugguucaagaccaaggccuccgugacgcucgaccggaccugcgagcacaucaaggucagcugcggcaagaagaccgugcaguuccacgccugcuuccgcaaccacauguccugcgugcgguucuuccacaacaccauccugcccggguacauggccacgagcaucugccagaacaucgagcugaucaucaucaucguccucaccaucgcgaucuucaucaugcuggugauccugaccaagaccuacaucugcuaccuccugaugccgcuguucaugcccaucgccuacugcuacggcugggccuacaacaaguccugcaagaagugcaacugcugcgggcucgccuaccaccccuucacgaacugcggcagcuucugcgugugcgggcugaaguucgaggcgagcgaccgcaugcggauccaccgcgaguccggccugugccagggcuacaagagccuccgggucgcccgccggcugugcaaguccaaggggagcuccuucgugaucagcauccugcucucccuguucauccugagcuucgugacccccaucgagggcaccaugaccaacuacccggaggagcgcaaguacacgcucgaggagaucgccgacgucaucgagggguucuaccaggaggccaagaucaaggaguacaucguguucuacuccagcaucuucggcuccuucauccugaucagcuccaugcugauccucuacaagcugcagaacaucaccuacuuccugagcaaguucaacgugauguacugcuccgagugcagcauguaccacuccaagaagaacaucaaguaccucggcgacuucaccaacaagugcggguucugcacgugcggcgagcuggaggacgccgaggggcugagcauccacaaggucacgaagcggugcaccuacgcguaccagaugaccuggaccaagaucauccucgccacgcugcugauccuccugaucggccagaacacccugcucguggucuccgcccaggccgacugcugggagaagaccgagaucaccaucgacugcaucgggcccaucuucgcccccaacacgugcaucaagcaggaggagaagaccuacgcgaaggaggcccagacccugguggaccagaacaagaucagccaggccgacgccaagcaggucgacaugcugggcgccaccaucgacgacgcgaucaaggccauccgcagccagaagaccuacacgaccaugcacaugcucgaggccaucuuccuguccaaguacugcgacuacuacagccuguucgagcacaacuccggcuacagccaggggaaguggcggcucaucgccaagaccgaguccuucgacaucugcagccgccacaccacgcaccacuucugccggugcauguccgacgagaccaagugcaagaacggcgacugggacuucgccggggagaugaacagcaccuaccacuccaagagcaacuuccugcugcacgaccugcgccucuucuacaagaucuacuccgcggccuuccccggccugagcgaggccaugcuguacaaguuccucuccgagaaggacaccacgaacgccaucaagcugcuggagaagcuguucaccaaguacagcuacaacaaccuccugguggggauccuccgguucggcaaguuccuguucuccaugagcaucuucaacaccaccgagcugggcggggcgcagaaggccaugauccuccgcccgacggacgagcugcggaccaccuacuccggcaagcaggagagccugagcaacuccguggugggggagcagaccagcgacugcgucaacaugaagaagaucuccugcaucagcccccgcuucaacaucccccucuccagcaugaucgccugcggcaaccagcccaacuaccagaucuacaaggagccguccaaguacuacaagagcaacaacaagcccaacacguggugcaacaaggacauccacugccugaacgacuucgaguccaucgaccagagcgcccuggaccgccucaagaccaugaccugcuuccugaucgaccccaucaccacggaggacguguacuccaucgccauccacagcugcaaggugaaggacaaggggcagugcaccauccgggacaagaaguggaacaucaucaagugcgacuccgagcugcucuacuacaccgaccaccgcgagggcgaggacaccggcaacgagaucgggcacuacugccugagccacaagugcggcacggaccgguaccccaucaacccggagaucaucaaggacugcaucugggaguuccgcucccgcaagagcgaguacaucaaccgggucgaccuggagucccucgaggaguucaagcgggcgcugagcgacaagcugacccacacccucaccaucuacaacuucaagcccacggccaaccugccccacaucaagcccaucuacaaguacaucaccgcccuggggguggagaacuccgacggccucgaggccgccuacauccugaccagcaucccggcgcugggcgggaccagcaucggcuacaacaucaugacgaaggacaacuuccccgugauggacgucaucaucuacgugaaguccgccgugauccagaccaccuacaaccacaucuacgacaccgggcccacgaucggcaucaacagcaagcacgacgagaagugcaccggguccugcccccagaacaucacccacgaccagaacuggcucaccuucagccaggagcgcgccucccgguggggcugcgaggaguucggcugccuggccaucaacaccgggugcgucuucggcagcugccaggacaugauccgcuccgacacgaagguguacaagaaggcccuggaggagaccgugguccucaccgugugcaucaacuacccggggaacaccuucugcacggaggugaacagcgucgagaccaagaugaccgacgacguggagcugcaguucaagaccguggacacgaagacccugcccaaccuccuggcggucaccaaccacaagcuguacuccggccagaucaacgaccucgggagcuucucccagaugugcggcaacgugcagaagaccaacagcacggugaugggcgccgggaccgucaaguucgacuacaucugccacggcgccucccggaaggacaucaucauccgccggugcuacaugaacaacuacgccagcugcucccugcugaaggaggagaaggaccucaucuucgcggacaaccacgagaccaucaccgugagcaacuccaagcaccuggugggggagcugcagaucaagcucaugcugggcgacauccgcuacaagcuguucgccgagcggcccgagcucgaggucgacgccaagugcguggggugcccgagcugcuucgaguccuacagcugcaacuuccagaucgugacgaacaucgacaccgucugcacccuggagggccccugcaccaucuuccacaaccgcaucaucaucagcuccacgaagcagagcuacggcaucaagauguccugccccaccaagcccaaccacaucgagaaguucaagaucugcaaccacgaguacgacauccuguucgacaccguggccaagaacgacaagaucgagaucgacaccggggaccagacccucuucgugcgggagaaggacacccgcugcaagaccuggcugugccgggucaaggacgagggcaucagcgugaucuucgagccgcugcgcgccuucuucggguccuacuucagcaucaucuucuacaucauccucgcggccauccugaucuucgugggcgucuacaucuuccugcccauguucaugcgccuccgggacgugcugaagcgcaacgagcaccuguaccuccaggagaucaagcacaaguga

SEQ ID NO: 12559 - RNA, 4305 nt, Artificial Sequence
  derived and/or modified CDS sequence (opt1) from ILEV(R5964)__KF234074.1__GP
augcuguuccccaucauccuccugaugauccagcuggugagcuccaccccgcucagcacccgcugcuuccacgagggcacgcuggucaaggagaagaucuccaccaccagcaucuccgaguucugccugaaggacgacgugagcaugaucaaguccgagaucaccuaccagaagaacgacacggggguguacggccacagcaagaucuaccggaacuggaucgucaaggaguggaaggccugcaaccccgugcccuccgccgggggcagcaucaacgugaucgaggucaacgaggacaugucccucgcgaccaagaacuacaucugcacccgcgacugcgugaucaccguggacaaggaggacgcccagaucaucuuccagacggacaaccugaaccacuucgaggucagcgggaccacccuguccagcggcugguucaagaccaaggccuccgugacgcucgaccggaccugcgagcacaucaaggugagcugcggcaagaagaccguccaguuccacgccugcuuccgcaaccacauguccugcgugcgguucuuccacaacaccauccugcccggguacauggccacgagcaucugccagaacaucgagcugaucaucaucaucgugcucaccaucgcgaucuucaucaugcuggucauccugaccaagaccuacaucugcuaccuccugaugccgcuguucaugcccaucgccuacugcuacggcugggccuacaacaaguccugcaagaagugcaacugcugcgggcucgccuaccaccccuucacgaacugcggcagcuucugcgugugcgggcugaaguucgaggcgagcgaccgcaugcggauccaccgcgaguccggccugugccagggcuacaagagccuccggguggcccgccggcugugcaaguccaaggggagcuccuucgucaucagcauccugcucucccuguucauccugagcuucgugacccccaucgagggcaccaugaccaacuacccggaggagcgcaaguacacgcucgaggagaucgccgacgugaucgagggguucuaccaggaggccaagaucaaggaguacaucgucuucuacuccagcaucuucggcuccuucauccugaucagcuccaugcugauccucuacaagcugcagaacaucaccuacuuccugagcaaguucaacgugauguacugcuccgagugcagcauguaccacuccaagaagaacaucaaguaccucggcgacuucaccaacaagugcggguucugcacgugcggcgagcuggaggacgccgaggggcugagcauccacaaggugaccaagcggugcaccuacgcguaccagaugaccuggaccaagaucauccucgccacgcugcugauccuccugaucggccagaacacccugcucgucguguccgcccaggccgacugcugggagaagaccgagaucaccaucgacugcaucgggcccaucuucgcccccaacacgugcaucaagcaggaggagaagaccuacgcgaaggaggcccagacccuggucgaccagaacaagaucagccaggccgacgccgagcaggucgacaugcugggcgccaccaucgacgacgcgaucaaggccauccgcagccagaagaccuacacgaccaugcacaugcucgaggccaucuuccuguccaaguacugcgacuacuacagccuguucgagcacaacuccggcuacagccaggggaaguggcggcucaucgccaagaccgaguccuucgacaucugcagccgccacaccacgcaccacuucugccggugcauguccgacgagaccaagugcaagaacggcgacugggacuucgccggggagaugaacagcaccuaccacuccaagagcaacuuccugcugcacgaccugcgccucuucuacaagaucuacuccgcggccuuccccggccugagcgaggccaugcuguacaaguuccucuccgagaaggacaccacgaacgccaucaagcugcuggagaagcuguucaccaaguacagcuacaacaaccuccugguggggauccuccgguucggcaaguuccuguucuccaugagcaucuucaacaccaccgagcugggcggggcgcagaaggccaugauccuccgcccgacggacgagcugcggaccaccuacuccggcaagcaggagagccugagcaacuccguggugggggagcagaccagcgacugcgugaacaugaagaagaucuccugcaucagcccccgcuucaacaucccccucuccagcaugaucgccugcggcaaccagcccaacuaccagaucuacaaggagccguccaaguacuacaagagcaacaacaagcccaacacguggugcaacaaggacauccacugccugaacgacuucgaguccaucgaccagagcgcccuggaccgccucaagaccaugaccugcuuccugaucgaccccaucaccacggaggacgucuacuccaucgccauccacagcugcaaggugaaggacaaggggcagugcaccauccgggacaagaaguggaacaucaucaagugcgacuccgagcugcucuacuacaccgaccaccgcgagggcgaggacaccggcaacgagaucgggcacuacugccugagccacaagugcggcacggaccgguaccccaucaacccggagaucaucaaggacugcaucugggaguuccgcucccgcaagagcgaguacaucaaccggguggaccuggagucccucgaggaguucaagcgggcgcugagcgacaagcugacccacacccucaccaucuacaacuucaagcccacggccaaccugccccacaucaagcccaucuacaaguacaucaccgcccugggggucgagaacuccgacggccucgaggccgccuacauccugaccagcaucccggcgcugggcgggaccagcaucggcuacaacaucaugacgaaggacaacuuccccgugauggacgugaucaucuacgucaaguccgccgugauccagaccaccuacaaccacaucuacgacaccgggcccacgaucggcaucaacagcaagcacgacgagaagugcaccggguccugcccccagaacaucacccacgaccagaacuggcucaccuucagccaggagcgcaccucccgguggggcugcgaggaguucggcugccuggccaucaacacggggugcguguucggcagcugccaggacaugauccgcuccgacaccaaggucuacaagaaggcccuggaggagaccguggugcucaccgucugcaucaacuacccggggaacacguucugcaccgaggugaacagcguggagaccaagaugaccgacgacgucgagcugcaguucaagacgguggacaccaagacccugcccaaccuccuggccgugaccaaccacaagcuguacuccggccagaucaacgaccucgggagcuucucccagaugugcggcaacguccagaagacgaacagcaccgugaugggcgcggggaccgugaaguucgacuacaucugccacggcgccucccggaaggacaucaucauccgccggugcuacaugaacaacuacgccagcugcucccugcugaaggaggagaaggaccucaucuucgccgacaaccacgagaccaucacggucagcaacuccaagcaccuggugggggagcugcagaucaagcucaugcugggcgacauccgcuacaagcuguucgcggagcggcccgagcucgagguggacgccaagugcgucgggugcccgagcugcuucgaguccuacagcugcaacuuccagaucgugaccaacaucgacaccgugugcacccuggagggccccugcacgaucuuccacaaccgcaucaucaucagcuccaccaagcagagcuacggcaucaagauguccugccccaccaagcccaaccacaucgagaaguucaagaucugcaaccacgaguacgacauccuguucgacaccgucgccaagaacgacaagaucgagaucgacacgggggaccagacccucuucgugcgggagaaggacacccgcugcaagaccuggcugugccgggugaaggacgagggcaucagcgucaucuucgagccgcugcgcgccuucuucggguccuacuucagcaucaucuucuacaucauccucgccgcgauccugaucuucgugggcguguacaucuuccugcccauguucaugcgccuccgggacguccugaagcgcaacgagcaccuguaccuccaggagaucaagcacaaguga

SEQ ID NO: 12560 - RNA, 4305 nt, Artificial Sequence
  derived and/or modified CDS sequence (opt1) from MAGV__AY286443.1__GP
auggagcugcucaucaucauccugcugcucggcagcgccgccuccagccccaucuccacccgcugcuuccacgggggccagcugaucgcggagagcaaguccgccaccagcaucuccgaguucugccugaaggacgacgugagcaugaucaaguccgaggucacguacaucaagaacgacaccgggaucuacggccacaacaagguguuccggagcuggaccaucaaggacuggaagcucugcaacccgauccccaccgccgggggcuccaucaacgugaucgaggucaacagcgaccugucccuggccacgcgcgccuacgugugcagccgggacugcaccaucaccaucgacaaggaggacgcgcagaucaucuuccagaccgacaagcucaaccacuucgagguguccggcacgacccugagcuccgggugguucaagaccaaggccagcgucacccuggaccgcacgugcgagcacaucaaggugaccugcggcaagaagucccuccaguuccacgccugcuucaagcaccacaugagcugcauccgguucuuccaccacaccauccugcccgggaccauggugagcuccaugugccagaacaucgagcugaucaucaucaucggccucacgcuggucaucuucauccugauggugauccucaccaagaccuacaucugcuaccugcugaugcccguguucaugccggucgccuacaucuacgggugggcguacaacaagagcugcaagaagugcaacugcugcggccucgccuaccaccccuucaccaacugcggcucccacugcgugugcgggcugaaguucgaggccagcgaccgcaugcggcugcaccgcgaguccggccucugccagggguacaagagccugcggaucgcccgcaugcugugcaaguccaagggcagcucccucgugaucagcggccugcuguccaugcuccugcugagcuucaucacgcccaucgaggggacccucaccaacuaccccaacgagaagcaguacacccuggaggagaucgccgacgucguggagggcaucaucacggagcagcaccugaaggaguacguggucuucuacaccucccucuucgggggccugauccugcuccugacccugauccucagcaucaccaucaacaaggugacggaccugcuggcguccaccaacgugaucuacugcgaggagugcagcauguaccacuccaagaaggggaucaaguacaacggcgacuucaccaacaagugcggcuucugcacgugcagcgagcaggaggacgucgagggggugaucauccacaaggugucccggaagugcacguacaaguaccagcucaaguggguccgcgugaucaugaucauccuggcccugcuccugaccauccagaacaccguccugaucguggccgccgagguggacugcuggaccaagaaguccaucgagaucgacugcaucggcccgcugcucaacaucgggagcugcacggacaagagcagccggaccuacgagaccgaggucaacaagcuggugcgccaguccaaggugacccacgccgacgcggagcagaucagcauccugggcuccacccucgacaacgccaucaaggccguccggagccagaagacguacgagaccaugcacuuccuggagaccguguuccugaugaagaacugcgacuacuacaacuccuucgagcacaacagcggguacucccagaccaaguggcgccucaucgccaagacgagccacuucgacaucugcucccggcacagcacccaccacuucugccgcugcgugaacgagggcaccaagugccagaacggcgacugggacuucgccggggagaugaacgacaccuacaacuccaagaacgacuucuaccugcacgaccuggaccucuucuacacgcugcuggagaacgcguuccccggcaccaccgagagccucuucuaccagcugcugcagaagaagaacaccacgggggccuccaagcuccugggcaagcugaucaccaaguacgggaacaacaacauguucgucgagaucuggaaguucggccaguaccuccugaagcugcccuacaucaacgacaccgagcucagcaccgaccggaaguccacgaucaucaagagccagcagguccugagccgcucccagaccggccggcaggagagccuguccagcgccacccccgggaccgccacgaaggagugcuccaacgccaaggacaucggcugcaucagcccgcgcuucgggauccccaucggcaaccucaccgcgugcggcgacucccccaacuacaagguguacaagacccccgagaagaucuacaagagcaacaaccgcggggagguguggugcuccgacgacgugcacugccugaccgacuucgagccggccgaggaggagguggucaaccggaucaagcagaugacgugcuuccugaccgacgugaccaccaagacggacguguucagcgucgccaucuccacgugcaagaugguggacaagggcgugugcaccgucaacgacgccaaguggaacauccucaagugcaacagcgggcuguacuacuucaccgaccaccgcggcgggcaggacaccggcaacgacuucggcgaguacugcaucucccacagcugcaacaccgagcgguuccccaucaaccccgacgugcugaaggacugcaucugggaguaccacucccgcaagagcaaguacaucuccaccgugagccucgagucccuggacgaguuccggcgcgcgaugagcgacaagcugagccacacccucaugaucuacaacuucaagcccacggccaaccugccgcacaucaagcccaccuacaaguucaucaccgccaacgggaucgagaacuccgacggcaucgacagcgccuacauccuguccagcauccccgcccucgggggcauguccgucggguacaacauccagaccaaggacaacuucccccugcuggacaucaucguguucaucaagagcgcgaucaucaagaccacguacaaccacaucuacgacaccggcccgaccaucggcaucaacacccagcacgacgagcacugcacggggcccugccccacccucaucccccacaaggagaacuggcugaccuucucccaggagcggaccagccgcuggggcugcgaggaguucgggugccuggccaucaacacgggcugcguguucggguccugccaggacaucauccacccggaggccaaggucuaccggaaggccaucgaggaggagguggugcucaccgucugcaucaccuuccccggcaacaccuacugcacggagaucaacgccaucgagcccaagaucaccgacgagaucgagcugcaguucaagaccguggacaccaagacgcugccgaaccuccugauggugcagaaccacaagcuguacagcggccagaucaacgaccucggguccuucagccagggcugcgggaacguccagaagaccaaccaguccgugaucggcgcggggaccgccaaguucgacuacgugugccacggcgccagccgcaaggacgucaucgugcggcgcugcuacaacaacaacuacgaguccugcaagcugcugaaggaggagaccagccucaucuucgccgacaaccacgagacgcuggagguggccaacaccaagcaccugaucggcgagcuccaguucaagaucaugcugggggacauccgguacaaguccuucgcggagagccccgagcuggaggucgacgccaagugcgugggcugccccuccugcuucgagagcuacagcugcaacuuccagaucgugaccaacaucgacaccgucugcuccguggacgggcccugcacccucuuccacaaccgccugaucaucagcgccaccaagcaguccuacggcuucaagaugagcugcccgcggaagcccgagcccaccgaggaguuccagaucugcaaccgcaaguacaacgugcuguucaccacgaucgacaagaacgacaagaucgagaucaacaccggcgaccagaccuccuacaucuacgagaaggacaaccggugcaagaccuggcucugccgcguccgggacgaggggaucagcgugaucuucgagccccugaaggccuucuucggcuccuacuucagcaucaucuucuacguggucguggggaucaucgugcuguuccucacgaucuacaucuuccugccgauguucuucaagcugcgcgacauccucaagcgcaacgaguaccuguaccugcaggagcucaagcacaaguga

SEQ ID NO: 12561 - RNA, 4305 nt, Artificial Sequence
  derived and/or modified CDS sequence (opt1) from MAGV(ts8)__AY286444.1__GP
auggagcugcucaucaucauccugcugcucggcagcgccgccuccagccccaucuccacccgcugcuuccacgggggccagcugaucgcggagagcaaguccgccaccagcaucuccgaguucugccugaaggacgacgugagcaugaucaaguccgaggugacguacaucaagaacgacaccgggaucuacggccacaacaagguguuccggagcuggaccaucaaggacuggaagcucugcaacccgauccccaccgccgggggcuccaucaacgugaucgaggucaacagcgaccugucccuggccacgcgcgccuacgugugcagccgggacugcaccaucaccaucgacaaggaggacgcgcagaucaucuuccagaccgacaagcucaaccacuucgagguguccggcacgacccugagcuccgggugguucaagaccaaggccagcgucacccuggaccgcacgugcgagcacaucaaggugaccugcggcaagaagucccuccaguuccacgccugcuucaagcaccacaugagcugcauccgguucuuccaccacaccauccugcccgggaccauggugagcuccaugugccagaacaucgagcugaucaucaucaucggccucacgcuggucaucuucauccugauggugauccucaccaagaccuacaucugcuaccugcugaugcccguguucaugccggucgccuacaucuacgggugggcguacaacaagagcugcaagaagugcaacugcugcggccucgccuaccaccccuucaccaacugcggcucccacugcgugugcgggcugaaguucgaggccagcgaccgcaugcggcugcaccgcgaguccggccucugccagggguacaagagccugcggaucgcccgcaugcugugcaaguccaagggcagcucccucgugaucagcggccugcuguccaugcuccugcugagcuucaucacgcccaucgaggggacccucaccaacuaccccaacgagaagcaguacacccuggaggagaucgccgacgucguggagggcaucaucacggagcagcaccugaaggaguacguggucuucuacaccucccucuucgggggccugauccugcuccugacccugauccucagcaucaccaucaacaaggugacggaccugcuggcguccaccaacgugaucuacugcgaggagugcagcauguaccacuccaagaaggggaucaaguacaacggcgacuucaccaacaagugcggcuucugcacgugcagcgagcaggaggacgucgagggggugaucauccacaaggugucccggaagugcaccuacaaguaccagcucaaguggguccgcgugaucaugaucauccuggcccugcuccugaccauccagaacaccguccugaucguggccgccgagguggacugcuggaccaagaaguccaucgagaucgacugcaucggcccgcugcucaacaucgggagcugcacggacaagagcagccggaccuacgagaccgaggucaacaagcuggugcgccaguccaaggugacccacgccgacgcggagcagaucagcauccugggcuccacccucgacaacgccaucaaggccguccggagccagaagacguacgagaccaugcacuuccuggagaccguguuccugaugaagaacugcgacuacuacaacuccuucgagcacaacagcggguacucccagaccaaguggcgccucaucgccaagacgagccacuucgacaucugcucccggcacagcacccaccacuucugccgcugcgugaacgagggcaccaagugccagaacggcgacugggacuucgccggggagaugaacgacaccuacaacuccaagaacgacuucuaccugcacgaccuggaccucuucuacacgcugcuggagaacgcguuccccggcaccaccgagagccucuucuaccagcugcugcagaagaagaacaccacgggggccuccaagcuccugggcaagcugaucaccaaguacgggaacaacaacauguucgucgagaucuggaaguucggccaguaccuccugaagcugcccuacaucaacgacaccgagcucagcaccgaccggaaguccacgaucaucaagagccagcagguccugagccgcucccagaccggccggcaggagagccuguccagcgccacccccgggaccgccacgaaggagugcuccaacgccaaggacaucggcugcaucagcccgcgcuucgggauccccaucggcaaccucaccgcgugcggcgacucccccaacuacaagguguacaagacccccgagaagaucuacaagagcaacaaccgcggggagguguggugcuccgacgacgugcacugccugaccgacuucgagccggccgaggaggagguggucaaccggaucaagcagaugacgugcuuccugaccgacgugaccaccaagacggacguguucagcgucgccaucuccacgugcaagaugguggacaagggcgugugcaccgucaacgacgccaaguggaacauccucaagugcaacagcgggcuguacuacuucaccgaccaccgcgacggccaggacaccgggaacgacuucggcgaguacugcaucucccacagcugcaacaccgagcgguuccccaucaaccccgacgugcugaaggacugcaucugggaguaccacucccgcaagagcaaguacaucuccaccgugagccucgagucccuggacgaguuccggcgcgcgaugagcgacaagcugagccacacccucaugaucuacaacuucaagcccacggccaaccugccgcacaucaagcccaccuacaaguucaucaccgccaacggcaucgagaacuccgacgggaucgacagcgccuacauccuguccagcauccccgcccucggcgggauguccgucggcuacaacauccagaccaaggacaacuucccccugcuggacaucaucguguucaucaagagcgcgaucaucaagaccacguacaaccacaucuacgacaccgggccgaccaucggcaucaacacccagcacgacgagcacugcacgggccccugccccacccucauccugcacaaggagaacuggcugaccuucucccaggagcggaccagccgcugggggugcgaggaguucggcugccucgccaucaacacggggugcguguucggcuccugccaggacaucauccaccccgaggccaaggucuaccggaaggccaucgaggaggagguggugcugaccgucugcaucaccuucccggggaacaccuacugcacggagaucaacgccaucgagcccaagaucaccgacgagaucgagcugcaguucaagaccguggacaccaagacgcuccccaaccugcugauggugcagaaccacaagcucuacagcggccagaucgacgaccugggcuccuucagccaggggugcggcaacguccagaagaccaaccaguccgugaucggggcgggcaccgccaaguucgacuacgugugccacggggccagccgcaaggacgucaucgugcggcgcugcuacaacaacaacuacgaguccugcaagcugcucaaggaggagaccagccugaucuucgccgacaaccacgagacgcuggagguggccaacaccaagcaccucaucggcgagcugcaguucaagaucaugcugggcgacauccgguacaaguccuucgcggagagcccggagcucgaggucgacgccaagugcguggggugccccuccugcuucgagagcuacagcugcaacuuccagaucgugaccaacaucgacaccgucugcuccguggacggccccugcacgcuguuccacaaccgccugaucaucagcgccaccaagcaguccuacggguucaagaugagcugcccccggaagccggagcccaccgaggaguuccagaucugcaaccgcaaguacaacguccucuucaccacgaucgacaagaacgacaagaucgagaucaacaccggcgaccagaccuccuacaucuacgagaaggacaaccggugcaagaccuggcugugccgcgugcgggacgagggcaucagcgugaucuucgagccccugaaggccuucuucggguccuacuucagcaucaucuucuacguggucgugggcaucaucguccucuuccugacgaucuacaucuuccugcccauguucuucaagcuccgcgacauccugaagcgcaacgaguaccuguaccuccaggagcugaagcacaaguga

SEQ ID NO: 12562 - RNA, 4311 nt, Artificial Sequence
  derived and/or modified CDS sequence (opt1) from MAGV(AG83-1746)__KX100113.1__GP
augaagaugauccugcucaucaucauccugugcgugaaccuggccgccgcgaaccccgucgccacccgcugcuuccacggcgggcagcucaucgccgagacccggagcgccacguccaucagcgaguucugccugaaggacgacguguccaugaucaagagcgagaucaccuacaccaagaacgacaccggcaucuucgggcacuccaagaucuacaagagcuggcugaucaaggacuggaagcucugcaacccggugcccacggccggcggguccaucaacgucaucgaggugaacagcgaccugucccugaccaccaaggcguacgugugcagccgcgacugcaccaucacgaucgacaaggaggaggcccagaucaucuuccagaccgacaagcucaaccacuucgaggucuccggcaccacccugagcuccggcugguucaagacgaaggccagcgugacccuggaccggaccugcgagcacaucaaggugaccugcgggaagaagacgcuccaguuccacgccugcuuccgccaccacauguccugcguccgguucuuccacaacaccauccugcccggcaccauggugaacagcaugugccagaacaucgagcugaucaucauccucgggcugacccugaucaucuucacgcucauggugauccugaccaagaccuacaucugcuacauccugaugccccucuucaugccgaucgcguacgccuacggcugggccuacaacaaguccugcaagaagugcaacugcugcgggcuggccuaccaccccuucaccaacugcggcagccacugcgucugcggccugaaguucgaggccuccgaccgcaugcggauccaccgcgagagcgggcucugccagggcuacaagagccugcggaucgcgcgccugcucugcaaguccaaggggagcucccugaucaucagcacgcugcucuccaugcugcugcucagcuucaucacccccaucgagggcaccaugaccaacuaccccgagacgcggcaguacucccuggaggagaucgccgacgugguggagggccugcucagcgagcagaacaucaaggaguacgucguguucuacaccucccuguucgggagccugauccuccugcuggccuucauccucuccaucacccugaccaaggugacgaacgcccuggccaagaccaacgucaucuacugcgaggagugcagcauguaccacgcgaagaagggcaucaaguacaacggggacuucaccaacaagugcggcuucugcacgugcgacgagcaggaggacgaggaggggaucaucauccacaagguguccaagaagugcaccuaccgcuaccagcuccagugggccaagaucaucaugaucauccuggugaugcugcucaugaugcagaacaccauccugaucgucgccgccgagaccgacugcuggaccaagaacagccuggagcuggacugcaucggcccgcuccugaccaucuccgacugcagcaacaaggaguccaagaacuacgaggaggaggccgcgaagcuggugagccaguccaagaucacgcaggccgacgccgagcaggucaccauccucggcaacaccaucgacaccgcccugaaggccauccggagccagaagacguaccagaccaugcaccuccucgagagcguguuccugaugaagaacugcgacuacuacuccagcuucgagcacaacuccggguacagccaggcgaaguggcgccugaucgccaagaccucccacuucgacaucugcagccggcacuccaugcaccacuucugccgcugcguggccgacggcaccaagugccagaacgggaacugggacuucgccggcgagaugaacaacacguacagcaccaagaacgacuucuaccuccacgaccugaaccuguucuucacccuccacgagaccgcguuccccgggacgaccgagucccuguucuaccagcugaucgccaagaagaacaccaccggcgccagcaagcuccugggcaagcugaucacgaaguacgggaacaacaagcuguucgucggcaucuggaaguucgggcaguaccugcugacccuccccuacgugaacaccaccgagcuguccaagacgcggaaggagaccauccugaagccccaccagauccucacccgcagccagggcgggcggccggaguccaugagcuccgccgaggugggccagaccgccaaggagugcgcgaacgccaagaacgucggcugcaucagcccccgcuucggggugcccaucggcaaccugacggccugcgggaacucccccaacuacaagaucuacaagaccccgaacaagaucuacaagagcaacaaccggggcgagguguggugcagcgaggacguccacugccuggccgacuucgagcccgccgacaccgagguggugaacaaggucaagaagaugaccugcuuccucuccgacgugaacacgcgcgcggacaucuucagcaucgccaucuccgccugccgcaugguggacaagggcgucugcaccgugaacggggccaaguggaacauccugaagugcgagagcggccuguacuacuucaccgaccaccgggaggggcaggacaccggcaacgacuucggggaguacugcaucucccacagcugcaacacggagcgcuaccccaucaaccccgacauccucaaggagugcaucugggaguaccacucccgcaagagcaaguacaucuccaccaucaaccuggagagccuggaggaguucaagcgggccauguccgacaagcucagccacacccugaugguguacaacuucaagccgaccgcgaaccugccccacaucaagcccuccuacaaguucaucacggccaacggcaucgagaacagcgacggccucgaguccgccuacauccugagcuccauccccgccaucgggggcaugagcaucggguacaacauccagaccaaggacaacuucccgcugcucgaccugaucgucuucgugaaguccgcggugaucaagaccaccuacaaccacaucuacgacaccggccccacgaucgggaucaacaccaaccacgacgagcacugcaccggccccugccccaccaucaucccgcacaaggagaacuggcugacguucagccaggagcggaccagccgcuggggcugcgaggaguucgggugccucgccaucaacaccggcugcgucuucggguccugccaggacgugauccaccccgagaccaagaucuaccggaaggccguggaggaggaggucgugcugacggugugcaucaacuuccccggcaacaccuucugcaccgagaucaacgccaucgagccgaagaucaccgacgagaucgagcugcaguucaagacggucgacaccaagacccuccccaaccugcuggccgugcagaaccacaagcucuacagcgggcagaucaacgaccugggcuccuucagccagggcugcgggaacgugcagaagaccaaccaguccauccugggcgcggggacggucaaguucgacuacgugugccacggcgccagccgcaaggacaucaucgugcggcgcugcuacaccaacaacuacgacuccugcaagcuccugaaggaggagcggagccugaucuucgccgacaaccacgagacccucgaggucgccaacacccgccaccugaucggggagcugcaguucaagaucaugcucggcgacauccgguacaaggccuucgcggagaagcccgagcuggagaucgacgccaagugcgugggcugccccuccugcuucgagagcuacuccugcagcuuccagaucgugacguccaucgacaccgucugcagcguggaggggccgugcacccuguuccacaaccgcaucaucaucaccgccgccaagcaguccuacggcgugaagaugagcugcaagacgaagcccgggcccgucgaggaguuccggaucugcaaccgcaacuaccggguguccuucgccaccaucgacaagaacgacaagaucgagaucaacaccggcgaccagaccagcuacaucguggagaaggacucccgcugcaagacguggcucugccggguccgcgacgagggcaucagcgugaucuucgagccccugaaggcguucuucgggagcuacuucuccguggccuucuacaucaucaucggcaucgccgcccuguuccucaucaucuacaucuuccugccgauguucuucaagcugcgcgacguccucaagaagaacgaguaccuguaccugcaggagcucaagcacaaguga

SEQ ID NO: 12563 - RNA, 4305 nt, Artificial Sequence
  derived and/or modified CDS sequence (opt1) from MAGV(BeAr 7272)__KX100104.1__GP
auggagcugcucaucaucauccugcugcucggcagcgccgccuccagccccaucuccacccgcugcuuccacgggggccagcugaucgcggagagcaaguccgccaccagcaucuccgaguucugccugaaggacgacgugagcaugaucaaguccgaggucacguacaucaagaacgacaccgggaucuacggccacaacaagguguuccggagcuggaccaucaaggacuggaagcucugcaacccgauccccaccgccgggggcuccaucaacgugaucgaggucaacagcgaccugucccuggccacgcgcgccuacgugugcagccgggacugcaccaucaccaucgacaaggaggacgcgcagaucaucuuccagaccgacaagcucaaccacuucgagguguccggcacgacccugagcuccgggugguucaagaccaaggccagcgucacccuggaccgcacgugcgagcacaucaaggugaccugcggcaagaagucccuccaguuccacgccugcuucaagcaccacaugagcugcauccgguucuuccaccacaccauccugcccgggaccauggugagcuccaugugccagaacaucgagcugaucaucaucaucggccucacgcuggucaucuucauccugauggugauccucaccaagaccuacaucugcuaccugcugaugcccguguucaugccggucgccuacaucuacgggugggcguacaacaagagcugcaagaagugcaacugcugcggccucgccuaccaccccuucaccaacugcggcucccacugcgugugcgggcugaaguucgaggccagcgaccgcaugcggcugcaccgcgaguccggccucugccagggguacaagagccugcggaucgcccgcaugcugugcaaguccaagggcagcucccucgugaucagcggccugcuguccaugcuccugcugagcuucaucacgcccaucgaggggacccucaccaacuaccccaacgagaagcaguacacccuggaggagaucgccgacgucguggagggcaucaucacggagcagcaccugaaggaguacguggucuucuacaccucccucuucgggggccugauccugcuccugacccugauccucagcaucaccaucaacaaggugacggaccugcuggcguccaccaacgugaucuacugcgaggagugcagcauguaccacuccaagaaggggaucaaguacaacggcgacuucaccaacaagugcggcuucugcacgugcagcgagcaggaggacgucgagggggugaucauccacaaggugucccggaagugcacguacaaguaccagcucaaguggguccgcgugaucaugaucauccuggcccugcuccugaccauccagaacaccguccugaucguggccgccgagguggacugcuggaccaagaaguccaucgagaucgacugcaucggcccgcugcucaacaucgggagcugcacggacaagagcagccggaccuacgagaccgaggucaacaagcuggugcgccaguccaaggugacccacgccgacgcggagcagaucagcauccugggcuccacccucgacaacgccaucaaggccguccggagccagaagacguacgagaccaugcacuuccuggagaccguguuccugaugaagaacugcgacuacuacaacuccuucgagcacaacagcggguacucccagaccaaguggcgccucaucgccaagacgagccacuucgacaucugcucccggcacagcacccaccacuucugccgcugcgugaacgagggcaccaagugccagaacggcgacugggacuucgccggggagaugaacgacaccuacaacuccaagaacgacuucuaccugcacgaccuggaccucuucuacacgcugcuggagaacgcguuccccggcaccaccgagagccucuucuaccagcugcugcagaagaagaacaccacgggggccuccaagcuccugggcaagcugaucaccaaguacgggaacaacaacauguucgucgagaucuggaaguucggccaguaccuccugaagcugcccuacaucaacgacaccgagcucagcaccgaccggaaguccacgaucaucaagagccagcagguccugagccgcucccagaccggccggcaggagagccuguccagcgccacccccgggaccgccacgaaggagugcuccaacgccaaggacaucggcugcaucagcccgcgcuucgggauccccaucggcaaccucaccgcgugcggcgacucccccaacuacaagguguacaagacccccgagaagaucuacaagagcaacaaccgcggggagguguggugcuccgacgacgugcacugccugaccgacuucgagccggccgaggaggagguggucaaccggaucaagcagaugacgugcuuccugaccgacgugaccaccaagacggacguguucagcgucgccaucuccacgugcaagaugguggacaagggcgugugcaccgucaacgacgccaaguggaacauccucaagugcaacagcgggcuguacuacuucaccgaccaccgcgacggccaggacaccgggaacgacuucggcgaguacugcaucucccacagcugcaacaccgagcgguuccccaucaaccccgacgugcugaaggacugcaucugggaguaccacucccgcaagagcaaguacaucuccaccgugagccucgagucccuggacgaguuccggcgcgcgaugagcgacaagcugagccacacccucaugaucuacaacuucaagcccacggccaaccugccgcacaucaagcccaccuacaaguucaucaccgccaacggcaucgagaacuccgacgggaucgacagcgccuacauccuguccagcauccccgcccucggcgggauguccgucggcuacaacauccagaccaaggacaacuucccccugcuggacaucaucguguucaucaagagcgcgaucaucaagaccacguacaaccacaucuacgacaccgggccgaccaucggcaucaacacccagcacgacgagcacugcacgggccccugccccacccucaucccccacaaggagaacuggcugaccuucucccaggagcggaccagccgcugggggugcgaggaguucggcugccuggccaucaacacggggugcguguucggcuccugccaggacaucauccacccggaggccaaggucuaccggaaggccaucgaggaggagguggugcucaccgucugcaucaccuuccccgggaacaccuacugcacggagaucaacgccaucgagcccaagaucaccgacgagaucgagcugcaguucaagaccguggacaccaagacgcugccgaaccuccugauggugcagaaccacaagcuguacagcggccagaucaacgaccucggcuccuucagccaggggugcggcaacguccagaagaccaaccaguccgugaucggggcgggcaccgccaaguucgacuacgugugccacggggccagccgcaaggacgucaucgugcggcgcugcuacaacaacaacuacgaguccugcaagcugcugaaggaggagaccagccucaucuucgccgacaaccacgagacgcuggagguggccaacaccaagcaccugaucggcgagcuccaguucaagaucaugcugggcgacauccgguacaaguccuucgcggagagccccgagcuggaggucgacgccaagugcguggggugccccuccugcuucgagagcuacagcugcaacuuccagaucgugaccaacaucgacaccgucugcuccguggacggccccugcacccucuuccacaaccgccugaucaucagcgccaccaagcaguccuacggguucaagaugagcugcccgcggaagcccgagcccaccgaggaguuccagaucugcaaccgcaaguacaacgugcuguucaccacgaucgacaagaacgacaagaucgagaucaacaccggcgaccagaccuccuacaucuacgagaaggacaaccggugcaagaccuggcucugccgcguccgggacgagggcaucagcgugaucuucgagccccugaaggccuucuucggguccuacuucagcaucaucuucuacguggucgugggcaucaucgugcuguuccucacgaucuacaucuuccugccgauguucuucaagcugcgcgacauccucaagcgcaacgaguaccuguaccugcaggagcucaagcacaaguga

SEQ ID NO: 12564 - RNA, 4311 nt, Artificial Sequence
  derived and/or modified CDS sequence (opt1) from MAGV(CbaAr 426)__KX100110.1__GP
augaagaugauccugcucaucaucauccugugcgugaaccuggccgccgcgaaccccgucgccacccgcugcuuccacggcgggcagcucaucgccgagacccggagcgccacguccaucagcgaguucugccugaaggacgacguguccaugaucaagagcgagaucaccuacaccaagaacgacaccggcaucuucgggcacuccaagaucuacaagagcuggcugaucaaggacuggaagcucugcaacccggugcccacggccggcggguccaucaacgucaucgaggugaacagcgaccugucccugaccaccaaggcguacgugugcagccgcgacugcaccaucacgaucgacaaggaggaggcccagaucaucuuccagaccgacaagcucaaccacuucgaggucuccggcaccacccugagcuccggcugguucaagacgaaggccagcgugacccuggaccggaccugcgagcacaucaaggugaccugcgggaagaagacgcuccaguuccacgccugcuuccgccaccacauguccugcguccgguucuuccacaacaccauccugcccggcaccauggugaacagcaugugccagaacaucgagcugaucaucauccucgggcugacccugaucaucuucacgcucauggugauccugaccaagaccuacaucugcuacauccugaugccccucuucaugccgaucgcguacgccuacggcugggccuacaacaaguccugcaagaagugcaacugcugcgggcuggccuaccaccccuucaccaacugcggcagccacugcgucugcggccugaaguucgaggccuccgaccgcaugcggauccaccgcgagagcgggcucugccagggcuacaagagccugcggaucgcgcgccugcucugcaaguccaaggggagcucccugaucaucagcacgcugcucuccaugcugcugcucagcuucaucacccccaucgagggcaccaugaccaacuaccccgagacgcggcaguacucccuggaggagaucgccgacgugguggagggccugcucagcgagcagaacaucaaggaguacgucguguucuacaccucccuguucgggagccugauccuccugcuggccuucauccucuccaucacccugaccaaggugacgaacgcccuggcccgcaccaacgucaucuacugcgaggagugcagcauguaccacgcgaagaagggcaucaaguacaacggggacuucaccaacaagugcggcuucugcacgugcgacgagcaggaggacgaggaggggaucaucauccacaagguguccaagaagugcaccuaccgguaccagcuccagugggccaagaucaucaugaucauccuggugaugcugcucaugaugcagaacaccauccugaucgucgccgccgagaccgacugcuggaccaagaacagccuggagcuggacugcaucggcccgcuccugaccaucuccgacugcagcaacaaggaguccaagaacuacgaggaggaggccgcgaagcuggugagccaguccaagaucacgcaggccgacgccgagcaggucaccauccucggcaacaccaucgacaccgcccugaaggccauccgcagccagaagacguaccagaccaugcaccuccucgagagcguguuccugaugaagaacugcgacuacuacuccagcuucgagcacaacuccggguacagccaggcgaaguggcggcugaucgccaagaccucccacuucgacaucugcagccgccacuccaugcaccacuucugccggugcguggccgacggcaccaagugccagaacggggacugggacuucgccggcgagaugaacaacacguacagcaccaagaacgacuucuaccuccacgaccugaaccuguucuucacccuccacgagaccgcguuccccgggacgaccgagucccuguucuaccagcugaucgccaagaagaacaccaccggcgccagcaagcuccugggcaagcugaucacgaaguacgggaacuccaagcuguucgucggcaucuggaaguucgggcaguaccugcugacccuccccuacgugaacaccaccgagcugagcaagacgcgccgggagaccauccugaagacccaccagauccucacccgcucccagggcgggcggagcgaguccaugagcuccgccgaggugggccagaucgccaaggagugcgcgaacgccaagaacgucggcugcaucagcccccgcuucgggaucccgaucggcaaccugacggccugcgggaacagccccaacuacaagaucuacaagacccccaacaagaucuacaaguccaacaaccgcggcgagguguggugcagcgaggacgugcacugccuggccgacuucgagcccgccgacaccgaggucgugaacaaggugaagaagaugaccugcuuccucuccgacgucaacacgcgggcggacaucuucagcaucgccaucuccgccugccgcaugguggacaagggcgugugcaccgucaacggggccaaguggaacauccugaagugcgagagcggccuguacuacuucaccgaccaccgggaggggcaggacaccggcaacgacuucggggaguacugcaucucccacagcugcaacacggagcgcuacccgaucaaccccgacauccucaaggagugcaucugggaguaccacucccgcaagagcaaguacaucuccaccaucaaccuggagagccuggaggaguucaagcgggccauguccgacaagcucagccacacccugaugguguacaacuucaagcccaccgcgaaccugccccacaucaagccguccuacaaguucaucacggccaacggcaucgagaacagcgacggccucgaguccgccuacauccugagcuccauccccgccaucgggggcaugagcaucggguacaacauccagaccaaggacaacuucccccugcucgaccugaucguguucgucaagagcgcggugaucaagaccaccuacaaccacaucuacgacaccggccccacgaucgggaucaacaccaaccacgacgagcacugcaccggcccgugccccaccaucaucccccacaaggagaacuggcugacguucucccaggagcggaccagccgcuggggcugcgaggaguucgggugccucgccaucaacaccggcugcguguucggguccugccaggacgucauccaccccgagaccaagaucuaccggaaggccguggaggaggaggugguccugacggugugcaucaacuucccgggcaacaccuucugcaccgagaucaacgccaucgagcccaagaucaccgacgagaucgagcugcaguucaagacgguggacaccaagacccuccccaaccugcuggccguccagaaccacaagcucuacagcgggcagaucaacgaccugggcuccuucagccagggcugcgggaacgugcagaagaccaaccaguccauccugggcgcggggacggugaaguucgacuacgucugccacggcgccagccgcaaggacaucaucgugcggcgcugcuacaccaacaacuacgacuccugcaagcuccugaaggaggagcggagccugaucuucgccgacaaccacgagacccucgagguggccaacacccgccaccugaucggggagcugcaguucaagaucaugcucggcgacauccgguacaaggccuucgcggagaagccggagcuggagaucgacgccaagugcgucggcugccccuccugcuucgagagcuacuccugcaacuuccagaucgugacgagcaucgacaccgugugcuccgucgaggggcccugcacccuguuccacaaccgcaucaucaucaccgccgccaagcagagcuacggcgugaagauguccugcaagacgaagcccgggccgguggaggaguucaccaucugcaaccggaacuaccgcgucagcuucgccaccaucgacaagaacgacaagaucgagaucaacaccggcgaccagacguccuacaucguggagaaggacagccggugcaagaccuggcucugccgcgugcgcgacgagggcaucagcgucaucuucgagccccugaaggcguucuucggguccuacuucagcaucgccuucuacaucaucaucggcaucgccgcccuguuccucaucaucuacaucuuccugcccauguucuucaagcugcgggacgugcucaagaagaacgaguaccuguaccugcaggagcucaagcacaaguga

SEQ ID NO: 12565 - RNA, 4305 nt, Artificial Sequence
  derived and/or modified CDS sequence (opt1) from MAGV(CoAr 3363)__KX100107.1__GP
augcugagccuccugauccuggccuuccucggccuguccaccagcaaccccaucgccacccgcugcuuccacgggggccagcugaucgcggaguccaagagcgccacguccaucagcgaguucugccucaaggacgacguguccaugcucaagagcgaggucguguacaccaagaacgacaccgggcuguucggccacaacaagguguuccgguccuggaccaucaaggacuggaagcucugcaacccgauccccacggccgggggcaccaucaacgucaucgaggugaacaaggaccugagccugaugaccaagaccuacaucugcucccgcgacugcacgaucaccaucgacaaggaggaggcccagaucaucuuccagaccgacaagcucaaccacuucgaggugagcggcaccacgcuguccagcgggugguucaaguccaaggccagcgucacccuggaccggaccugcgagcacgugaaggugaccugcggcaagaagucccuccaguuccacgcgugcuucaagcaccacaugagcugcguccgcuucuuccacaacacgauccugcccgggaacaugaucaccuccaugugccagaacaucgagcugaucaucauccucggccugacccuggccaucuucauccucauggugaugcugaccaagacguacaucugcuaccugcucaugcccaucuucaugccgaucgccuaccuguacgggugggccuacaacaagagcugcaagaagugcaacugcugcggccuggcguaccaccccuucaccaacugcggcagccacugcgugugcgggcucaaguucgaggccuccgaccggaugcgcauccaccgggagagcggccugugccagggguacaagucccugcgcaucgcccggcuccugugcaagagcaagggcuccagccuggucaucuccggccuccugagcaugcugauccucuccuucgugacccccaucgaggggaccaucacgagcuaccccgagucccgcaaguacacccuggaggagaucaccgacguggucgagggccuggugagcgagcagaacaucaaggaguacaucguguucuacaccucccucuucgggagccugauccugcuccuggccuucaucauguccaucacgcugagcaagaucaccuccauccucgcccggcgcaacgucaucuacugcgaggagugcagcauguaccacuccaagcggggcaucaaguacaacggggacuucaccaacaagugcggcuucugcacgugcaacgagcaggaggacgcggagggccuggugauccacaaggugagcaagcgcugcaccuacaagugccagcugaagugggccaagguccucaugaucacccuggugcugcugcucaucgcccagaacaccauccugaucguggccgccaagaccgacugcuggacgaagaagucccuggacaucgacugcaucgggccgaugcucgacaucggcagcugcaccaacaagaacacccggagcuacgacaccgaggcgcagaagcuggucacccaguccaaggugagccagcuggacgccgaccaggccucccuccuggggagcuccaucgacagcgccaucaaggccauccgcacgcagaagaccuaccccaccaugcaccuccuggagaccaucuuccugaugaagaacugcgacuacuacacguccuucaaccacaacagcggcuacucccaggcgcgguggcgccugaucgccaagaccgggcacuucgacaucugcagccggcacuccacccaccacuucugccgcugcaucagcgacggcaccaagugccagaacggcgacugggacuucgccggggagaugaacgagcccuacaacuccaagaacgacuucuaccuccacgaccugaaccuguucuacacgaucuucgagaacgccuuccccggcaccaccgagagccucuucuaccagcugauccagaagcgggacaccacgggggccuccaagguccugggcaagcucaucaccaaguacgggaacaacaacauguucgugggcguguggaaguucggccaguaccugcugacccucccguacaucaacaacaccgagcugagccagaaccgcaagcagacgauccuggcgacccaggagccccucagccgcucccaccccgggcggcaggagagcauguccagcgccauccagggcuccgucaccaaggagugccacaacgccaaggacguggggugcaucagcccccgcuucggcaucccgaucggcaaccugaccgccugcggggacucccccaacuacaagaucuacaagacgcccgagaagcuguacaagagcaacaacaagggcgagguguggugcuccaacgacguccacugccucaacgacuucgagcccgcggacgaggagguggugaacaaggucaagaagcugaccugcuuccugaccgacgugcucgugaagaccgacaucuucagcgucgccgccuccacgugcaagauggccgacaaggggaucugcaccgugaacgacgccaaguggaacaucaucaagugcgacagcggccuguacuacuucaccgaccaccgggaggggcaggacaccggcaacgacuucggcgaguacugcaucucccacagcugcaacacggagcgcuucccgaucaaccccgacauccugaaggacugcaccugggaguuccacucccgcaagagcaaguacaucuccaccaucagccucgagucccuggaggaguuccggcgggcgauggccgagaagcugagccacacccucacgaucuacaacuucaagcccaccgccaaccugccccacauccgcccgaccuacaaguucaucaccgccaacgggguggagaacagcgacggcaucgaguccgccuacauccugagcuccauccccgcgcucagcgggaucuccgucggcuacaacgugcagacgaaggacaacuucccccugcuggacaucaucguguucaucaagagcgccgucauccggaccaccuacaaccacaucuacgacaccgggcccaccaucggcaucaacacgcagcacgacgagcacugcaccggcccgugccccgccguggugccccacaaggagaacuggaucaccuucucccaggagcgcaccagccggugggggugcgaggaguucggcugccucgccaucaacacggggugcgucuucggcuccugccaggacaucauccacccggagaccaagguguaccgcaaggccguggaggaggaggucgugcugaccgugugcaucaacuuccccgggaacaacuacugcaccgagaucaacgcgaucgagcccaagaucacggacgagaucgagcugcaguucaagaccgucgacaccaagacccuccccaaccugcuggccgugcagaaccacaagcucuacagcggccagaucaacgaccugggcuccuucagccaggggugcggcaacgugcagaagacgaaccacuccauccuggggaugggcaccgccaaguucgacuacgucugccacggggccagccggaaggacgugaucgugcgccggugcuacaacaacaacuucgacuccugcaagcuccugaaggaggagaccagccugaucuucgcggacaaccacgagacccucgaggucgcccacacgaagcaccugaucggcgagcugcaguucaagaucaugcucggcgacauccgcuacaaguccuucgccgagagcccggagcuggagaucgacgccaagugcguggggugccccuccugcuucgagagcuacagcugcaacuuccagaucgugaccaacaucgacaccgucugcuccguggagggccccugcacccuguuccacaaccggaucaucaucagcgccaacaagcaguccuacgggcucaagaugagcugccagacgaagcccaaccagaacgaggaguucaucaucugcaaccgcaaguacuccgugcuguucaccaccaucgacaagaacgacaagaucgaggucaacaccggcgaccagacgagcuacaucuacgagaaggacucccggugcaagaccuggcugugccgcgugcgcgacgagggcaucagcgugcuguucgagccgcugaaggcguucuucggguccuacuucagcaucaucuucuacgucgugaucggcaucaucgugcuguuccucaucgucuacaucuuccugcccauguucuucaagcugaaggacgugcucaagaagaacgaguaccuguaccugcaggagcucaagcacaaguga

SEQ ID NO: 12566 - RNA, 4305 nt, Artificial Sequence
  derived and/or modified CDS sequence (opt1) from MAGV(OBS 6657)__KX100116.1__GP
auggagcugcucaucaucauccugcugcucggcagcgccgccuccagccccguguccacccgcugcuuccacgggggccagcugaucgcggagagcaaguccgccaccagcaucuccgaguucugccugaaggacgacgucagcaugaucaaguccgaggugacguacaccaagaacgacaccgggaucuacggccacaacaagguguuccggagcuggaccaucaaggacuggaagcucugcaacccgauccccacggccgggggcuccaucaacgucaucgaggugaacagcgaccugucccuggccaccaaggccuacgugugcagccgcgacugcaccaucaccaucgacaaggaggacgcgcagaucaucuuccagacggacaagcucaaccacuucgaggucuccggcaccacccugagcuccgggugguucaagaccaaggccagcgugacgcuggaccggaccugcgagcacaucaaggugaccugcggcaagaagucccuccaguuccacgccugcuucaagcaccacaugagcugcauccgcuucuuccaccacaccauccugcccgggacgauggucagcuccaugugccagaacaucgagcugaucaucaucaucggccucacccuggugcuguucauccucauggugauccugaccaagaccuacaucugcuaccugcucaugcccaucuucaugccgaucgccuacaucuacgggugggcguacaacaagagcugcaagaagugcaacugcugcggccuggccuaccaccccuucacgaacugcggcucccacugcgucugcgggcugaaguucgaggccagcgaccggaugcgcauccaccgggaguccggccucugccagggguacaagagccugcgcaucgcccggaugcugugcaaguccaagggcagcucccucgugaucagcggccugcuguccaugcuccugcugagcuucaucacccccaucgaggggacccucaccaacuaccccaacgagcgccaguacacgcuggaggagaucgccgacguggucgagggcauccugaccgagcagcaccucaaggaguacgugguguucuacaccucccuguucgggggccugauccuccugcugacccucauccugagcaucacgaucaacaaggucaccgaccugcucgcguccaccaacgugaucuacugcgaggagugcagcauguaccacuccaagaaggggaucaaguacaacggcgacuucaccaacaagugcggcuucugcacgugcagcgagcaggaggacaucgaggggguggucauccacaaggugucccggaagugcaccuacaaguaccagcugaagugggugcgcgucaucaugaucauccuggcccuccugcugacccugcagaacaccgugcucaucgucgccgccgagguggacugcuggacgaagaaguccaucgagaucgacugcaucggcccgcugcugaacaucgggaccugcaccgacaagagcagccggaccuacgagaccgaggugaacaagcucguccgccagagcaaggugacgcaggccgacgcggagcaggucuccauccugggcagcacccuggacuccgccaucaaggccauccggagccagaagaccuacgagaccaugcacuuccucgagacgguguuccugaugaagaacugcgacuacuacuccagcuucgagcacaacuccggguacagccagaccaaguggcgccugaucgccaagaccucccacuucgacaucugcagccggcacuccgcccaccacuucugccgcugcgugaacgagggcaccaagugccagaacggcgacugggacuucgcgcgggagaugaacgacacguacaacagcaagaacgacuucuaccuccacgaccuggaccuguucuacacccucuucgagaacgccuuccccgggaccaccgagucccuguucuaccagcugcuccagaagaagaacacgaccggcgccagcaagcugcuggggaagcucaucaccaaguacggcaacaacaaccuguucguggggaucuggaaguucggccaguaccugcucaagcugcccuacaucaacgacaccgagcuguccacggaccgcaagagcaccaucaugaagucccagcagaugcucagccggagccagaccggccgccaggagucccugagcuccgccacccccgggacggccaccaaggagugcagcaacgcgaaggacaucggcugcaucuccccgcgcuucgggauccccaucggcaaccugaccgccugcggcgacagccccaacuacaagaucuacaagacccccgagaagaucuacaaguccaacaacaagggggaggucuggugcagcgacgacgugcacugccucgccgacuucgagccggccgaggaggagguggucaaccggaucaagcagaugacgugcuuccugaccgacgugaccaccaagacggacguguucuccgucgcgaucagcacgugcaagauggccgacaagggcgugugcaccgugaacgacgccaaguggaacauccugaagugcaacuccgggcucuacuacuucaccgaccaccgcgacggccaggacaccgggaacgacuucggcgaguacugcaucagccacuccugcaacaccgagcgguuccccaucaaccccgacguccugaaggacugcaucugggaguaccacagccgcaaguccaaguacaucagcaccaucucccuggagagccucgacgaguuccggcgcgccaugagcgacaagcugucccacacccugaugaucuacaacuucaagcccacggccaaccucccgcacaucaagcccaccuacaaguucaucaccgcgaacggcaucgagaacagcgacgggaucgacuccgccuacauccugagcuccauccccgcccugggcgggaugagcgugggcuacaacgugcagaccaaggacaacuucccccuccuggacaucaucgucuucaucaaguccgccaucaucaagaccacguacaaccacaucuacgacaccgggccgaccaucggcaucaacacccagcacgacgagcacugcacgggccccugccccacccugaucccccacaaggagaacuggcucaccuucagccaggagcggaccucccgcugggggugcgaggaguucggcugccuggccaucaacacggggugcguguucggcagcugccaggacaucauccacccggaggcgaagguguaccggaaggccaucgaggaggaggucgugcugaccgugugcaucaccuuccccgggaacaccuacugcacggagaucaacgccaucgagcccaagaucaccgacgagaucgagcuccaguucaagaccgucgacaccaagacgcugccgaaccugcucauggugcagaaccacaagcuguacuccggccagaucaacgaccugggcagcuucucccaggggugcggcaacgugcagaagaccaaccagagcgucaucgggaccggcaccgccaaguucgacuacgugugccacggggccucccgcaaggacgugaucguccggcgcugcuacaacaacaacuacgagagcugcaagcuccugaaggaggaguccagccugaucuucgcggacaaccacgagacgcucgagguggccaacaccaagcaccugaucggcgagcugcaguucaagaucaugcucggcgacauccgguacaaguccuucgccgagagccccgagcuggagguggacgccaagugcgucgggugccccagcugcuucgaguccuacagcugcaacuuccagaucgugaccaacaucgacaccgugugcuccgucgacggccccugcacgcuguuccacaaccgccucaucaucagcgcggccaagcaguccuacgggcugaagaugagcugcucccggcgcccggagcagaccgaggaguuccagaucugcaaccggaaguacagcgugcuguucaccaccaucgacaagaacgacaagaucgagaucaacacgggcgaccagaccuccuacaucuacgagaaggacaaccgcugcaagaccuggcucugccgggugcgcgacgagggcaucagcgucaucuucgagccccugaaggccuucuucggguccuacuucagcaucaucuucuacgugaucgugggcaucaucguccuguuccucaucaucuacaucuuccugcccauguucuucaagcugcgcgacauccucaagcggaacgaguaccuguaccugcaggagcucaagcacaaguga

SEQ ID NO: 12567 - RNA, 4302 nt, Artificial Sequence
  derived and/or modified CDS sequence (opt1) from NORV(0234)__EU004188.1__GP
augaucugguucauccugcuccuggccaucgcccccagcuucggcaccccgaucgcgacccgcugcuuccacgggggccagcugaucgccgaggccaagucccagacgagcaucuccgaguucugccucaaggacgacgugagcaugaucaaguccgaggucaccuacaccaagaacgacaccgggaucuucggccacagcaagguguaccgguccuggacgaucaaggacuggaagcugugcaaccccgugcccaccgucgggggcagcaucaacgugaucgaggugaccgccgaccugucccucagcaccaaggccuacgucugcucccgcgacugcacgaucaccaucgacaaggagggcgcgcagaucguguuccagaccgacaagcugaaccacuucgaggugagcgggaccacgcuguccagcggcugguucaagaccaaggccuccgucacccucgaccggaccugcgagcacaucaaggugacgugcgggaagaagacccugcaguuccacgccugcuucaagcaccacaugagcugcauccgcuucuuccacaacaccauccugcccggcuccaugguggccagcaugugccagaacaucgagcucaucaucauccuggggcugacccucaucaucuucauccugauggcgauccugacgaagaccuacaucugcuaccuccugaugccgaucuucaugcccaucgccuacgccuacggcugggccuacaacaaguccugcaagaagugccacugcugcggccuggccuaccaccccuucaccaacugcgggagccacugcgucugcggccucaaguucgaggcgagcgaccggaugcgcauccaccgggaguccgggcugugccagggcuacaagagccugcgcguggcccggcuccugugcaaguccaagggcagcucccuggugaucagcauccuccuguccaugcugauccucagcuucgucacccccaucgaggggacgcugaccaacuacccggagucccgccgguacacccuggaggagaucgccgacgugguggagggcaucaucgccgagcaggaccucaaggaguacaucgucuucuacaccagccuguucgggucccugauccuccugcuggccuucauccucagcgugacgcugaccaaggugcuggaccuccuggcgaagaccaacgucaucuacugcgaggagugcuccauguaccacccccgcaagggcaucaaguacaacggggacuucaccaacaagugcggcuucugcacgugcgacgagcaggaggacguggagggcgugaucauccacaaggucagcaagaagugcaccuaccgguaccaggugaagugggccaagaucaucaugaucaucgucgugauccugcucauggcccagaacaccauccugaucguggccgccgagaccgacugcuggacgaagaagucccuggagcucgacugcaucgggccccugcugaacaucggcagcugcuccgggaaggaggcgcgcaccuacgagaccgaggucaagaagcuggugagccaguccaaggugacccacaucgacgccgagcacaucagcauccucggcgccaccaucgacagcgccaucaaguccauccgggcccagaagacguacgcgaccaugcaccuccuggagaccgucuuccugaugaagaacugcgacuacuacaccguguucgagcacaacagcggguacucccaggccaaguggcgccugaucgccaagacgaaccacuucgacaucugcagccggcacuccgcccaccacuucugccgcugcaucaacgacgagaccaagugccagaacggcaacugggacuucgcgggcgagaugaacaacaccuacagcaccaagaaggacuucuaccggcacgaccuggaccucuucuacacgaucuucgagaacgccuuccccggguccaccgagagccuguucuaccaccuccugcagaccaagaacaccacgggcgccucccgcauccuggagaagcugagcaccaaguucgggaacaacaacauguucgugggcaucuggaaguucgggcaguaccuccugacccugccguacgucaacgagaccgagcucucccccagccggcaguccacgauccugaccaacagcaacucccugagccgcuccaccggccgccaggagagccucagcuccgccauccccggccccaacaccaaggagugcagcaacgcccgggacguggggugcaucuccccgcgcuucggcauccccaucgggaaccugacggcgugcggcgagagccccuccuacaagaucuacaagacccccgagaagcuguacaagagcaacaacaagggcgagaucuggugcuccgacgacgugcacugccucaagaacuucgagccggccaccgaggagaucgucaaccggaucaagcagaugaccugcuuccugacggacgugagcaccaagaccgacaucuucuccaucgccaccagcacgugccgcaugguggacaagggggucugcaccgugaacgacgccaaguggaacauccugaagugcgacuccggccucuucuacuucaccgaccagcgggaggggcaggacaccggcaacgacuucggggaguacugcaucagccacuccugcaacacggagcgcuuccccaucaaccccgacauccugaaggacugcaccugggaguaccacagccggaaguccaaguacaucagcaccaucucccuggagagccucgacgaguuccgccgggccauguccgacaagcugagccacacccugaugaucuacaacuucaagcccacggcgaaccucccgcacaucaagcccaccuacaaguucaucaccgccaacggcaucgagaacagcgacggccuggacuccgccuacaucgugagcuccauccccgcccucgggggcaugagcgucggguacaacgugcagaccaaggacaacuucccccugcuggacaucaucguguucaucaaguccgccgucauccgcaccacguacaaccacaucuacgacaccggcccgaccaucgggaucaacacccagcacgacgagcacugcacgggcgcgugccccacccagaucccccacaaggacaacuggcugaccuucagccaggagcggaccucccgcuggggcugcgaggaguucgggugccucgccaucaacacgggcugcguguucgggagcugccaggacaucauccacccggagaccaagguguaccggaaggccauggaggaggaggucauccugaccgugugcgugaccuuccccggcaacacguacugcaccgagaucaacgccaucgagcccaagaucaccgacgagaucgagcugcaguucaagaccgucgacacgaagacccuccccaacauccuggcggugcagaaccacaagcuguacuccgggcagaucaacgaccucggcagcuucucccagggcugcgggaacgugcagaagaccaaccagagcauccugggcaccgggacggccaaguucgacuacgucugccacggcgccucccgcaaggacaucaucgugcggcgcugcuacaacaacaaccacgacagcugcaagcugcucaaggaggagaccucccugaucuucgccgacaaccacgagacccugguggucgccaacaccaagcaccucaucggggagcugcaguucaagaucaugcugggcgacauccgguacaagagcuucgcggaguccccggagcucgagaucgacgccaagugcgugggcugccccagcugcuucgaguccuacagcugcaacuuccagaucaucacgaacaucgacaccgugugcagcgucuccgggcccugcacccuguuccacaaccgccugaucaucaccgccacgaagcagagcuacggcaucaagauguccugccccaccaagccggaggggaccgagaccuucgagaucugcaacaagcaguacaagaucuucuucacgaccaucgacaagaacgacaagaucgagaucaacaccggcgaccagaccagcuacaucuacgagaaggacaaccggugcaagacguggcucugccgcgugcgcgacgagggcaucuccgugcuguucgagccccugcgggccuucuucgggagcuacuucuccaucaucuucuacgccgucgugggcaucaucauccucuuccuggcgguguacaucuuccugcccaugaucuucaagcuccgcgacaugcugaagaagaacgaguaccuguaccuccaggagagcaagcacaaguga

SEQ ID NO: 12568 - RNA, 4305 nt, Artificial Sequence
  derived and/or modified CDS sequence (opt1) from PLAV(75V3066)__KX100122.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaucaagaacgacaccgggcuguucggccacaacaagguguuccggagcuggaccaucaaggacuggaagcugugcaacccgauccccaccgccgggggcacgaucaacgucaucgaggugaacaaggaccucucccugaugaccaagaccuacaucugcagccgcgacugcaccaucacgaucgacaaggaggaggcccagaucaucuuccagaccgacaagcugaaccacuucgagguguccggcaccacccucagcuccgggugguucaagagcaaggccuccgucacgcuggaccggaccugcgagcacgugaaggugaccugcggcaagaagucccugcaguuccacgcgugcuucaagcaccacaugagcugcguccgcuucuuccacaacaccauccuccccgggaacaugaucacgagcaugugccagaacaucgagcugaucaucauccugggccucacccuggccaucuucauccugauggugaugcucaccaagaccuacaucugcuaccugcugaugcccaucuucaugccgaucgccuaccucuacgggugggccuacaacaaguccugcaagaagugcaacugcugcggccuggcguaccaccccuucacgaacugcggcagccacugcgugugcgggcugaaguucgaggccagcgaccggaugcgcauccaccgggaguccggccucugccagggguacaagagccugcgcaucgcccggcugcucugcaaguccaagggcagcucccuggucaucagcggccugcucuccaugcugauccugagcuucgugacccccaucgaggggaccaucaccuccuaccccgagagccgcaaguacacgcucgaggagaucaccgacguggucgagggccugguguccgagcagaacaucaaggaguacaucguguucuacaccagccuguucgggucccucauccugcugcucgccuucaucaugagcaucacccuguccaagaucacgagcauccuggccaagcggaacgucaucuacugcgaggagugcuccauguaccacagcaagcgcggcaucaaguacaacggggacuucaccaacaagugcggcuucugcacgugcaacgagcaggaggacaccgagggccucgugauccacaagguguccaagcggugcaccuacaaguaccagcugaagugggcgaagguccugaugaucacccucgugcugcugcugaucgcccagaacaccauccucaucguggccgccgagaccgacugcuggacgaagaagucccuggacaucgacugcaucgggccgaugcuggacaucggcagcugcaccaacaagaacacccgcagcuacgacgccgaggcgcagaagcucgucagccaguccaagaucagccagcuggacgccgaccaggugucccugcucgggaacagcaucgacuccgccaucaaggccauccgggcccagaagaccuaccccaccaugcaccuccuggagacgaucuuccucaugaagaacugcgacuacuacaccaacuucaaccacaacagcggcuacucccaggcgaaguggcgccugaucgccaagaccgggcacuucgacaucugcagccggcacuccacccaccacuucugccgcugcaucaacgacggcacgaagugccagaacggcgacugggacuucgccggggagaugaacgagaccuacaacagcaagaacgacuucuacucccacgaccugaaccucuucuacaccaucuucgagaacgccuuccccggcaccacggagagccuguucuaccagcugauccagaagaagaacaccaccggggccuccaagguccucggcaagcugaucaccaaguacgggaacaacaacauguucgugggcguguggaaguucggccaguaccugcucacgcugcccuacaucaacaacaccgagcugagccagaaccggcgccucaccauccuggcgacccaggagauccugucccggagccacagcgggcgccaggaguccaugagcaacgccauccagggcuccaucacgaaggagugccacaacgccaagggggucggcugcaucagcccgcgcuucggcauccccaucgggaaccucaccgccugcggcgacucccccaacuacaagaucuacaagacccccgagaagcuguacaagagcaacaacaagggggagguguggugcuccaacgacgugcacugccugaacgacuucgagccggcggacgaggaggucaucaacaagaucaagaagcugaccugcuuccugacggacgugagcguggaggucgacaucuucuccguggccgccagcacgugcaagauggccgacaagggcgugugcaccgucaacggggccaaguggaacaucaucaagugcgacuccggccuguacuacuucaccgaccaccgggagggccaggacaccgggaacgacuucggcgaguacugcaucagccacuccugcaacaccgagcgcuuccccaucaaccccgacacccucaaggacugcaccugggaguuccacagccggaaguccaaguacaucagcacgaucucccuggagagccuggaggaguuccgccgggcgauggccgagaagcucucccacacccugaccaucuacaacuucaagcccaccgccaaccugccgcacauccgccccacguacaaguucaucaccgccaacgggguggagaacagcgacggcaucgagagcgccuacauccucuccagcauccccgcgcucgggggcaucuccgugggcuacaacguccagaccaaggacaacuucccccugcuggacaucaucguguucaucaagagcgccgugauccggaccacguacaaccacaucuacgacaccgggccgaccaucggcaucaacacccagcacgacgagcacugcaccgggcccugccccgccgucgugccccacaaggagaacuggaugacguucucccaggagcgcaccagccgguggggcugcgaggaguucgggugccuggccaucaacaccggcugcguguucggcuccugccaggacaucauccacccggagaccaaggucuaccgcaaggccguggaggaggaggugguccugacggugugcaucaacuuccccgggaacagcuacugcaccgagaucaacgcgaucgagcccaagaucaccgacgagaucgagcuccaguucaagaccguggacacgaagacccugccgaaccugcucgccguccagaaccacaagcuguacuccggccagaucaacgaccuggggagcuucucccagggcugcgggaacgugcagaagaccaaccacagcauccucggcaugggcaccgugaaguucgacuacgucugccacggggccucccggaaggacgugacggugcgccggugcuacaacaacaacuucgacagcugcaagcugcugaaggaggagaccucccucaucuucgccgacaaccacgagacccuggaggucgcgcacaccaagcaccugaucggcgagcuccaguucaagaucaugcugggggacauccgcuacaagagcuucgccgagucccccgagcuggagaucgacgccaagugcgugggcugccccagcugcuucgaguccuacagcugcaacuuccagaucgugacgaacaucgacaccgucugcagcguggagggccccugcacccucuuccacaaccggaucaucaucuccgccaacaagcagagcuacgggcugaagauguccugccagaccaagccgaaccagaacgaggaguucaucaucugcaaccgcaaguacagcgugcuguucacgaccaucgacaagaacgacaagaucgaggucaacaccggcgaccagaccuccuacaucuacgagaaggacagccggugcaagacguggcucugccgcgugcgggacgaggggaucuccgugcuguucgagccccugaaggccuucuucggcagcuacuucuccaucaucuucuacgucgugguggggaucaucguccucuuccugaucguguacaucuuccugcccauguucuucaagcucaaggacgugcugaagcgcaacgaguaccuguaccuccaggagcugaagcacaaguga

SEQ ID NO: 12569 - RNA, 4305 nt, Artificial Sequence
  derived and/or modified CDS sequence (opt1) from PLAV(75V5758)__KX100128.1__GP
auggagcugcucaucaucauccugcugcucggcagcgccgccuccagccccguguccacccgcugcuuccacgggggccagcugaucgcggagagccgguccgccaccagcaucuccgaguucugccugaaggacgacgucagcaugaucaaguccgaggugacguacaccaagaacgacaccgggaucuacggccacaacaagguguuccgcagcuggaccaucaaggacuggaagcucugcaacccgauccccacggccgggggcuccaucaacgucaucgaggugaacagcgaccugucccuggccaccaaggccuacgugugcagccgggacugcaccaucaccaucgacaaggaggacgcgcagaucaucuuccagacggacaagcucaaccacuucgaggucuccggcaccacccugagcuccgggugguucaagaccaaggccagcgugacgcuggaccggaccugcgagcacaucaaggugaccugcggcaagaagucccuccaguuccacgccugcuucaagcaccacaugagcugcauccgcuucuuccaccacaccauccugcccgggacgauggucagcuccaugugccagaacaucgagcugaucaucaucaucggccucacccuggccaucuucauccugauggugauccucaccaagaccuacaucugcuaccugcugaugcccguguucaugccgaucgcguacaucuacgggugggccuacaacaagagcugcaagaagugcaacugcugcggccucgccuaccaccccuucacgaacugcggcucccacugcgucugcgggcugaaguucgaggccagcgaccgcaugcggauccaccgcgaguccggccugugccagggguacaagagccuccggaucgcccgcaugcugugcaaguccaagggcagcucccuggugaucagcggccuccuguccaugcugcuccugagcuucaucacccccaucgaggggacccugaccaacuaccccaacgagaagcaguacacgcucgaggagaucgcggacguggucgagggcaucaugaccgagcagcaccugaaggaguacgugguguucuacaccucccuguucgggggccucauccugcugcucacccugauccugagcaucacgaucaacaaggucaccgaccuccuggccuccaccaacgugaucuacugcgaggagugcagcauguaccacuccaagaaggggaucaaguacaacggcgacuucaccaacaagugcggcuucugcacgugcagcgagcaggaggacguggagggggucgugauccacaaggugucccggaagugcaccuacaaguaccagcugaaguggguccgcgugaucaugaucauccucgcccugcugcucaccauccagaacaccguccugaucguggccgccgagguggacugcuggacgaagaaguccaucgagaucgacugcaucggcccgcugcugaacaucgggagcugcaccgacaagagcggcaagaccuacgagaccgaggucaacaagcucgugcggcagagcaaggugacccaggcggacgccgagcagaucuccguccuggggaacacgcuggacagcgccaucaaggccauccgcucccagaagaccuacgagaccaugcacuuccucgagaccguguuccugaugaagaacugcgacuacuacagcuccuucgagcacaacagcggcuacucccagacgaaguggcggcugaucgccaagaccagccacuucgacaucugcucccgccacagcgcgcaccacuucugccggugcgugaacgagggcaccaagugccagaacggggacugggacuucgccggcgagaugaacaacaccuacaacuccaagaacgacuucuaccuccacgaccuggaccuguucuacacccucuucgagaacgccuuccccgggaccaccgagagccuguucuaccagcugcuccagaagaagaacaccacgggcgccuccaagcugcuggggaagcucaucaccaaguacggcaacaacaacauguucgucggcaucuggaaguucgggcaguaccugcugaagcuccccuacaucaacgacaccgagcugagcgccgaccgcaaguccaccaucaugaagucccagcagguccugagccggagccagacgggccgccaggagagccucuccagcgcgacccccgggaccgccaccaaggagugcuccaacgccaaggacaucggcugcaucagcccgcgguucggcauccccaucgggaaccugacggccugcggcgacucccccaacuacaagaucuacaagacccccgagaagaucuacaagagcaacaacaagggggagguguggugcuccgacgacgugcacugccuggcggacuucgagccggccgaggaggagguggugaaccgcaucaagcagaugaccugcuuccucaccgacgucacgaccaagaccgacguguucagcaucgccguguccacgugcaagauggucgacaagggcgugugcacggugaacgacgccaaguggaacauccugaagugcaacagcgggcuguacuacuucaccgaccaccgcgacggccaggacaccggcaacgacuucggggaguacugcaucucccacagcugcaacaccgagcgguuccccaucaaccccgacguccucaaggacugcaucugggaguaccacucccgcaagagcaaguacaucuccacgaucagccuggagucccuggacgaguuccggcgcgccaugagcgacaagcucagccacacccugaugaucuacaacuucaagcccaccgcgaaccugccgcacaucaagcccgccuacaaguucaucaccgccaacggcaucgagaacuccgacgggaucgacagcgccuacauccucuccagcauccccgcccugggcgggauguccgugggcuacaacgugcagacgaaggacaacuucccccugcucgacaucaucgucuucaucaagagcgcgaucaucaagaccaccuacaaccacaucuacgacaccggcccgaccaucgggaucaacacgcagcacgacgagcacugcaccggccccugccccacccugaucccccacaaggagaacuggcugaccuucucccaggagcggacgagccgcugggggugcgaggaguucggcugccucgccaucaacaccgggugcguguucggcuccugccaggacaucauccacccggaggccaagguguaccggaaggccaucgaggaggaggucgugcugaccgugugcaucaccuuccccggcaacacguacugcaccgagaucaacgccaucgagcccaagaucaccgacgagaucgagcugcaguucaagaccgucgacacgaagacccucccgaaccugcugauggugcacaaccacaagcucuacagcgggcagaucaacgaccugggcuccuucagccaggggugcggcaacgugcagaagaccaaccaguccgucaucggggcgggcaccgugaaguucgacuacgugugccacggcgccagccgcaaggacgucaucgugcggcgcugcuacaacaacaacuacgaguccugcaagcugcucaaggaggagacgagccugaucuucgccgacaaccacgagacccuggagguggccaacaccaagcaccucaucggggagcugcaguucaagaucaugcugggcgacauccgguacaaguccuucgcggagagccccgagcucgaggucgacgccaagugcguggggugccccuccugcuucgagagcuacagcugcaacuuccagaucgugaccaacaucgacacggucugcuccgugaacggccccugcacccuguuccacaaccgccugaucaucagcgccaccaagcaguccuacggccucaagaugagcugcucccggaagccggagcccaccgaggaguuccagaucugcaaccgcaaguacagcgugcuguucacgaccaucgacaagaacgacaagaucgagaucaacaccggggaccagaccuccuacaucuacgagaaggacaaccggugcaagacguggcugugccgcguccgggacgagggcaucagcgugaucuucgagccccucaaggccuucuucggguccuacuucagcaucaucuucuacgugaucgucggcaucaucgugcuguuccugaucguguacaucuuccuccccauguucuucaagcugcgcgacauccugaagcggaacgaguaccucuaccugcaggagcugaagcacaaguga

SEQ ID NO: 12570 - RNA, 4317 nt, Artificial Sequence
  derived and/or modified CDS sequence (opt1) from POTV(89-3380)__EU004189.1__GP
auggagcccccgaugaagcuguuccucauccuggccaccgccguggcggccgucuacagccugcccgccucccgcugcuucagcgacggcaucaucaucaaggagaagcaggacuccaaggccgugagcgaguucugccucaaggacgacguguccaugaucaagagccacgucguguacuccaagaacgagagcgggaucuucgccaacucccagauccugcggaaguggaucaucaaggacuggaagcugugcagcccccuccccaccgcgggcgggcagaucaacgugaucgagaucaaccacgaccugacgcuguccaccaagaccuacgucugcaccacggacugcaccaucggcaucgacaaggagaacgcccagaucaccuuccagaccaacaagcucaacuacuucgaggugagcgggacgaccaucuccagcggcugguucaaguccaagaccagcgugucccuggaccagaccugcgagcaccugaaggucagcugcggcaagaaguccaugcaguuccacgccugcuucaagcagcacaugagcugcauccgcuaccuccacaagacggcccugccgggguacauggcggccagcaucugcuccaacaucgagcugaucaucaugaccacccucacccuggccaucuucauccugcucugcaucaucacgaagaccuacaucugcuaccugcugaugccccucuucaugcccaucgccuacaucuacggcuggcuguacaacaagagcugcaagaagugcaacugcugcgggcuguccuaccaccccuucaccaacugcggcagcuacugcgugugcggggccaaguucgagaccuccgaccggaugcgcauccaccgggagagcggccucugccagggcuacaagucccugcgcguggcgcggaagcugugcaagagcaagggguccagccucgucaucuccgugacgcugagcguguucaucuucuccuucaucaccccgaucggcggggucaucaucaacgacaagcugagcgaggagaaguacuccaucaaccagaugauggacgccaucguggaccucgagaacuucagccacaacguguccggcacccagcaggucaucagcgugaucuuccugcugaucuccugccucuuccugcugcucaccuaccgccugaacaagaucauccagcaccuggcccggagcggccuccuguucugcgaggagugcagcauguaccacuccaagaaggacaucaaguacaacggggacuucacgaacaagugcggcuucugcacgugcgggcagcccgaggaccccgagggccugaaccuccacauccugagccagaacugcaccuacaagcagcaguucaagugggugaagaucaucaucuccauccugcucagccugaucaucaucgaguccagcaugauccuggccgccgcggagaccgacugcuucuccgagaagcagaucagcgaguucugccucgggccccugcuguccaucagcuccugcgaggacaagaacagccgcaccuucaagggcgaggcccagaagcuggucgcccucaagaagaucaccuccgacgaggccaugcugaucgagagcaugggcgccaagguggaggacgcgcugaagaugauccaggcccagaaguccccggacagcauguacaccauggaguacguguuccucaacaccuacugcgacuacuacucccuguucgagcacaacagcggguacagccagaucaaguggcgguacauccugaagacgcaccaguucgacgccugcgcccgccacuccaacaaccacuucugccggugcaugagcgacggcaugcacugccccucccucgacugggacaucgccgacgagcugaacaacaccuacaucaccaagcccaacuucuucaagcacgacuacaaccugcuccuggacgucaucaccgcggccuuccccgggacgggcgccguguucgucaucgacgccugcaagaaggcgaacgccaccgccaucaagaccuucagcaacaacaucaucgcccgcuucccguacaacaaccugcucaagggggugaugaaguuccugcaguacaucuccaagcaccccagcuucaagaaguaccagcccgacacccggcacuacgaccugauccccguggccccgaccgcgcgcggccggucccucggccgcagcaacuccuacagcgacgcccaggucgggccgcccacgaaggacugccagaagcugaaggaggugggcugccugucccccaaguucgggcucccccuggagagcaucaucuccugcggcagcucccccaacuacaagcuguacaagaagccccagaaguacuacaagagcaacaacaaggagaacaccuggugcuccaaggacgugcacugccuccacgacuucgagcccaucaccgaggacguccuggagaaggugaaggugaugaccugcugggagaucgagccggggacgaucgaggacaucuucaccaucgccagcgagaccugcaagaucaacgaccggggcgucugcgaggugaacgccgccaaguggaagaucgugaagugcgagaccggccuguacuacuacacggaccaccgcgagggggacgacaccggcuccgaccucgggcacuacugccugacccacaagugcgcgggcggccgguaccccaucaaccccgagauccugcagaacugcaucugggaguuccacagccagaagucccaguacaucaaccaggucgaccucgagcagaucgaggaguacaagaaggcccugaccgagaagcugacgcacacccucaaccacuacaacuuccugccgaccaagaaccugccccacaucagccccaacuacaaguacgugacccucaacgggcaggagacgagcgacggcaucgagaacuccuacaucgugagcgagauccccgccaucgccgggaccuccaucggccugaagguccagaccaagaacaacgggaacaucuucgaccugaucaucuacgugaagcgcgccgacaucaucgcgagcuacaaccacaucuacgacaccggcccgacgaucggccacaacguggagcacgaggagcucugcaccgggcagugcccccagcacauccccgccaaggccaacuggcugaccuucucccaggagcgcaccagccgguggggcugcgaggaguucgggugccuggccaucaacacgggcugcgucuacggguccugccaggacaucaucaagcccguggcgaagguguaccgcaagagcaccgaggagaaggucgagcucgagcugugcaucgugcugccggaccggaacuucugcaccacccucaacgcccuggagcccaagaucacggaggagaucgagcugcaguucaagaccaucgaccaggugucccuccccaacaucguccugcugcgcgaccacaagcuguucaagggccagaucaacgaccugggcaccuucgggcagaacugcggcaacgugcagaagaccaaccagagcauccugggggccggcacggugcgguucgacuaccucugccacuccgccagccgcaaggacaucaucauccggcgcugcuacaacaacaacuacgacuccugcaaccaccuccagcuggccgagagccucaucuuccuggacaaccacgagacccuggagguccggaagcccaaccacauccucgggacccuguccaugaagcugaugcucggcgacuuccaguacaagaccuucgcgaaggacaucgagcuggacuucacgggccgcugcguggggugcaucggcugcuucgagggguucgugugcgagaugcacaucaccaccaccgucgaggcgaccugcaaccuggaggccagcugccaguucuuccacaaccagcuccacaucaagccggacgugcugaaguacuacacgaagaugaccugccagaccgacgaguacauccccuccaagaucaagaucugcaacaaggaguacaagaucaccaucggcaaggugcggaagaacgacaagaucgagaucgacaacagcgaccagacgagcuacaucaaggagaaggacgagcgcugcaagaccuggcugugccggguccgcgacgaggggaucuccgugaucuucgagccccuccugaacaucuucggcaacuacggccggaucgccguggccgucaucagcgccauccuggcccucaucgugcugguguacauccugaugcccaucugcaugaagauccgcgacauccucaagaccaacgagaaggaguuccugaucgaguccaaguacaaguga

SEQ ID NO: 12571 - RNA, 4311 nt, Artificial Sequence
  derived and/or modified CDS sequence (opt1) from TENV(TSV-FE3-66FB)__FJ943508.1__GP
auggagaucuucuucaucgcccugcucgccaucgcgaacagcgugaacuccacgccccuggccacccgcugcuuccacggcgggcagcugaucgccgagagcaaguccgccacgagccucuccgaguucugccugaaggacgacgucagcaugaucaaguccgagaucuacuacgugaagaacgagaccggcaucuucagccacaacaaggugcugcgguccuggaccaucaaggacuggaaguucugcaacccgguccccaccgccgggggcagcaucaacgugaucgaggugaacuccgacaugagccucgcgacgaagaccuacgucugcucccgcgacugcaccaucaccaucgaccgggaggaggcccagaucaucuuccagacggagaagcugaaccacuucgaggugagcgggaccacccuguccagcggcugguucaaguccaaggccagcgugacccucgaccgcacgugcgagcaccugaaggugaccugcggcaagaagucccugcaguuccacgccugcuucaagcaccacaugagcugcauccgguucuuccacaacaccaugcuccccgggcgcaucgucaacagcaugugccagaacaucgagcugaucaucauccugggccucaccaucgugaucuucauccugauggucauccugacgaagaccuacaucugcuacauccucaugccccuguucaugccgaucgcguacaucuacgggugggccuacaacaaguccugcaagaagugcaacugcugcggccuggccuaccaccccuucaccaacugcgggagccacugcgugugcggccucaaguucgaggccuccgaccggaugcgcauccaccgggagagcggccugugccagggguacaagucccugcgcaucgcccggcuccugugcaagagcaagggcuccagccuggugaucuccauccuccugagcaugcugcuccuguccuucgucacccccaucgagggggcgcugacgaacuacccccagagcaagcucuacucccuggaggagaucgccgacgugguggagggccugaucaccgagcacaacgucaaggaguacaucguguucuacaccagccucuucggcgggcugauccugcuccuggccuucauccuguccaucaugcucaccaaggugacgagcaugcuggcccgcaccaacgucaucuacugcgaggagugcuccauguaccacagcaagaccggcaucaaguacaacggggacuucaccaacaagugcggcuucugcacgugcgacgagcaggaggacgccgaggggaucaucauccacaagguguccaagaagugcaccuacaaguaccagcugaagugggcgcggaucaucaugaucauccucaucgugcugcugaccacccagaacacgauccucaucgucgccgccgagguggacugcugggagcgcgccacccugagccaggagugcaucggcccgcugcagaagaucgaggacugccagaacaaggaggagaagaccuacaugagcgaggccaacaagcuggucucccagagcaagaucacccaggcggacgccgaccagguguccgugcucggcgacacgaucgacagcgccaucaaggccauccggucccagaagaccuaccagaccaugcaccuccuggagaccgucuuccugaugaagaacugcgacuacuacagcaccuucgagcacaacuccggguacagccaggccaaguggcgccugauggcgaagacgaaccacuucgacaucugcucccggcacagcaaccaccacuucugccgcugcgugaccgagggcaccaagugccagaacggggacugggacuucgccggcgagaugaacuccaccuacaacaccaagagcgacuucuaccagcacgaccugaaccucuucuucucccuguacgagagcgccuuccccgggaccgccgagucccuguucuaccagcucaucagcgagaagaacaccaccggcgcgucccagcugcugggccagaucaucaagaaguucgccaacaacaacaugcucaucgggguguggaaguucggccaguaccugcugacgcuccccuacgucaacaccaccaagcugagcaagagccgggaggagaccauccugacgaaccaccagcgccucgugcgguccuacaccgggcgccagcagagcauggccaacgccgaggugggcgaguccaccaagaacugccugaacgccaagaacgucgggugcaucagcccccgcuucggcgugccgaucggcaaccugaccgugugcggggaguccacgaacuacaaggucuacaagacccccgcgaagaucuacaagagcaacaaccggcccaagaccuggugcuccgaggacgugcacugccucagcaacuucgagcccgccuccgccgagguggucaacaagaucaagcgcaugaccugcuuccugacggacgugaccaccaacguggacgucuucagcaucgccaucuccacgugcaagauggccgacaagggcgugugcaccgugaacgacgcgcgguggagcauccugaagugcgacuccgggcuccuguacuucaccgaccaccgcgagggccaggacaccggcaacgacuucggggaguacugcaucagccacaacugcaacaccgagcgguacccgaucaaccccgacaucaucaaggacugcaucugggaguaccacucccgcaagagcaaguacaucuccgccaucaaccuggagagccucgaggaguuccggcgcgccauguccgagaagcugagccacacgcuggucaucuacaacuucaagcccaccgccaaccucccccacaucaagccgagcuacaaguccaucaccgugaacggcaucgagaacagcgacgggaucgaguccgccuacauccugagcaacauccccgcgaucggcgggauguccgugggcuacaacguccugaccaaggacggcuucccccuccuggacaucaucaucuucaucaagagcgccgugaucaagacgaccuacaaccacaucuacgacaccgggcccaccaucggcaucaacacgcugcacgacgagaagugcaccgggccgugccccuccaucaucccccacaaggagaacuggcucaccuucagccaggagcggaccucccgcuggggcugcgaggaguucgggugccuggccaucaacaccggcugcguguucggcagcugccaggacaucauccggcccgagacgaagaucuaccgcaaggccgucgaggaggaggugauccugaacgcgugcaucaacuucccggggaacaccuacugcaccgagaucaacgccaucgagcccaagaucaccgacgagaucgagcuccaguucaagacgguggacaccaagacccugcccaaccugcucgccguccagaaccacaagcuguacuccggccagaucaacgacaucgggaccuucagccagggcugcgggaacgugcagaagacgaaccagaccaugcugggcaccggcaccgugcgguucgacuacgucugccacggggccucccgcaaggacaucaucgugcggcgcugcuacaacaacaacuacgagagcugcaagcuccugaaggaggagaagucccugaucuucgccgacaaccacgagacgcucgagguggcgaacacccggcaccuccugggcgagcugcaguucaagaucaugcugggggacauccgcuacaaggccuucgccgagaagccggagcuggagaucgacgccaagugcgucggcugccccagcugcuucgaguccuacagcugcaacuuccagaucguguccaacguggacaccgucugcuacaucgaggggcccugcacccucuuccacaaccggaucaucaucaagacgaugaagcaggccuacggcaucaagaugagcugcaagaccaagcccgcgccgagcgaggaguucaagaucugcggccgcaccuacaacguggccuucaacaccguggagaagaacgacaagaucgagaucaacacgggggaccagaccuccuacaucagcgagaaggacgaccgcugcaagaccuggcugugccggguccgcgacgagggcaucuccgugaucuucgagccccugaagaaccucuucgggaacuacuucaacaucgccuucuacaucaucaucggccugaucgcccuguuccucaccaucuacaucuuccugcccauguucuucaagcugcgggacgugcucaagcgcaacgaguaccuguaccugcaggagcucaagcacaaguga

SEQ ID NO: 12572 - RNA, 4311 nt, Artificial Sequence
  derived and/or modified CDS sequence (opt1) from TENV(TSV-FL06)__FJ943506.1__GP
auggagaucuucuucaucgcccugcucgccaucgcgagcuccgugaacagcacgccccuggccacccgcugcuuccacggcgggcagcugaucgccgaguccaagagcgccacgucccucagcgaguucugccugaaggacgacgucuccaugaucaagagcgagaucuacuacgugaagaacgagaccggcaucuucuccuacaacaaggugcugcggagcuggaccaucaaggacuggaaguucugcaacccgguccccaccgccgggggcuccaucaacgugaucgaggugaacagcgacaugucccucgcgacgaagaccuacgucugcagccgcgacugcaccaucaccaucgaccgggaggaggcccagaucaucuuccagacggagaagcugaaccacuucgagguguccgggaccacccugagcuccggcugguucaagagcaaggccuccgugacccucgaccgcacgugcgagcaccugaaggugaccugcggcaagaagucccugcaguuccacgccugcuucaagcaccacaugagcugcauccgguucuuccacaacaccaugcuccccgggcgcaucgucaacuccaugugccagaacaucgagcugaucaucauccugggccucaccaucgugaucuucauccugauggucauccugacgaagaccuacaucugcuacauccucaugccccuguucaugccgguggcguacaucuacgggugggccuacaacaagagcugcaagaagugcaacugcugcggccuggccuaccaccccuucaccaacugcgggucccacugcgugugcggccucaaguucgaggccagcgaccggaugcgcauccaccgggaguccggccugugccagggguacaagagccugcgcaucgcccggcuccugugcaaguccaagggcagcucccuggucaucagcauccuccuguccaugcugcuccugagcuucgugacccccaucgagggggcgcugacgaacuacccccaguccaagcucuacagccuggaggagaucgccgacguggucgagggccugaucaccgagcacaacgugaaggaguacaucguguucuacaccucccucuucggcgggcugauccugcuccuggccuucauccugagcaucaugcucaccaaggucacguccaugcuggcccgcaccaacgugaucuacugcgaggagugcagcauguaccacuccaagaccggcaucaaguacaacggggacuucaccaacaagugcggcuucugcacgugcgacgagcaggaggacgccgaggggaucaucauccacaaggugagcaagaagugcaccuacaaguaccagcugaagugggcgcggaucaucaugaucauccucaucguccugcugaccacccagaacacgauccucaucguggccgccgaggucgacugcugggagcgcgccacccugagccacgagugcaucggcccgcugcagaagaucgaggacugccagaacaaggaggagaagaccuacauguccgaggccaacaagcuggugagccaguccaagaucacccaggcggacgccgaccaggugagcguccucggcgacacgaucgacuccgccaucaaggccauccggagccagaagaccuaccagaccaugcaccuccuggagaccguguuccugaugaagaacugcgacuacuacuccaccuucgagcacaacagcggguacucccaggccaaguggcgccugauggcgaagacgaaccacuucgacaucugcagccggcacuccaaccaccacuucugccgcugcgugaccgagggcaccaagugccagaacggggacugggacuucgccggcgagaugaacagcaccuacaacacgaaguccgacuucuaccagcacgaccugaaccucuucuucagccuguacgaguccgccuuccccgggaccgccgagagccuguucuaccagcucaucuccgagaagaacaccaccggcgcgagccagcugcugggccagaucaucaagaaguucgccaacaacaacaugcucaucggggucuggaaguucggccaguaccugcugacgcuccccuacgugaacaccaccaagcugagcaagucccgggaggagaccacgcugaccaaccaccagcgccucgugcggagcuacaccgggcgccagcaguccauggccaacgccgaggucggcgagagcaccaagaacugccugaacgccaagaacguggggugcaucagcccccgcuucggcgugccgaucggcaaccugacggucugcggggagagcaccaacuacaagguguacaagacccccgcgaagaucuacaaguccaacaaccggcccaagaccuggugcagcgaggacgugcacugccucuccaacuucgagcccgccagcgccgaggucgugaacaagaucaagcgcaugacgugcuuccugaccgacgugaccaccaacgucgacguguucuccaucgccaucagcacgugcaagauggccgacaagggcgugugcaccgucaacgacgcgcggugguccauccugaagugcgacagcgggcuccuguacuucaccgaccaccgcgagggccaggacaccggcaacgacuucggggaguacugcaucucccacaacugcaacacggagcgguacccgaucaaccccgacaucaucaaggacugcaucugggaguacuacagccgcaaguccaaguacaucagcgccaucaaccuggagucccucgaggaguuccggcgcgccaugagcgagaagcugagccacacccuggugaucuacaacuucaagcccaccgccaaccucccccacaucaagccguccuacaagagcaucaccgugaacggcaucgagaacuccgacgggaucgagagcgccuacauccuguccaacauccccgcgaucggcgggaugagcgucggcuacaacgugcugacgaaggacggcuucccccuccuggacaucaucaucuucaucaaguccgccgugaucaagaccaccuacaaccacaucuacgacaccgggcccacgaucggcaucaacacccugcacgacgagaagugcaccgggccgugccccagcaucaucccccacaaggagaacuggcucaccuucucccaggagcggaccagccgcuggggcugcgaggaguucgggugccuggccaucaacacgggcugcgucuucggcuccugccaggacaucauccggcccgagaccaagaucuaccgcaaggccguggaggaggaggugauccugaacgcgugcaucaacuucccggggaacaccuacugcaccgagaucaacgccuucgagcccaagaucacggacgagaucgagcuccaguucaagaccgucgacaccaagacccugcccaaccugcucgccgugcagaaccacaagcuguacagcggccagaucaacgacaucgggacguucucccagggcugcgggaacgugcagaagaccaaccagaccaugcugggcaccggcacgguccgguucgacuacgugugccacggggccagccgcaaggacaucaucgugcggcgcugcuacaacaacaacuacgaguccugcaagcuccugaaggaggagaagucccugaucuucgccgacaaccacgagacccucgaggucgcgaacacccggcaccuccugggcgagcugcaguuccgcaucaugcugggggacauccgguacaaggccuucgccgagaagccggagcuggagaucgacgccaagugcgugggcugccccagcugcuucgagagcuacuccugcaacuuccagaucgugagcaacgucgacaccgugugcuacaucgaggggcccugcacccucuuccacaaccgcgugaucaucaagaccaugaagcaggccuacggcaucaagaugagcugcaagaccaagcccgcgccguccgaggaguucaagaucugcggccgcaccuacaacgucgccuucaacacgguggagaagaacgacaagaucgagaucaacaccggggaccagaccagcuacaucuccgagaaggacgaccggugcaagaccuggcugugccgcgugcgggacgagggcaucagcgucaucuucgagccccugaagaaccucuucgggaacuacuucaacaucgccuucuacaucaucaucggccugaucgcccuguuccucacgaucuacaucuuccugcccauguucuucaagcugcgcgacgugcucaagcggaacgaguaccuguaccugcaggagcucaagcacaaguga

SEQ ID NO: 12573 - RNA, 4305 nt, Artificial Sequence
  derived and/or modified CDS sequence (opt1) from TLAV(61D240)__KX100119.1__GP
augcuguuccuccugauccuggccuuccucggcuucagcaccuccaaccccaucgccacccgcugcuuccacgggggccagcugaucgcggagagcaaguccgccacgagcaucuccgaguucugccugaaggacgacgugagcaugcucaaguccgaggucguguacaccaagaacgacaccgggcuguucggccacaacaagguguuccggagcuggaccaucaaggacuggaagcugugcaacccgauccccacggccgggggcaccaucaacgucaucgaggugaacaaggaccucucccugaugaccaagaccuacaucugcagccgcgacugcacgaucaccaucgacaaggaggaggcccagaucaucuuccagaccgacaagcugaaccacuucgagguguccggcaccacgcucaacagcgggugguucaaguccaaggccagcgucacccuggaccggaccugcgagcacgugaaggugaccugcggcaagaagucccugcaguuccacgcgugcuucaagcaccacaugagcugcguccgcuucuuccacaacacgauccuccccgggaacaugaucaccuccaugugccagaacaucgagcugaucaucauccugggccucacccuggccaucuucauccugauggugaugcucaccaagacguacaucugcuaccugcugaugcccaucuucaugccgaucgccuaccucuacgggugggccuacaacaagagcugcaagaagugcaacugcugcggccuggcguaccaccccuucaccaacugcggcucccacugcgugugcgggcugaaguucgaggccagcgaccggaugcgcauccaccgggagagcggccucugccagggguacaagucccugcgcaucgcccggcugcucugcaagagcaagggcuccagccuggucaucuccggccugcucagcaugcugauccuguccuucgugacccccaucgaggggaccaucacgagcuaccccgagucccgcaaguacacccucgaggagaucaccgacguggucgagggccuggugagcgagcagaacaucaaggaguacaucguguucuacaccucccuguucgggagccucauccugcugcucgccuucaucauguccaucacgcugagcaagaucaccuccauccuggcccggcgcaacgucaucuacugcgaggagugcagcauguaccacuccaagcggggcaucaaguacaacggggacuucaccaacaagugcggcuucugcacgugcaacgagcaggaggacgcggagggccucgugauccacaaggugagcaagcgcugcaccuacaaguaccagcugaagugggccaagguccugauggugacccucgugcugcugcugaucgcccagaacaccauccucaucgucgccgccgggaccgacugcuggacgaagaagucccuggacaucgacugcaucggcccgaugcuggacaucgggagcugcaccaacaagaacacccggaacuacgacaccgaggcgcagaagcucgugagccaguccaaggucagccagcuggacgccgaccaggccucccugcucggcaacagcaucgacuccgccaucaaggccauccgcgcgcagaagaccuaccccacgaugcaccuccuggagaccaucuuccucaugaagaacugcgacuacuacaccagcuucaaccacaacuccggguacagccaggccaaguggcggcugaucgccaagaccggccacuucgacaucugcucccgccacagcacgcaccacuucugccggugcaucaacgacggcaccaagugccagaacggggacugggacuucgccggcgagaugaacgagaccuacaacuccaagaacgacuucuacagccacgaccugaaccucuucuacaccaucuucgagaacgccuuccccgggacgaccgagucccuguucuaccagcugauccagaagaagaacaccaccggcgcgagcaagauccucgggaagcugaucacgaaguacggcaacaagaacauguucgugggcguguggaaguucgggcaguaccugcucacccugcccuacaucaacaacaccgagcugucccagaaccgccggcagaccauccucgccacgcaggagagccugucccgcagccacagcggccgccaggaguccaugagcuccgccauccaggggagcgucaccaaggagugccacaacgccaaggacgugggcugcaucuccccgcgguucggcauccccaucgggaaccugaccgcgugcggcgacagccccaacuacaagaucuacaagacccccgagaagcucuacaaguccaacaacaagggggagguguggugcagcaacgacguccacugccugaacgacuucgagccggccgacgaggagguggugaacaaggucaagaagcugacgugcuuccucaccgacguguccgugaagaccgacaucuucagcgucgccgccuccacgugcaagauggccgacaagggcgugugcaccgugaacgacgcgaaguggaacaucaucaagugcgacagcgggcuguacuacuucaccgaccaccgcgagggccaggacaccggcaacgacuucggggaguacugcaucucccacagcugcaacaccgagcgguuccccaucaaccccgacauccugaaggacugcacgugggaguuccacucccgcaagagcaaguacaucuccaccaucagccucgagucccuggaggaguuccggcgcgccaugaccgagaagcugagccacacccucacgaucuacaacuucaagcccaccgccaaccugccgcacauccggcccaccuacaaguucaucaccgccaacggcgucgagaacagcgacgggaucgaguccgccuacauccugagcuccauccccgcgcucggcgggaucagcgugggcuacaacgugcagacgaaggacaacuucccccugcuggacaucaucgucuucaucaaguccgccgugauccgcaccaccuacaaccacaucuacgacaccggcccgaccaucgggaucaacacgcagcacgacgagcacugcaccggccccugccccgccguggucccccacaaggagaacuggaucaccuucagccaggagcggaccucccgcugggggugcgaggaguucggcugccucgccaucaacacggggugcguguucggcagcugccaggacaucauccacccggagaccaagguguaccggaaggccgucgaggaggaggugauccugaccgugugcaucaacuuccccggcaacaacuacugcaccgagaucaacgcgaucgagcccaagaucacggacgagaucgagcugcaguucaagaccgucgacaccaagacccucccgaaccugcuggccgugcagaaccacaagcucuacuccgggcagaucaacgaccugggcagcuucucccaggggugcggcaacgugcagaagacgaaccacagcauccuggggaugggcaccgccaaguucgacuacgucugccacggcgccucccgcaaggacgugaucgugcggcgcugcuacaacaacaacuucgacagcugcaagcuccugaaggaggagaccucccugaucuucgcggacaaccacgagacccucgaggucgcccacacgaagcaccugaucggggagcugcaguucaagaucaugcucggcgacauccgguacaagagcuucgccgagucccccgagcuggagaucgacgccaagugcguggggugccccagcugcuucgaguccuacagcugcaacuuccagaucgugaccaacaucgacaccgucugcagcguggagggccccugcacccuguuccacaaccgcaucaucaucuccgccaacaagcagagcuacggccucaagauguccugccagacgaagccgaaccagaacgaggaguucaucaucugcaaccggaaguacagcgugcuguucaccaccaucgacaagaacgacaagaucgaggucaacaccggggaccagacguccuacaucuacgagaaggacagccgcugcaagaccuggcugugccgggugcgcgacgagggcaucuccgugcuguucgagccccugaaggcguucuucgggagcuacuucuccaucaucuucuacgucguggugggcaucaucguccuguuccucaucaucuacaucuuccugcccauguucuucaagcugaaggacgugcucaagcgcaacgaguaccuguaccugcaggagcucaagcacaaguga

SEQ ID NO: 12574 - RNA, 4305 nt, Artificial Sequence
  derived and/or modified CDS sequence (opt1) from NRIV(9800535)__AY593725.1__GP
augcugcuccugcuggugcuccugauccccugcuacgucagcgccuccccgguggugacccgcugcuuccacggcgggcagcugaucgccgagaagaagucccagaccgcggucuccgaguucugccucaaggacgacgugagcacgaucaaguccgagaucaccuacgagaagaacaacaccggccuguucgcccacagcaaggugcugcggaacuggaucaucaaggacuggaagaacugcaaccccguccccaccgccgggggcuccaucaacgugaucgaggugaacacggaccucagccugaccaccaagaccuacgucugcucccgcgacugcacgaucaccguggacaaggaggacgcccagaucaucuuccagaccgagaagcugaaccacuucgaggugagcgggaccacgcucuccagcggcugguucaagaccaaggccuccgucacccuggaccggaccugcgagcacaucaaggugacgugcggcaagaagacccugcaguuccacgcgugcuucaagcaccacaugagcugcauccgcuucuuccacgggaccauccuccccggcaccauggccacguccaucugccagaacaucgagcugaucaucaucaucagccugacccucaucaucuucauccugaugaucauccugaccaagaccuacaucugcuaccuccugaugccgcuguucaugcccaucgccuacuucuacgggugguccuacaacaagagcugcaagaagugcuccugcugcggccucgccuaccaccccuucacgaacugcgggagccacugcgugugcggccugaaguucgaggcgagcgaccggaugcgcauccaccgggaguccggccugugccagggguacaagagccuccgcgucgcccggcugcugugcaaguccaagggcagcucccucgugaucagcauccugcuguccaugcucauccugagcuucgugacccccaucgaggggacccugaccaacuacccggagucccgcaaguacgaccucgaggagaucgccgacguccuggagggcuucaucguggagaagggcaucaaggaguacguggucuucuacacgagcaucuucggggcccugcuccugcugaucgcccucgugaucaccaucacccugaacaaggugaccgaguaccugacgaacaucaacguccucuacugcuacgagugcuccauguaccacagcaagaagaacaucaaguacaucggcgacuucaccaacaagugcggguucugcacgugcggcgagcuggaggaccaggaggggcugaagauccacaaggugucccggaagugcaucuacaaguaccagcucaccuggagcaagaucaucaugaccauccuggucugccugcugaucgcgcagaacaccauccucaucguggccgccuccgacgacugcuggaccaagaagucccuggagauggagugcaucggcccccugcagcaggucgacacgugcgacgacaaggccagccgcagcuacuccggcgaggcccggaagcucgugcgcgcgagcaagaucagcgaccuggacgccgcccagguggggcugcucggcuccaccaucgagagcgccaucgccuccauccggaagcagcgcaccuaccccaccaugcaccuccuggagagcguguuccucgggaagcacugcgacuacuacaagaccuucgagcacaacuccggcuacagccaggcgaaguggcggcugaccgccaagacgcaccacuucgacaucugcucccgccacagcacccaccacuucugccggugcaucuccgacgggaccaagugccagaacggcgaccuggacuucgccggcgagaugaacagcaccuaccaguccaagaaggacuucuucgagcacgacuucaagcuguucugcacgcuggucgagaacgccuuccccgggaccaccgagagccuguucuacgagaugcucuccaagaagaacaccacgggcaucaagcagcugcuggacaagcucacccgcaaguucgggaacaacaacauguucgugggcaucuggaaguucgggcaguaccugaugagccugccguacaucaacgagaccucccucacccccgcccagaucagcaagauccuggaggugacggaccagcaccaccgguccaucagcggccgccaggagagccuggcguccgccacccccggcagcaaguccaaggagugcgggcacgccaagaaggucagcugcaucagcccccgcuucagcgugccgauggagggccucauggccugcggggacucccccaacuacaagaucuacaagacccccaccaagcuguacaagagcaacaacaagggcgagguguggugcuccggcgacguccacugcagccaggagcugucccccgcgagccaggaguccguggaccggaucaagcagaucacgugcuuccucaccgagccggaggugagcgacgacgucuucuccaucgccaucagcacgugcaaggugcaggacaagggggugugcaccgucaacgaggaccgcuggaacgugaucaagugcgacuccggccugaucuacuacaccgaccagcgggacgggcaggacaccggcaacgacuucggggaguacugccugagccacuccugccgcaucgagcgguuccccaucaaccccgccaucauccgcgacugccucugggaguaccacagccgcaagagcaaguacaucaccucccuggaccuggagaaccucgaggaguucaagcgggccaucagcgagaagcugucccacacccugaucguguacaacuucaagcccacggccaaccucccgcacaucaagcccgucuacaaguacaucaccgugcagggcguggagaacagcgacggcgucgacuccgcguacaucgccgccagcaugcccgcccuguccgggaccagcaucggcuacaacaucaugucccgggacaacuucccccuguucgacaucaucaucuucaucaagagcgccaucaucaaggcgaccuacaaccacaucuacgacacggggccgaccaucggcaucaacgugaugcacgacgagcacugcaccgggcagugccccaccgacaucccccacaaggagaacuggaucacguucgcccaggagcgcaccucccgguggggcugcgaggaguucggcugccucgccgugaacaccgggugcgucuucggcagcugccaggacaucauccgcccggagaccaagguguaccggaaggccguggaggaguccguccugcugaccgugugcaucacguaccccgggaagaccuucugcaccgagaucaacgccaucgagcccaagaucaccgacgagcucgagcugcaguucaagacgguggacaccaagacccugcccaacauccucgcgguccagaaccacaagcuguacagcggccagaucaacgaccugggguccuucagccagggcugcggcaacauccagcgcaccaacuccagcaucaucgggacgggcaccgccaaguucgacuacgugugccacggggccucccggaaggacaucaucgugcgccggugcuacaacaacaacuacgagagcugcaagcuccugaaggaggagcagagccugauguucgccgacaaccacgagaccaucgacgucgcgaacgugcgccaccuccugggcgaccugcaguucaagcucaugcugggggaccugcgguacaaguccuucgccgagaacccggaccucgagaucgaggccaagugcgugggcugccccagcugcuucaccuccuacagcugcuccuucaagaucgccagcaacaucgacacggucugcuccaucgagggccccugcaccaccuuccacaaccgccugaugaucaccagcacgaagcaggacuacgggaucaagauguccugcaagaccaagcccaaggagaccgaggaguuccagaucugcaagaagaccuacacggugcuguucaccaccguggagaagaacgacaagaucgagaucagcaccggcgaccagacguccuucauccaggagcgcgacgaccggugcaagaccuggcucugccgcguccgggacgaggggaucagcgugaucuucgagccgauccgcgccuucuucggcuccuacuucagcaucgcguucuacguggucaucuccaucaucgugcuguuccuggccaucuacaucuuccuccccaugguguucaagcugcgggacguccugaagcgcaacgaguaccucuaccugcaggagaucaagcacaaguga

SEQ ID NO: 12575 - RNA, 4305 nt, Artificial Sequence
  derived and/or modified CDS sequence (opt1) from NRIV(GSA/TS7/5170/WT)__KM514677.1__GP
augcugcuccugcuggugcuccugauccccugcuacgucagcgccuccccgguggugacccgcugcuuccacggcgggcagcugaucgccgagaagaagucccagaccgcggucuccgaguucugccucaaggacgacgugagcacgaucaaguccgagaucaccuacgagcggaacaacaccggccuguucgcccacagcaaggugcugcgcaacuggaucaucaaggacuggaagaacugcaaccccguccccaccgccgggggcuccaucaacgugaucgaggugaacacggaccucagccugaccaccaagaccuacgucugcucccgggacugcacgaucaccguggacaaggaggacgcccagaucaucuuccagaccgagaagcugaaccacuucgaggugagcgggaccacgcucuccagcggcugguucaagaccaaggccuccgucacccuggaccggaccugcgagcacaucaaggugacgugcggcaagaagacccugcaguuccacgcgugcuucaagcaccacaugagcugcauccgcuucuuccacgggaccauccuccccggcaccauggccacguccaucugccagaacaucgagcugaucaucaucaucagccugacccucaucaucuucauccugauggugauccugaccaagaccuacaucugcuaccuccugaugccgcuguucaugcccaucgccuacuucuacgggugguccuacaacaagagcugcaagaagugcuccugcugcggccucgccuaccaccccuucacgaacugcgggagccacugcgucugcggccugaaguucgaggcgagcgaccgcaugcggauccaccgcgaguccggccugugccagggguacaagagccuccggguggcccgccugcugugcaaguccaagggcagcucccucgugaucagcauccugcuguccaugcucauccugagcuucgucacccccaucgaggggacccugaccaacuacccggagucccggaaguacgaccucgaggagaucgccgacgugcuggagggcuucaucguggagaagggcaucaaggaguacgucguguucuacacgagcaucuucggggcccugcuccugcugauggcccucgugaucaccaucacccugaacaaggucaccgaguaccugacgaacaucaacgugcucuacugccacgagugcuccauguaccacagcaagaagaacaucaaguacaucggcgacuucaccaacaagugcggguucugcacgugcggcgagcuggaggaccaggaggggcugaagauccacaaggucucccgcaagugcaucuaccgguaccagcucaccuggagcaagaucaucaugaccauccuggugugccugcugaucgcgcagaacaccauccucaucguggccgccuccgacgacugcuggaccaagaagucccuggagauggagugcaucggcccccugcagcaggucgacacgugcgacgacaaggccagccgcagcuacuccggcgaggccaagaagcucgugcgggcgagcaagaucagcgaccuggacgccgcccagguggggcugcucggcuccaccaucgagagcgccaucgccuccauccgcaagcagcggaccuaccccaccaugcaccuccuggagagcgucuuccucgggaagcacugcgacuacuacaagaccuucgagcacaacuccggcuacagccaggcgaaguggcgccugaccgccaagacgcaccacuucgacaucugcucccggcacagcacccaccacuucugccgcugcaucuccgacgggaccaagugccagaacggcgacugggacuucgccagcgagaugaacuccaccuaccagagcaagaaggacuucuucgagcacgacuucaagcuguucugcacgcucguggagaacgccuuccccggcaccaccgagucccuguucuacgagaugcugagcaagaagaacaccacggggaucaagaaccuccuggacaagcugacccggaaguucggcaacaacaacauguucguggggaucuggaaguucggccaguaccucaucucccugccguacgucaacgagaccagccugacccccgcccagguguccaagauccucgaggugacggaccagcaccaccgcagcaucagcgggcgccaggagucccuggcgagcgccaccuccggcagcaaguccaaggagugcggccacgccaagaaggucagcugcaucagcccccgguucagcgugcccauggaggggcugauggccugcggcgacuccccgaacuacaagaucuacaagacccccgcgaagcucuacaagagcaacaacaagggggagguguggugcuccggcgacguccacugcagccaggagcugucccccgccagccaggaguccguggaccgcaucaagcagaucacgugcuuccugaccgagcccgaggugagcgacgacgucuucuccaucgccaucagcacgugcaaggugcaggacaagggcgugugcaccgucaacgaggaccgguggaacgugaucaagugcgacuccgggcucaucuacuacaccgaccagcgcgacggccaggacaccgggaacgacuucggcgaguacugccugagccacagcugccggaucgagcgcuucccgaucaaccccaccaucaucuccgacugccugugggaguaccacagccggaaguccaaguacaucaccagccucgaccuggagaaccuggaggaguucaagcgcgccaucuccgagaagcucagccacacccugaucguguacaacuucaagcccacggccaaccugccccacaucaagccggucuacaaguacaucaccgugcaggggguggagaacuccgacggcgucgacagcgcguacaucuccgccagcaugcccgcccucuccggcaccagcaucggguacaacaucaugucccgggacaacuucccccuguucgacaucaucaucuucaucaagagcgccaucaucaaggccaccuacaaccacaucuacgacacgggccccaccaucgggaucaacgugaugcacgacgagcacugcaccggccagugcccgaccgacaucccccacaaggagaacuggaucacguucgcgcaggagcgcaccucccggugggggugcgaggaguucggcugccuggccgugaacaccggcugcgucuucgggagcugccaggacaucauccgccccgagaccaagguguaccggaaggccguggaggaguccguccuccugaccgugugcaucacguacccgggcaagaccuucugcaccgagaucaacgccaucgagcccaagaucaccgacgagcuggagcuccaguucaagacgguggacaccaagacccugcccaacauccuggccguccagaaccacaagcucuacagcgggcagaucaacgaccugggcuccuucagccaggggugcggcaacauccagaagaccaacagcuccaucaucggcacggggaccgcgaaguucgacuacgugugccacggcgccagccgcaaggacaucaucgugcggcgcugcuacaacaacaacuacgaguccugcaagcugcucaaggaggagcagagccugauguucgccgacaaccacgagaccaucgacgucgccaacgugcggcaccuccugggggaccugcaguucaagcugaugcucggcgaccugcgcuacaaguccuucgcggagaaccccgaccuggagaucgaggccaagugcguggggugcccgagcugcuucaccuccuacagcugcuccuucaagaucgccagcaacaucgacacggucugcuccaucgagggccccugcaccaccuuccacaaccggcucaugaucaccagcacgaagcaggacuacggcaucaagauguccugcaagaccaagcccaaggagaccgaggaguuccagaucugcaagaagaccuacacggugcuguucaccaccguggagaagaacgacaagaucgagaucagcaccggggaccagacguccuucauccaggagcgcgacgaccgcugcaagaccuggcugugccggguccgcgacgagggcaucagcgugaucuucgagcccauccgggccuucuucggguccuacuucagcaucgccuucuacguggucgugaucaucaucgugcuguuccuggcgaucuacaucuuccugccgauggucuucaagcuccgcgacgugcugaagcggaacgaguaccuguaccuccaggagaucaagcacaaguga

SEQ ID NO: 12576 - RNA, 4305 nt, Artificial Sequence
  derived and/or modified CDS sequence (opt1) from NRIV(TND/S1/19801/WT)__KM514679.1__GP
augcugcuccugcuggugcuccugauccccugcuacgucagcgccuccccgguggugacccgcugcuuccacggcgggcagcugaucgccgagaagaagucccagaccgcggucuccgaguucugccucaaggacgacgugagcacgaucaaguccgagaucaccuacgagcggaacaacaccggccuguucgcccacagcaaggugcugcgcaacuggaucaucaaggacuggaagaacugcaaccccguccccaccgccgggggcuccaucaacgugaucgaggugaacacggaccucagccugaccaccaagaccuacgucugcucccgggacugcacgaucaccguggacaaggaggacgcccagaucaucuuccagaccgagaagcugaaccacuucgaggugagcgggaccacgcucuccagcggcugguucaagaccaaggccuccgucacccuggaccggaccugcgagcacaucaaggugacgugcggcaagaagacccugcaguuccacgcgugcuucaagcaccacaugagcugcauccgcuucuuccacgggaccauccuccccggcaccauggccacguccaucugccagaacaucgagcugaucaucaucaucagccugacccucaucaucuucauccugauggugauccugaccaagaccuacaucugcuaccuccugaugccgcuguucaugcccaucgccuacuucuacgggugguccuacaacaagagcugcaagaagugcuccugcugcggccucgccuaccaccccuucacgaacugcgggagccacugcgucugcggccugaaguucgaggcgagcgaccgcaugcggauccaccgcgaguccggccugugccagggguacaagagccuccggguggcccgccugcugugcaaguccaagggcagcucccucgugaucagcauccugcuguccaugcucauccugagcuucgucacccccaucgaggggacccugaccaacuacccggagucccggaaguacgaccucgaggagaucgccgacgugcuggagggcuucaucguggagaagggcaucaaggaguacgucguguucuacacgagcaucuucggggcccugcuccugcugauggcccucgugaucaccaucacccugaacaaggucaccgaguaccugacgaacaucaacgugcucuacugccacgagugcuccauguaccacagcaagaagaacaucaaguacaucggcgacuucaccaacaagugcggguucugcacgugcggcgagcuggaggaccaggaggggcugaagauccacaaggucucccgcaagugcaucuaccgguaccagcucaccuggagcaagaucaucaugaccauccuggugugccugcugaucgcgcagaacaccauccucaucguggccgccuccgacgacugcuggaccaagaagucccuggagauggagugcaucggcccccugcagcaggucgacacgugcgacgacaaggccagccgcagcuacuccggcgaggccaagaagcucgugcgggcgagcaagaucagcgaccuggacgccgcccagguggggcugcucggcuccaccaucgagagcgccaucgccuccauccgcaagcagcggaccuaccccaccaugcaccuccuggagagcgucuuccucgggaagcacugcgacuacuacaagaccuucgagcacaacuccggcuacagccaggcgaaguggcgccugaccgccaagacgcaccacuucgacaucugcucccggcacagcacccaccacuucugccgcugcaucuccgacgggaccaagugccagaacggcgacugggacuucgccagcgagaugaacuccaccuaccagagcaagaaggacuucuucgagcacgacuucaagcuguucugcacgcucguggagaacgccuuccccggcaccaccgagucccuguucuacgagaugcugagcaagaagaacaccacggggaucaagaaccuccuggacaagcugacccggaaguucggcaacaacaacauguucguggggaucuggaaguucggccaguaccucaucucccugccguacgucaacgagaccagccugacccccgcccagguguccaagauccucgaggugacggaccagcaccaccgcagcaucagcgggcgccaggagucccuggcgagcgccaccuccggcagcaaguccaaggagugcggccacgccaagaaggucagcugcaucagcccccgguucagcgugcccauggaggggcugauggccugcggcgacuccccgaacuacaagaucuacaagacccccgcgaagcucuacaagagcaacaacaagggggagguguggugcuccggcgacguccacugcagccaggagcugucccccgccagccaggaguccguggaccgcaucaagcagaucacgugcuuccugaccgagcccgaggugagcgacgacgucuucuccaucgccaucagcacgugcaaggugcaggacaagggcgugugcaccgucaacgaggaccgguggaacgugaucaagugcgacuccgggcucaucuacuacaccgaccagcgcgacggccaggacaccgccaacgacuucggggaguacugccugagccacagcugccggaucgagcgcuucccgaucaaccccaccaucaucuccgacugccugugggaguaccacagccggaaguccaaguacaucaccagccucgaccuggagaaccuggaggaguucaagcgcgccaucuccgagaagcucagccacacccugaucguguacaacuucaagcccacggcgaaccugccccacaucaagccggucuacaaguacaucaccgugcagggcguggagaacuccgacggggucgacagcgccuacaucuccgccagcaugcccgcccucuccggcaccagcaucggcuacaacaucaugucccgggacaacuucccccuguucgacaucaucaucuucaucaagagcgccaucaucaaggcgaccuacaaccacaucuacgacacggggcccaccaucggcaucaacgugaugcacgacgagcacugcaccgggcagugcccgaccgacaucccccacaaggagaacuggaucacguucgcccaggagcgcaccucccgguggggcugcgaggaguucgggugccuggccgugaacaccggcugcgucuucggcagcugccaggacaucauccgccccgagaccaagguguaccggaaggccguggaggaguccguccuccugaccgugugcaucacguacccggggaagaccuucugcaccgagaucaacgccaucgagcccaagaucaccgacgagcuggagcuccaguucaagacgguggacaccaagacccugcccaacauccuggcgguccagaaccacaagcucuacagcggccagaucaacgaccugggguccuucagccagggcugcgggaacauccagaagaccaacagcuccaucaucggcacgggcaccgccaaguucgacuacgugugccacggggccagccgcaaggacaucaucgugcggcgcugcuacaacaacaacuacgaguccugcaagcugcucaaggaggagcagagccugauguucgccgacaaccacgagaccaucgacgucgcgaacgugcggcaccuccugggcgaccugcaguucaagcugaugcucggggaccugcgcuacaaguccuucgccgagaaccccgaccuggagaucgaggccaagugcgugggcugcccgagcugcuucaccuccuacagcugcuccuucaagaucgccagcaacaucgacacggucugcuccaucgaggggcccugcaccaccuuccacaaccggcucaugaucaccagcacgaagcaggacuacggcaucaagauguccugcaagaccaagcccaaggagaccgaggaguuccagaucugcaagaagaccuacacggugcuguucaccaccguggagaagaacgacaagaucgagaucagcaccggcgaccagacguccuucauccaggagcgcgacgaccgcugcaagaccuggcugugccggguccgcgacgaggggaucagcgugaucuucgagcccauccgggccuucuucggcuccuacuucagcaucgcguucuacguggucgugaucaucaucgugcuguuccuggccaucuacaucuuccugccgauggucuucaagcuccgcgacgugcugaagcggaacgaguaccuguaccuccaggagaucaagcacaaguga

SEQ ID NO: 12577 - RNA, 4305 nt, Artificial Sequence
  derived and/or modified CDS sequence (opt1) from NRIV(9800521)__JX857326.1__GP
augcugcuccugcuggugcuccugauccccugcuacgucagcgccuccccgguggugacccgcugcuuccacggcgggcagcugaucgccgagaagaagucccagaccgcggucuccgaguucugccucaaggacgacgugagcacgaucaaguccgagaucaccuacgagaagaacaacaccggccuguucgcccacagcaaggugcugcggaacuggaucaucaaggacuggaagaacugcaaccccguccccaccgccgggggcuccaucaacgugaucgaggugaacacggaccucagccugaccaccaagaccuacgucugcucccgcgacugcacgaucaccguggacaaggaggacgcccagaucaucuuccagaccgagaagcugaaccacuucgaggugagcgggaccacgcucuccagcggcugguucaagaccaaggccuccgucacccuggaccggaccugcgagcacaucaaggugacgugcggcaagaagacccugcaguuccacgcgugcuucaagcaccacaugagcugcauccgcuucuuccacgggaccauccuccccggcaccauggccacguccaucugccagaacaucgagcugaucaucaucaucagccugacccucaucaucuucauccugaugaucauccugaccaagaccuacaucugcuaccuccugaugccgcuguucaugcccaucgccuacuucuacgggugguccuacaacaagagcugcaagaagugcuccugcugcggccucgccuaccaccccuucacgaacugcgggagccacugcgugugcggccugaaguucgaggcgagcgaccggaugcgcauccaccgggaguccggccugugccagggguacaagagccuccgcgucgcccggcugcugugcaaguccaagggcagcucccucgugaucagcauccugcuguccaugcucauccugagcuucgugacccccaucgaggggacccugaccaacuacccggagucccgcaaguacgaccucgaggagaucgccgacguccuggagggcuucaucguggagaagggcaucaaggaguacguggucuucuacacgagcaucuucggggcccugcuccugcugauggcccucgugaucaccaucacccugaacaaggugaccgaguaccugacgaacaucaacguccucuacugccacgagugcuccauguaccacagcaagaagaacaucaaguacaucggcgacuucaccaacaagugcggguucugcacgugcggcgagcuggaggaccaggaggggcugaagauccacaaggugucccggaagugcaucuacaaguaccagcucaccuggagcaagaucaucaugaccauccuggucugccugcugaucgcgcagaacaccauccucaucguggccgccuccgacgacugcuggaccaagaagucccuggagauggagugcaucggcccccugcagcaggucgacacgugcgacgacaaggccagccgcagcuacuccggcgaggcccggaagcucgugcgcgcgagcaagaucagcgaccuggacgccgcccagguggggcugcucggcuccaccaucgagagcgccaucgccuccauccggaagcagcgcaccuaccccaccaugcaccuccuggagagcguguuccucgggaagcacugcgacuacuacaagaccuucgagcacaacuccggcuacagccaggcgaaguggcggcugaccgccaagacgcaccacuucgacaucugcucccgccacagcacccaccacuucugccggugcaucuccgacgggaccaagugccagaacggcgacugggacuucgccggcgagaugaacagcaccuaccaguccaagaaggacuucuucgagcacgacuucaagcuguucugcacgcucgucgagaacgccuuccccgggaccaccgagagccuguucuacgagaugcuguccaagaagaacaccacgggcaucaagcagcuccuggacaagcugacccgcaaguucgggaacaacaacauguucgugggcaucuggaaguucgggcaguaccucaugagccugccguacgugaacgaggccucccugacccccgcgcagaucagcaagauccucgaggucaccgaccagcaccaccgguccaucagcggccgccaggagagccuggccuccgccacgcccggcagcaaguccaaggagugcgggcacgccaagaaggugagcugcaucagcccccgcuucagcgugccgauggagggccugauggcgugcggggacucccccaacuacaagaucuacaagacccccaccaagcucuacaagagcaacaacaagggcgaggucuggugcuccggcgacgugcacugcagccaggagcugucccccgccagccaggaguccguggaccggaucaagcagaucacgugcuuccugaccgagccggaggucagcgacgacguguucuccaucgccaucagcacgugcaaggugcaggacaagggggucugcaccgugaacgaggaccgcuggaacgugaucaagugcgacuccggccucaucuacuacaccgaccagcgggacgggcaggacaccggcaacgacuucggggaguacugccugagccacuccugccgcaucgagcgguuccccaucaaccccgccaucauccgcgacugccugugggaguaccacagccgcaagagcaaguacaucaccucccucgaccuggagaaccuggaggaguucaagcgggccaucagcgagaagcucucccacacccugaucgucuacaacuucaagcccaccgcgaaccugccgcacaucaagcccguguacaaguacaucacggugcagggcgucgagaacagcgacggcguggacuccgccuacaucgccgccagcaugcccgcccucuccgggaccagcaucggcuacaacaucaugucccgggacaacuucccccuguucgacaucaucaucuucaucaagagcgcgaucaucaaggccaccuacaaccacaucuacgacaccgggccgacgaucggcaucaacgugaugcacgacgagcacugcaccgggcagugccccaccgacaucccccacaaggagaacuggaucaccuucgcccaggagcgcacgucccgguggggcugcgaggaguucggcugccuggccgucaacaccgggugcguguucggcagcugccaggacaucauccgcccggagaccaagguguaccggaaggccgucgaggaguccgugcuccugaccgugugcaucaccuaccccgggaagacguucugcaccgagaucaacgcgaucgagcccaagaucaccgacgagcuggagcuccaguucaagaccgucgacacgaagacccugcccaacauccuggccgugcagaaccacaagcucuacagcggccagaucaacgaccugggguccuucagccagggcugcggcaacauccagcgcaccaacuccagcaucaucgggaccggcacggccaaguucgacuacgugugccacggggccucccggaaggacaucaucguccgccggugcuacaacaacaacuacgagagcugcaagcugcucaaggaggagcagagccugauguucgcggacaaccacgagaccaucgacguggccaacgugcgccaccuccugggcgaccugcaguucaagcugaugcucggggaccugcgguacaaguccuucgccgagaacccggaccuggagaucgaggccaagugcgucggcugccccagcugcuucaccuccuacagcugcuccuucaagaucgccaccaacaucgacacggugugcagcaucgagggccccugcaccaccuuccacaaccgccucaugaucaccuccacgaagcaggacuacgggaucaagaugagcugcaagaccaagcccaaggagaccgaggaguuccagaucugcaagaagaccuacacggugcuguucaccaccgucgagaagaacgacaagaucgagaucuccaccggcgaccagacgagcuucauccaggagcgcgacgaccggugcaagaccuggcugugccgcgugcgggacgaggggaucuccgugaucuucgagccgauccgcgcguucuucggcagcuacuucuccaucgccuucuacgucgugaucagcaucaucgugcuguuccuggccaucuacaucuuccugcccauggucuucaagcuccgggacgugcugaagcgcaacgaguaccuguaccuccaggagaucaagcacaaguga

SEQ ID NO: 12578 - RNA, 4305 nt, Artificial Sequence
  derived and/or modified CDS sequence (opt1) from NRIV(Adrar)__KJ716849.1__GP
augcugcuccugcuggugcuccugauccccugcuacgucagcgccuccccgguggugacccgcugcuuccacggcgggcagcugaucgccgagaagaagucccagaccgcggucuccgaguucugccucaaggacgacgugagcacgaucaaguccgagaucaccuacgagaagaacaacaccggccuguucgcccacagcaaggugcugcggaacuggaucaucaaggacuggaagaacugcaaccccguccccaccgccgggggcuccaucaacgugaucgaggugaacacggaccucagccugaccaccaagaccuacgucugcucccgcgacugcacgaucaccguggacaaggaggacgcccagaucaucuuccagaccgagaagcugaaccacuucgaggugagcgggaccacgcucuccagcggcugguucaagaccaaggccuccgucacccuggaccggaccugcgagcacaucaaggugacgugcggcaagaagacccugcaguuccacgcgugcuucaagcaccacaugagcugcauccgcuucuuccacgggaccauccuccccggcaccauggccacguccaucugccagaacaucgagcugaucaucaucaucagccugacccucaucaucuucauccugauggugauccugaccaagaccuacaucugcuaccuccugaugccgcuguucaugcccaucgccuacuucuacgggugguccuacaacaagagcugcaagaagugcuccugcugcggccucgccuaccaccccuucacgaacugcgggagccacugcgucugcggccugaaguucgaggcgagcgaccggaugcgcauccaccgggaguccggccugugccagggguacaagagccuccgcguggcccggcugcugugcaaguccaagggcagcucccucgugaucagcauccugcuguccaugcucauccugagcuucgucacccccaucgaggggacccugaccaacuacccggagucccgcaaguacgaccucgaggagaucgccgacgugcuggagggcuucaucguggagaagggcaucaaggaguacgucguguucuacacgagcaucuucggggcccugcuccugcugauggcccucgugaucaccaucacccugaacaaggucaccgaguaccugacgaacaucaacgugcucuacugccacgagugcuccauguaccacagcaagaagaacaucaaguacaucggcgacuucaccaacaagugcggguucugcacgugcggcgagcuggaggaccaggaggggcugaagauccacaaggucucccggaagugcaucuacaaguaccagcucaccuggagcaagaucaucaugaccauccuggugugccugcugaucgcgcagaacaccauccucaucguggccgccuccgacgacugcuggaccaagaagucccuggagauggagugcaucggcccccugcagcaggucgacacgugcgacgacaaggccagccgcagcuacuccggcgaggccaagaagcucgugcgggcgagcaagaucagcgaccuggacgccgcccagguggggcugcucggcuccaccaucgagagcgccaucgccuccauccgcaagcagcggaccuaccccaccaugcaccuccuggagagcgucuuccuggggaagcacugcgacuacuacaagaccuucgagcacaacuccggcuacagccaggcgaaguggcgccugaccgccaagacgcaccacuucgacaucugcucccggcacagcacccaccacuucugccgcugcaucuccgacgggaccaagugccagaacggcgacugggacuucgccggcgagaugaacagcaccuaccaguccaagaaggacuucuucgagcacgacuucaagcuguucugcacgcucguggagaacgccuuccccgggaccaccgagagccuguucuacgagaugcuguccaagaagaacaccacgggcaucaagaagcuccuggacaagcugacccggaaguucgggaacaacaacauguucgugggcaucuggaaguucgggcaguaccucaucagccugccguacgucaacgagaccucccugacccccgcccaggugagcaagauccucgaggugacggaccagcaccaccgcuccaucagcggccggcaggagagccuggcguccgccacccccggcagcaaguccaaggagugcgggcacgccaagaaggucagcugcaucagcccccgcuucagcgugccgauggagggccugauggccugcggggacucccccaacuacaagaucuacaagacccccgcgaagcucuacaagagcaacaacaagggcgagguguggugcuccggcgacguccacugcagccaggagcugucccccgccagccaggaguccguggaccgcaucaagcagaucacgugcuuccugaccgagccggaggugagcgacgacgucuucuccaucgccaucagcacgugcaaggugcaggacaagggggugugcaccgucaacgaggaccgguggaacgugaucaagugcgacuccggccucaucuacuacaccgaccagcgcgaggggcaggacaccggcaacgacuucggggaguacugccugagccacuccugccggaucgagcgcuuccccaucaaccccgccaucaucagcgacugccugugggaguaccacagccggaaguccaaguacaucaccagccucgaccuggagaaccuggaggaguucaagcgcgccaucuccgagaagcucagccacacccugaucguguacaacuucaagcccaccgcgaaccugccgcacaucaagcccaucuacaaguacaucacgguccagggcguggagaacuccgacggcguggacagcgccuacaucgccgccuccaugcccgcccucagcgggaccuccaucggcuacaacaucaugagccgggacaacuucccccuguucgacaucaucaucuucaucaaguccgcgaucaucaaggccaccuacaaccacaucuacgacaccgggccgacgaucggcaucaacgucaugcacgacgagcacugcaccgggcagugccccaccgacaucccccacaaggagaacuggaucaccuucgcccaggagcgcacgagccgguggggcugcgaggaguucggcugccuggccgugaacaccgggugcguguucggcuccugccaggacaucauccgcagcgagaccaaggucuaccggaaggccguggaggaguccgugcuccugaccgucugcaucaccuacccggggaagacguucugcaccgagaucaacgcgaucgagcccaagaucaccgacgagcuggagcuccaguucaagaccguggacacgaagacccugcccaacauccuggccgugcagaaccacaagcucuacagcggccagaucaacgaccugggguccuucagccagggcugcggcaacauccagaagaccaaccuguccaucaucgggaccggcacggccaaguucgacuacgucugccacggggccagccgcaaggacaucaucgugcggcgcugcuacaacaacaacuacgagagcugcaagcuccugaaggaggagcagucccugauguucgcggacaaccacgagaccaucgacguggccaacguccggcaccuccugggcgaccugcaguucaagcucaugcugggggaccugcgcuacaagagcuucgccgagaaccccgaccucgagaucgaggccaagugcgugggcugcccguccugcuucaccagcuacuccugcagcuucaagaucgccuccaacaucgacaccgugugcagcaucgagggccccugcacgaccuuccacaaccggcugaugaucaccuccaccaagcaggacuacgggaucaagaugagcugcaagacgaagcccaaggagaccgaggaguuccagaucugcaagaagaccuacaccguccuguucacgaccguggagaagaacgacaagaucgagaucuccaccggcgaccagaccagcuucauccaggagaaggacgaccgcugcaagacguggcucugccgggugcgcgacgaggggaucuccgucaucuucgagcccauccgcgcguucuucggcagcuacuucuccaucgccuucuacguggugaucagcaucaucguccuguuccuggccaucuacaucuuccucccgaugguguucaagcugcgggacgugcugaagcgcaacgaguaccucuaccugcaggagaucaagcacaaguga

SEQ ID NO: 12579 - RNA, 4305 nt, Artificial Sequence
  derived and/or modified CDS sequence (opt1) from NRIV(DakArD28542)__JX857317.1__GP
augcugcuccugcuggugcuccugauccccugcuacgucagcgccuccccgguggugacccgcugcuuccacggcgggcagcugaucgccgagaagaagucccagaccgcggucuccgaguucugccucaaggacgacgugagcacgaucaaguccgagaucaccuacgagaagaacaacaccggccuguucgcccacagcaaggugcugcggaacuggaucaucaaggacuggaagaacugcaaccccguccccaccgccgggggcuccaucaacgugaucgaggugaacacggaccucagccugaccaccaagaccuacgucugcucccgcgacugcacgaucaccguggacaaggaggacgcccagaucaucuuccagaccgagaagcugaaccacuucgaggugagcgggaccacgcucuccagcggcugguucaagaccaaggccuccgucacccuggaccggaccugcgagcacaucaaggugacgugcggcaagaagacccugcaguuccacgcgugcuucaagcaccacaugagcugcauccgcuucuuccacgggaccauccuccccggcaccauggccacguccaucugccagaacaucgagcugaucaucaucaucagccugacccucaucaucuucauccugauggugauccugaccaagaccuacaucugcuaccuccugaugccgcuguucaugcccaucgccuacuucuacgggugguccuacaacaagagcugcaagaagugcuccugcugcggccucgccuaccaccccuucacgaacugcgggagccacugcgucugcggccugaaguucgaggcgagcgaccggaugcgcauccaccgggaguccggccugugccagggguacaagagccuccgcguggcccggcugcugugcaaguccaagggcagcucccucaucaucagcauccugcuguccaugcucauccugagcuucgugacccccaucgaggggacccugaccaacuacccggagucccgcaaguacgaccucgaggagaucgccgacguccuggagggcuucaucguggagaagggcaucaaggaguacguggucuucuacacgagcaucuucggggcccuguuccuccugauggcccuggugaucaccaucacccucaacaaggugaccgaguaccugacgaacaucaacguccuguacugccacgagugcuccauguaccacagcaagaagaacaucaaguacaucggcgacuucaccaacaagugcggguucugcacgugcggcgagcucgaggaccaggaggggcugaagauccacaaggugucccggaagugcaucuacaaguaccagcugaccuggagcaagaucaucaugaccauccucgucugccugcugaucgcgcagaacaccauccugaucguggccgccuccgacgacugcuggaccaagaagucccucgagauggagugcaucggcccccugcagcaggucgacacgugcgacgacaaggccagccgcagcuacuccggcgaggccaagaagcuggugcgggcgagcaagaucagcgaccucgacgccgcccagguggggcugcugggccccaccaucgaguccgccaucgccagcauccgcaagcagcggaccuacuccaccaugcaccuccuggagagcguguuccuggggaagcacugcgacuacuacaagaccuucgagcacaacuccggcuacagccaggcgaaguggcgccucaccgccaagacgcaccacuucgacaucugcucccggcacagcacccaccacuucugccgcugcaucuccgacgggaccaagugccagaacggcgacugggacuucgccggcgagaugaacagcaccuaccaguccaagaaggacuucuucgagcacgaccugaagcuguucugcacgcucgucgagaacgccuuccccgggaccaccgagagccuguucuacgagaugcuguccaagaagaacaccacgggcgugaagaagcuccuggacaagcugacccggaaguucgggaacaacaacauguucgugggcaucuggaaguucgggcaguaccucaugagccugccguacgucaacgagaccucccugacccccgcccagguggcgaagauccucgaggugacggaccagcaccaccgcagcaucuccggccggcaggagagccuggccagcgccacccccggcuccaagagcaaggagugcucccacgccaagaaggucagcugcaucagcccccgcuucagcgugccgauggaggggcugauggcgugcggcgacucccccaacuacaagaucuacaagacccccgccaagcucuacaagagcaacaacaagggggagguguggugcuccggcgacguccacugcagccaggagcugucccccgccagccaggaguccguggaccgcaucaagcagaucacgugcuuccugaccgagccggaggugagcgacgacgucuucuccaucgccaucagcacgugcaaggugcaggacaagggcgugugcaccgucaacgaggaccgguggaacgugaucaagugcgacuccgggcucaucuacuacaccgaccagcgcgacggccaggacaccgggaacgacuucggcgaguacugccugagccacuccugccggaucgagcgcuuccccaucaaccccgccaucaucagcgacugccugugggaguaccacagccggaaguccaaguacaucaccagccucgaccuggagaaccuggaggaguucaagcgcgcgaucuccgagaagcucagccacacccugaucguguacaacuucaagcccaccgccaaccugccgcacaucaagcccgucuacaaguacaucacggugcaggggguggagaacuccgacggcgucgacagcgccuacaucgccgccuccaugcccgcgcucagcggcaccuccaucggguacaacaucaugagccgggacaacuucccccuguucgacaucaucaucuucaucaaguccgccaucaucaaggccaccuacaaccacaucuacgacaccggcccgacgaucgggaucaacgugaugcacgacgagcacugcaccggccagugccccaccgacaucccccacaaggagaacuggaucaccuucgcccaggagcgcacgagccggugggggugcgaggaguucggcugccuggccgugaacaccggcugcgucuucggguccugccaggacaucauccgcccggagaccaagguguaccggaaggcgguggaggagagcguccuccugaccgugugcaucaccuaccccggcaagacguucugcaccgagaucaacgccaucgagcccaagaucaccgacgagcuggagcuccaguucaagaccguggacacgaagacccugcccaacauccuggccguccagaaccacaagcucuacuccgggcagaucaacgaccugggcagcuucucccaggggugcggcaacauccagaagaccaacagcuccaucaucggcaccgggacggccaaguucgacuacgugugccacggcgcgagccgcaaggacaucaucgugcggcgcugcuacaacaacaacuacgagagcugcaagcugcucaaggaggagcagucccugauguucgccgacaaccacgagaccaucgacgucgccaacgugcggcaccuccucggggaccugcaguucaagcugaugcucggcgaccugcgcuacaagagcuucgccgagaacccggaccuggagaucgaggccaagugcguggggugccccuccugcuucaccagcuacuccugcagcuucaagaucgcguccaacaucgacaccgucugcagcaucgagggccccugcacgaccuuccacaaccggcucaugaucaccuccaccaagcaggacuacggcaucaagaugagcugcaagacgaagcccaaggagaccgaggaguuccagaucugcaagaagaccuacaccgugcuguucacgaccguggagaagaacgacaagaucgagaucuccaccggggaccagaccagcuucauccaggagcgcgacgaccggugcaagacguggcugugccgcguccgcgacgagggcaucuccgugaucuucgagccgauccgggccuucuucgggagcuacuucuccaucgccuucuacguggucgugagcaucaucgugcuguuccuggccaucuacaucuuccugcccauggucuucaagcuccgcgacgugcugaagcggaacgaguaccuguaccuccaggagaucaagcacaaguga

SEQ ID NO: 12580 - RNA, 4305 nt, Artificial Sequence
  derived and/or modified CDS sequence (opt1) from NRIV(SUD-HKV141)__JX857323.1__GP
augcugcuccugcuggugcuccugauccccugcuacgucagcgccuccccgguggugacccgcugcuuccacggcgggcagcugaucgccgagaagaagucccagaccgcggucagcgaguucugccucaaggacgacgugagcacgaucaaguccgagaucaccuacgagaagaacaacaccggccuguucgcccacagcaaggugcugcggaacuggaucaucaaggacuggaagaacugcaaccccguccccaccgccgggggcuccaucaacgugaucgaggugaacacggaccucagccugaccaccaagaccuacgucugcucccgcgacugcacgaucaccguggacaaggaggacgcccagaucaucuuccagaccgagaagcugaaccacuucgaggugagcgggaccacgcucuccagcggcugguucaagaccaaggccuccgucacccuggaccggaccugcgagcacaucaaggugacgugcggcaagaagacccugcaguuccacgcgugcuucaagcaccacaugagcugcauccgcuucuuccacgggaccauccuccccggcaccauggccacguccaucugccagaacaucgagcugaucaucaucaucagccugacccucaucaucuucauccugauggugauccugaccaagaccuacaucugcuaccuccugaugccgcuguucaugcccaucgccuacuucuacgggugguccuacaacaagagcugcaagaagugcuccugcugcggccucgccuaccaccccuucacgaacugcgggagccacugcgucugcggccugaaguucgaggcgagcgaccggaugcgcauccaccgggaguccggccugugccagggguacaagagccuccgcguggcccggcugcugugcaaguccaagggcagcucccucaucaucagcauccugcuguccaugcucauccugagcuucgugacccccaucgaggggacccugaccaacuacccggagucccgcaaguacgaccucgaggagaucgccgacguccuggagggcuucaucguggagaagggcaucaaggaguacguggucuucuacacgagcaucuucggggcccuguuccuccugauggcccuggugaucaccaucacccucaacaaggugaccgaguaccugacgaacaucaacguccuguacugccacgagugcuccauguaccacagcaagaagaacaucaaguacaucggcgacuucaccaacaagugcggguucugcacgugcggcgagcucgaggaccaggaggggcugaagauccacaaggugucccggaagugcaucuacaaguaccagcugaccuggagcaagaucaucaugaccauccucgucugccugcugaucgcgcagaacaccauccugaucguggccgccuccgacgacugcuggaccaagaagucccucgagauggagugcaucggcccccugcagcaggucgacacgugcgacgacaaggccagccgcagcuacuccggcgaggccaagaagcuggugcgggcgagcaagaucagcgaccucgacgccgcccagguggggcugcugggccccaccaucgaguccgccaucgccagcauccgcaagcagcggaccuacuccaccaugcaccuccuggagagcguguuccuggggaagcacugcgacuacuacaagaccuucgagcacaacuccggcuacagccaggcgaaguggcgccucaccgccaagacgcaccacuucgacaucugcucccggcacagcacccaccacuucugccgcugcaucuccgacgggaccaagugccagaacggcgacugggacuucgccggcgagaugaacagcaccuaccaguccaagaaggacuucuucgagcacgaccugaagcuguucugcacgcucgucgagaacgccuuccccgggaccaccgagagccuguucuacgagaugcuguccaagaagaacaccacgggcgugaagaagcuccuggacaagcugacccggaaguucgggaacaacaacauguucgugggcaucuggaaguucgggcaguaccucaugagccugccguacgucaacgagaccucccugacccccgcccagguggcgaagauccucgaggugacggaccagcaccaccgcagcaucuccggccggcaggagagccuggccagcgccacccccggcuccaagagcaaggagugcgggcacgccaagaaggucuccugcaucagcccccgcuucuccgugccgauggagggccugauggcgugcggggacagccccaacuacaagaucuacaagacccccgccaagcucuacaaguccaacaacaagggcgagguguggugcagcggcgacguccacugcucccaggagcugacccccgccagccaggaguccguggaccgcaucaagcagaucacgugcuuccugaccgagccggaggugagcgacgacgucuucuccaucgccaucagcacgugcaaggugcaggacaagggggugugcaccgucaacgaggaccgguggaacgugaucaagugcgacuccggccucaucuacuacaccgaccagcgcgacgggcaggacaccggcaacgacuucggggaguacugccugagccacuccugccggaucgagcgcuuccccaucaaccccgccaucaucagcgacugccugugggaguaccacucccgcaagagcaaguacaucaccagccucgaccuggagaaccuggaggaguucaagcgggcgaucuccgagaagcucagccacacccugaucguguacaacuucaagcccacggccaaccugccgcacaucaagcccgucuacaaguacaucaccgugcagggcguggagaacuccgacggcgucgacagcgccuacaucgccgccuccaugcccgcgcucagcgggaccuccaucggcuacaacaucaugagccgggacaacuucccccuguucgacaucaucaucuucaucaaguccgccaucaucaaggccaccuacaaccacaucuacgacacggggccgaccaucggcaucaacgugaugcacgacgagcacugcaccgggcagugccccaccgacaucccccacaaggagaacuggaucacguucgcccaggagcgcaccagccgguggggcugcgaggaguucggcugccuggccgugaacaccgggugcgucuucggcuccugccaggacaucauccgcccggagaccaagguguaccggaaggcgguggaggagagcguccuccugaccgugugcaucacguaccccgggaagaccuucugcaccgagaucaacgccaucgagcccaagaucaccgacgagcuggagcuccaguucaagacgguggacaccaagacccugcccaacauccuggccguccagaaccacaagcucuacuccggccagaucaacgaccuggggagcuucucccagggcugcggcaacauccagaagaccaacagcuccaucaucgggacgggcaccgccaaguucgacuacgugugccacggggcgagccgcaaggacaucaucgugcggcgcugcuacaacaacaacuacgaguccugcaagcugcucaaggaggagcagagccugauguucgccgacaaccacgagaccaucgacgucgccaacgugcggcaccuccugggcgaccugcaguucaagcugaugcucggggaccugcgcuacaagagcuucgccgagaacccggaccuggagaucgaggccaagugcgugggcugccccuccugcuucaccagcuacuccugcagcuucaagaucgucuccaacaucgacacggugugcagcaucgagggccccugcaccaccuuccacaaccggcucaugaucaccuccacgaagcaggacuacgggaucaagaugagcugcaagaccaagcccaaggagaccgaggaguuccagaucugcaagaagaccuacacggugcuguucaccaccgucgagaagaacgacaagaucgagaucuccaccggcgaccagacgagcuucauccaggagcgcgacgaccggugcaagaccuggcugugccgcgugcgcgacgaggggaucuccgugaucuucgagccgauccgggcguucuucggcagcuacuucuccaucgccuucuacgucguggugagcaucaucguccucuuccuggccaucuacaucuuccugcccaugguguucaagcuccgcgacguccugaagcggaacgaguaccuguaccuccaggagaucaagcacaaguga

SEQ ID NO: 12581 - RNA, 4305 nt, Artificial Sequence
  derived and/or modified CDS sequence (opt1) from NRIV(SUD-HKV66)__JX857320.1__GP
augcugcuccugcuggugcuccugauccccugcuacgucagcgccuccccgguggugacccgcugcuuccacggcgggcagcugaucgccgagaagaagucccagaccgcggucuccgaguucugccucaaggacgacgugagcacgaucaaguccgagaucaccuacgagaagaacaacaccggccuguucgcccacagcaaggugcugcggaacuggaucaucaaggacuggaagaacugcaaccccguccccaccgccgggggcuccaucaacgugaucgaggugaacacggaccucagccugaccaccaagaccuacgucugcucccgcgacugcacgaucaccguggacaaggaggacgcccagaucaucuuccagaccgagaagcugaaccacuucgaggugagcgggaccacgcucuccagcggcugguucaagaccaaggccuccgucacccuggaccggaccugcgagcacaucaaggugacgugcggcaagaagacccugcaguuccacgcgugcuucaagcaccacaugagcugcauccgcuucuuccacgggaccauccuccccggcaccauggccacguccaucugccagaacaucgagcugaucaucaucaucagccugacccucaucaucuucauccugauggugauccugaccaagaccuacaucugcuaccuccugaugccgcuguucaugcccaucgccuacuucuacgggugguccuacaacaagagcugcaagaagugcuccugcugcggccucgccuaccaccccuucacgaacugcgggagccacugcgucugcggccugaaguucgaggcgagcgaccggaugcgcauccaccgggaguccggccugugccagggguacaagagccuccgcguggcccggcugcugugcaaguccaagggcagcucccucaucaucagcauccugcuggccaugcucauccuguccuucgugacccccaucgaggggacccugaccaacuacccggagagccgcaaguacgaccucgaggagaucgccgacguccuggagggcuucaucguggagaagggcaucaaggaguacguggucuucuacacguccaucuucggggcccuguuccuccugauggcgcuggugaucaccaucacccucaacaaggugaccgaguaccugacgaacaucaacguccuguacugccacgagugcagcauguaccacuccaagaagaacaucaaguacaucggcgacuucaccaacaagugcggguucugcacgugcggcgagcucgaggaccaggaggggcugaagauccacaaggugagccggaagugcaucuacaaguaccagcugaccugguccaagaucaucaugaccauccucgucugccugcugaucgcccagaacaccauccugaucguggccgccagcgacgacugcuggaccaagaagucccucgagauggagugcaucggcccccugcagcaggucgacacgugcgacgacaaggccagccgcuccuacagcggcgaggcgaagaagcuggugcgggccuccaagaucagcgaccucgacgccgcccaggugcgccugcuggggcccaccaucgagagcgccaucgcguccauccggaagcagcgcaccuacagcaccaugcaccuccuggaguccguguuccugggcaagcacugcgacuacuacaagaccuucgagcacaacagcggguacucccaggccaaguggcggcucaccgccaagacgcaccacuucgacaucugcagccgccacuccacccaccacuucugccggugcaucagcgacgccaccaagugccagaacggcgacugggacuucgccggggagaugaacuccaccuaccagagcaagaaggacuucuucgagcacgaccugaagcuguucugcacgcucgucgagaacgcguuccccggcaccaccgagucccuguucuacgagaugcugagcaagaagaacaccacgggcgugaagaagcuccuggacaagcugacccgcaaguucgggaacaacaacauguucgugggcaucuggaaguucgggcaguaccucaugucccugccguacgucaacgagaccagccugacccccgcccagguggccaagauccucgaggugacggaccagcaccaccgguccaucagcggccgccaggagucccuggccagcgcgacccccgggagcaaguccaaggagugcggccacgccaagaaggucagcugcaucagcccccgcuucagcgugccgauggagggccugauggccugcggggacucccccaacuacaagaucuacaagacccccgccaagcucuacaagagcaacaacaagggcgagguguggugcuccggggacguccacugcagccaggagcugacccccgccucccaggagagcguggaccggaucaagcagaucacgugcuuccugaccgagccggagguguccgacgacgucuucagcaucgcgaucuccacgugcaaggugcaggacaagggcgugugcaccgucaacgaggaccgcuggaacgugaucaagugcgacagcggccucaucuacuacaccgaccagcgggacgggcaggacaccggcaacgacuucggggaguacugccugucccacagcugccgcaucgagcgguuccccaucaaccccgccaucaucuccgacugccugugggaguaccacagccgcaaguccaaguacaucaccagccucgaccuggagaaccuggaggaguucaagcgggccaucagcgagaagcucucccacacccugaucguguacaacuucaagcccacggccaaccugccgcacaucaagcccgucuacaaguacaucaccgugcagggcguggagaacagcgacggggucgacuccgccuacaucgcggccagcaugcccgcccucuccggcaccagcaucggcuacaacaucaugucccgcgacaacuucccccuguucgacaucaucaucuucaucaagagcgccaucaucaaggccaccuacaaccacaucuacgacacggggccgaccaucggcaucaacgugaugcacgacgagcacugcaccgggcagugccccaccgacaucccccacaaggagaacuggaucacguucgcgcaggagcggaccucccgcuggggcugcgaggaguucgggugccuggccgugaacaccggcugcgucuucggcagcugccaggacaucauccggccggagaccaagguguaccgcaaggccguggaggaguccguccuccugaccgugugcaucacguaccccgggaagaccuucugcaccgagaucaacgccaucgagcccaagaucaccgacgagcuggagcuccaguucaagacgguggacaccaagacccugcccaacauccuggcgguccagaaccacaagcucuacagcggccagaucaacgaccugggguccuucagccagggcugcgggaacauccagaagaccaacuccagcaucaucggcacgggcaccgccaaguucgacuacgugugccacggggccucccggaaggacaucaucgugcgccggugcuacaacaacaacuacgagagcugcaagcugcucaaggaggagcagucccugauguucgccgacaaccacgagaccaucgacgucgccaacgugcgccaccuccucggcgaccugcaguucaagcugaugcucggggaccugcgguacaagagcuucgcggagaacccggaccuggagaucgaggccaagugcgugggcugccccagcugcuucaccuccuacagcugcuccuucaagaucgccagcaacaucgacacggucugcuccaucgaggggcccugcaccaccuuccacaaccgccucaugaucaccagcacgaagcaggacuacggcaucaagauguccugcaagaccaagcccaaggagaccgaggaguuccagaucugcaagaagaccuacacggugcuguucaccaccguggagaagaacgacaagaucgagaucagcaccggcgaccagacguccuucauccaggagcgggacgaccgcugcaagaccuggcugugccgcguccgggacgaggggaucagcgugaucuucgagccgauccgcgccuucuucggcuccuacuucagcaucgccuucuacguggucguguccaucaucgugcuguuccuggcgaucuacaucuuccugcccauggucuucaagcuccgggacgugcugaagcgcaacgaguaccuguaccuccaggagaucaagcacaaguga

SEQ ID NO: 12582 - RNA, 4344 nt, Artificial Sequence
  derived and/or modified CDS sequence (opt1) from BWAV(M459)__NC_034490.1__GP
auggccauguucgagcugaucgugcuccuggccuucagcuacgucaccggcgugccccaggagcugacccgcugcuucaccgggggcuccgugguccggcagcacuggagcaagaacgcgaucuccgagcucugccugaaggacgacgugagcaucaucaaguccgagaucgaguacaagaagaacgagaccgggaccuucgcccugagcaagaucuaccgcaaguggaucaccacggacugggagaagugccagccgcagaaguccaccggcgggcacaucagcgugcucgagguccggcacgaccugacccuggccuccgccaccuacaucugcggcaaccccugcacgaucaacguggaccgcgagauggcccaggugcaccuccagaccgagggcgucaaccacuucgagaucagcgggaccaccaucaaguccggcugguucaagacgaccaccuacaucacccuggaccagacgugcgagcaccugaaggugagcugcgggaagcaguccgugcaguuccacgcgugcuucaagcagcacauggccugcguccgguuccuccaccgcaccauccugcccggcaacauggccaacagcaucugccagaacaucgagaucaucauccugcucgcccugacccuguccaucuucauccuccugugcauccugaccaagacguacaucugcuacauccuccugcccaucuucaucccgaucagcuacaucuacggguacuucuacaaccgguccugcaagaagugcagccagugcggccugguguaccaccccuucaccgagugcggccgcaacugcgugugcggggcgcgguacgacaccuccgagcgcaugaagcuccaccggcugagcggccugugccccggguacaagagccucaaggccgcccgcguccugugcaaguccaagggcagcgccuccauccugagcauccucaucucccugcugauccucaccuucgugacgcccaucaacggccugaugcugaaggacaccgacaucaccaaccucaagaucgacacccugccggacgacaugcuggagcucauccacaacguggacuaccugaagcugauccucgagaucaacaucacgaucuucggguucauccugaucaucauccuguucaugcuccugauguucuaccgguaccagcacaucuucaucagcaucuacgucaucgacugcaaggagugcaacauguaccacuccaagagcggccugcgcuacaacggggacuucaccaacaagugcaugaccugcacgugcggcgagguggacgacauggaggggcucaacaagcacaagaagcgguacaacugccugaucaaguacaagacgaccauccugcagcacuucuuccuguccauccucgugugccugauccugaaggagagcguccucuucgccgcggcccaguccgaggagaucaucaagugccuggagcaggagagccugaccuccaagugcaccggcccccuccugaagacgccccagugcaccgagcagcagaagaaccuccucuucaucgagaucgccaagcagauggagaaggacaacaucaucaccagccuggacaacgcccugaucgccaagcuccccaacgagaucgcgggcuccauggccauccuggacaccaagaaguacuaccacgagcagaucacccuggaguacgccauccucagcaaguacugcgacuacuacaagaaguacgaggggaacacgggcuacucccagaccaccuggcgcaccuaccugcggagccaggaccuggagaucugccucauccugccguaccaguucuucugccgcugcuucaaguccgggacgggcugcaucgacaccaagauggagaucaagagcaccauggacaccuacuacagcucccaccagacgaaguucgacagcgaccugaacuacaugcuccacgugauccaccuggccuuccggggguccgccaccagcuacaucgcgaagugccugaucgagaagaacuacaccgagaccaucuccuaccucacgaagauccaggagaaguaccccaacaaccagcugcugaagguggccaucuucuucaccaaccaccuccugaaccagagccuggucgagaacuucgagguguccaccgaguggagccgcuacaagcacuccaccgcccagcccgagcacgaguggaagaagggcagcgagcucaagaugcuggaccccaacaagcugaagacgggcccggccauccagaccugccuccacaucaaggaccugcacugcaucagcccccggagccgcgcccccaccuccgggaucaucacgugcggccugaacgaccaggcgugcgucuaccgcaagcccgacaagaagaucuacgccagccacaugacccagcacggguucugcgugauggacggccacugccucaagccguucgagcccaucuccggggagaugcugcagaucaucaagaaguccaagugcuggaccgaggacaucgaggaccugaucaccgagggccaggacaagggccggaucuccugccagcccaucgacguggggaacugcaacgucagcggcaaccucuggaccaucacgcugugcagcgacaagaaguucuacuacaccgacaacaagcacgugcacgacaacuccaaggacaucggguacuacugcauggaggagaacugcaagaucccccgcuucccgauccaccccgacuucgugaaggacugcgagugggaccugaaccacaucaagaucgaccaccucaagcagaucaacaucgaggacaucaacagcuacaagaagauccugaccgagaagcugaccacggcccucaacuccuucaaguacaagggcaacgagaaccugccccacagcauccccaaguacaaguacaucaccauccagggcacccagaccaucgacgggaucgagaacgccuucaucgaggucgagaucccggcgcuguccggcagcgccacgggguucaagaucuccagccgggacggcaucgagcuguucgacgccauccuguacgugaagcaggccuccuucagcuccguguacaagaagcuguacgucaccgggcccaccaucggcaucaacaccaagcacgacgagcgcugcacgggcgccugccccaugacccucccgcacagcuacggguggcugaccuucuccaaggagcggaccagccaguggggcugcgaggaguacgggugccuggcgaucuccgacggcugcguguucgggagcugccaggacaucaucaaggacgaccucaccaucuaccgcaaggagacggaggagcugucccuggccgagaucugcaucaccuucaugcacaacaccuucugcaccagcaucgacuccacgacccccaccaucaccgacauccucgaggcccaguucaagacgguggagagcuucaagcugcccaacaccgucggccugaagaugcacaagcucuacaucggcaccaucaacgacaucgggguguacaagaaggccugcggcaacgugcagaaguacaacaacaccauccuggggagcggcucccccaaguucgacuacgucugccaccuggccaagcggaaggacgugauccuccgcaagugcuucgacaacgacuacaacagcugcaagcugcugaagguggcgaacgaccuccggaucgaggaggacggggagaagcugaaggucaucaacuacaagaaggugaugggcacgcugaaguucaaggccaucuucggcgacaucaaguacaaguccuucacccaggacguggacaucgacgccgaggcgaccugcgucgggugccucaacugcuucgagaacaucaacugcgagaucaaggugcagagcccgcuggagaccacgugcgagguggaguccagcugcgaccuguucaccacccgcauccucuuccaccaggacauccacaaguacgcccugaagcugaucugcuccaaggaggccagcuccaaguucuggauccgguucugcaacaaggagaucaagagcuccaucagccucaucaacgccgcccccauccuggagcuggcccccaucgaccagaccuccuacgucaaggaggaggacgagcgcugcggcacguggaugugccggguggcgcaggaggggaucggcgugaucuucgagcccuucaagaaccucuucgggagcuaccugggcaucuucuacaucaucaucaucgucaucauccugcucgugcuguucguguacaucuuccugccgaugauccucaagcugaaggagauccugcagaagaacgaggucgccuaccagcgcgacaugaagauccgguga

SEQ ID NO: 12583 - RNA, 4344 nt, Artificial Sequence
  derived and/or modified CDS sequence (opt1) from BWAV(UgAr1888)__KJ867186.1__GP
auggccaucuucaagcugaucgugcuccuggccuucagcuacgcgaccggcgucccccaggagcugucccgcugcuucaccgggggcagcguggugcggcagcacugguccaagaacgccaucagcgagcucugccugaaggacgacgucuccaucaucaagagcgagaucgaguacaagaagaacgagacggggaccuucgcccugaacaagaucuaccgcaaguggaucaccaccgacugggagaagugccagccgcagaaguccacgggcgggcacaucagcgugcucgaggugcggcacgaccugacccuggccuccgccaccuacaucugcggcaaccccugcaccaucaacgucgaccgcgagauggcccaggugcaccuccagacggagggcgugaaccacuucgagaucagcgggaccaccaucaaguccggcugguucaagaccacgaccuacaucacccuggaccagaccugcgagcaccugaaggucagcugcgggaagcaguccgugcaguuccacgcgugcuucaagcagcacauggccugcgugcgguuccuccaccgcacgauccugcccggcaacauggccaacagcaucugccagaacaucgagaucaucauccugcucgcgcugacccuguccaucuucauccuccugugcauccugaccaagaccuacaucugcuacauccuccugcccaucuucaucccgaucagcuacaucuacggguacuucuacaaccgguccugcaagaagugcagccagugcggccuggucuaccaccccuucacggagugcggccgcaacugcgugugcggggcccgguacgacaccuccgagcgcaugaagcuccaccggcugagcggccugugccccggguacaagagccucaagaccgcccgcgugcugugcaaguccaagggcagcgccuccauccugagcauccucaucucccugcugauccucaccuucgucacgcccaucaacggccugaugcugaaggacaccgacaucaccaaccucaagaucgacacccugccggacgacaugcuggagcucauccacaacguggacuaccugaagcugauccucgagaucaacaucaugaucuucggguucauccugaucaucauccuguucaugcuccugauguucuaccgguaccagcacaucuucaucagcaucuacgugaucgacugcaaggagugcgacauguaccacuccaagagcggccugcgcuacaacggggacuucacgaacaagugcaugaccugcacgugcggcgaggucgacgacauggaggggcucaacaagcacaagaagcgguacaacugccugaucaaguacaagaccaccauccugcagcacuucucccugagcaugcucgugugccugauccugaaggaguccguccucuucgccgcggcccagcccgaggagaucaucaagugccuggagcaggagagccugaccuccgagugcaccggcccccuccugaagacgccccagugcaccgagcagcagaagaaccuccucuucauggagaucgccaagcagauggagaaggacaacgugaucaccagccuggacaacgcccugaucgccaagcucccgaacgagaucgcgggcuccauggccauccuggacaccaagaaguacuaccacgagcagaucacccuggaguacgccauccucagcaaguacugcgacuacuacaagaaguacgaggggaacaccggcuacucccagacgaccuggcgcaccuaccugcggagccaggaccuggagaucugccucauccugcccuaccaguucuucugccgcugcuucaaguccgggaccggcugcaucgacacgaagaucgaguucaagagcaccauggacaccuacuacagcucccaccagaccaaguucgacagcgaccugaacuacaugcuccacgugauccaccuggccuuccggggguccgccacgagcuacaucgcgaagugccugaucgagaagaacuacaccgagaccaucuccuaccucaccaagauccaggagaaguaccccaacaaccagcugcugaagguggccaucuucuucacgaaccaccuccugaaccagagccuggucgagaacuucgagguguccaccgaguggagccgcuacaagcacuccgccacccagcccgagcacgaguggaagaagggcagcgagcucaagauccuggacuccaacaagcugaagaccggcccggccauccagacgugccuccacaucaaggaccugcacugcaucagcccccggucccgcgcccccaccagcgggaucaucacgugcggccugaacgaccaggcgugcgucuaccgcaagcccaacaaggagaucuacgccucccacaugacccagcacggguucugcaucauggacggccacugccucaagccguucgagcccaucagcggggagaugcugcagaucaucaagaaguccaagugcuggaccgaggacaucgaggaccugaucaccgagggccaggacaagggccggaucagcugccagcccaucgacguggggaacugcaacgugagcggcaaccucuggaccaucacccugugcuccgacaagaaguucuacuacacggacaacaagcacguccacgacagcuccaaggacgugggguacuacugcauggaggagaacugcaagaucccccgcuucccgauccaccccgacuucgugaaggacugcgagugggaccugaaccacauggagaucgaccaccucaagcagaucaacaucgaggacaucaacagcuacaagaagauccugaccgagaagcugaucaccgcccucaacuccuucaaguacaagggcaacgagaaccugccccacagcauccccaaguacgaguacaucaccauccagggcacgcagaccaucgacgggaucgagaacgccuucaucgaggucgagaucccggcgcuguccggcagcgccaccggguucaagaucuccagccgggacggcaucgagcuguucgacgccauccuguacgugaagcaggccuccuucagcuccguguacaagaagcuguacgucaccgggcccacgaucggcaucaacaccaagcacgacgagcgcugcaccggcgccugccccgugacccucccgcacagcuacggguggcugacguucuccaaggagcggaccagccaguggggcugcgaggaguacgggugccuggcgaucuccgacggcugcguguucgggagcugccaggacaucaucaaggacgaccucaccgucuaccgcaaggagaccgaggagcugucccuggccgagaucugcaucaccuucaugcacaacacguucugcaccagcaucgacagcaccacccccacgaucaccgacauccucgaggcccaguucaagaccguggaguccuucaagcugcccaacaccgugggccugaagaugcacaagcucuacaucggcacgaucaacgacaucggggucuacaagaaggccugcggcaacgugcagaaguacaacaacaccauccuggggagcggcucccccaaguucgacuacgugugccaccuggccaagcggaaggacgucauccuccgcaagugcuucgacaacgacuacaacagcugcaagcugcugaagguggcgaacgaccuccggaucgaggaggacggggagaagcugaaggugaucaacuacaagaaggucaugggcacccugaaguucaaggccaucuucggcgacgugaaguacaaguccuucacccaggacguggacaucgacgccgaggccacgugcgucgggugccucaacugcuucgagaacaucaacugcgagaucaaggugcagagcccgcuggagacgaccugcgagguggaguccagcugcgaccuguucaccacccgcauccucuuccaccaggacauccacaaguacgcccugaagcugaucugcuccaaggaggcgaccagcaaguucuggauccgguucugcaagaaggagaucaaguccagcaucucccucaucaacgccgcccccauccuggagcuggcccccaucgaccagaccagcuacgucaaggaggaggacgagcgcugcggcaccuggaugugccggguggcgcaggaggggaucggcgugaucuucgagcccuucaagaaccucuucggguccuaccugggcaucuucuacaucaucaucaucgucaucauccugcucgugcuguucguguacaucuuccugccgaugauccucaagcugaaggagauccugcagaagaacgaggucgccuaccagcgcgacaugaaggugcgguga

SEQ ID NO: 12584 - RNA, 4332 nt, Artificial Sequence
  derived and/or modified CDS sequence (opt1) from BWAV/PGAV(SAAr1)__KJ867177.1__GP
augaucugcaucugcaucuucguggccaucuuccccgccaucuacgcgaucccggacagcuacucccgcugcuucaccggcgggaccgucgugaaggagauguggagcaaggacgccgugacggagcugugcaucaaggacgacgucuccaucgugaagaccgagaccagcuacaagaagaacggcaccgggacguucgcccucaacaaggugacccggaaguggcugaugaccgacugggagaagugcaagccccagaaguccagcuccggccacaucaacgucaucgaggugcgcgacgaccugacccucgccacgagcaccuacaucugcuccagcuccugcaccaucaacguggaccgggagaccgcccagauccagcugaacacggacagcaucaaccacuucgagaucgcggggaccaccaucaagaccggcugguucaaguccacgacccuggucgcccucgaccagaccugcgagcaccugaaggugagcugcggcaagcaguccgugcaguuccacgccugcuucaaccagcacaugagcugcguccgcuuccugcaccggaccauccuccccgggaacauggccaaguccaucugccagaacaucgagaucaucauccuggugggccugaucauccucaucuuccugcugcucugcauccugacgaagaccuacaucugcuacauccugcuccccaucuucaucccgcugagcuacgcguacggguacuucuacaacaaggccugcaagaagugcucccagugcggccugguguaccaccccuucaccgagugcgggagcaacugcgucugcggcgcccgcuacgacaccagcgagcggaugaagcuccaccgcaucuccggccugugccccggguacaagagccugcggacggcccgcgugcucugcaaguccaagggcagcgccuccauccugagcauccugaucuccauccucauccugauguucgugacccccaucaacggguacaugaucaccaacgaguucgacgagggcaagcugaccgucgacagccucccggacgacaugcuguccaugaucagccggcuguccgcgcuccaguucaucuucacgcugaacaucgccugcagcgugcuggugacccuccugaccugccuguuccucaucaucuucuaccgcuuccagcaccgguuccuguccaaguacgccaucaacugcaccgagugcgacauguaccaccagaagaagggccugaucuacaacggggacuucacgaacaagugcaugaccugcacgugcggcgaggucaacgacauggaggggcucaacaagcacaagaagcgcuacaacugccugaucaaguacaaggccgccugguuccugaaccucaccaucaccaucaucugccugaugcugaucaaggacggcagcaugauggcggccgccgagaccaacaucgagaccugcauggccaagcccucccucaccaccgacugcacggggcccuuccugaagaucaccaagugcgacgagagccagaaggcccugcccuuccaggagaucgcgaagcagcuggugaaguccaacgugcucacccugcuggacaagcacaucgucgagaagcucccgaacgagaucgccggcagccuguccauccuggacaagaagcagcacuaccacgagcagcucgccguggaguacggcauccugagcaaguacugcgacuacuacgagcuguacaagagcaacuccggguacagccaguccaccuggggcacguaccuccggagccacgacuucgagaucugccugcugcuccccuaccaguacgucugccgcugcuucaaguccgggaccggcugcaccgacaccaaguucgaguucgagcagaagaugaacgagacguacaacagcaagaacgacauguacaacuccgacuucacccuggcccugaccgugcuccaccuggccaugcgggggaccgcgagcacguacaucaucgacaacgugcugcagaagaacuacuccaacgucaucgaguaccucaacaccaccaagaacaacuucaagagcaaccagguguucggcgugcuggucgacuucaccaucuaccugcuccgccacgccuccuacgccaaguacaaccugccccagagccugaagaaguuccgguccgugagcuccgaccucacgaccaucagcggccgcuccagcgggcagaacaucgugagcgaccugcaccagggcgacgucaucaagaccugccugaacaucaagcagcucaacugcaucucccccaagagccggaccacgaccaccaaccugaucacgugcggguccagccagaucuccguguacaaccugccgcgcggccagcucuacgagagcgugaccaccgagcacgggaccugcgccggcgacggccacugccugaccgacuucaugcccaucaacuccgacuuccuggcgacgcucaagaaguccaagugcuggaccaccgacauccccaacaucaucaagcuggucgagagcgacgggaagaucagcugccagcccaucgacgugggcuccugcaacgugagcgggaacaucuggaccaucacgaagugcuccgacaacaaguacuacuacaccgacaacaagcacguccacgacgacgagaaggacaucggccacuacugcauggaggagaccugcaaguucgugcgcuucccgaucaacgacaaguucgugagcaacugcgagugggaccugaaccacaucgagaucaacaagcucaaccaggucgagcuggacaacaucaacgccuacaagaaggugcugaccgagaagcucacguccagccuguccguguucaaguacaagcugacccagaaccucccccacgucauccccaaguucaaguacaucaccauccagggcacccagaccguggacgggaucgagaacagcuucaucgagguggagauccccgcccuguccggcgccgccagcggguucaagaucaugacgaaggagaacaacgagcuguucgacgcgauccucuacgucaagcaggccagcuucuccagcaucuacaagaagaucuacaccaccggcccgaccaucgggaucaacacgaagcacgacgagaagugcaccggcgccugccccgugaaccugccccacuccaccggcuggcugaccuucgccaaggagcggacgagcaccugggggugcgaggaguacggcugccucgccaucaacgacgggugcguguucggcuccugccaggacaucaucaaggacgagauguacaucuucaagaaggagaccgaggaggucgcgcugguggagaucugcaucagcuucaaccacaagaccuucugcacggacguggacuccaccacccccaucaucaccgacacgcuggaggcccaguucaagaccgucgagagcuacaagcucccgaaccacguggcccugaagcagcacaagcuguacguggggcagaucaacgacuucggcgucuacaagaaggccugcggcaacgugcagaagaucaacaacaccaucuacggggagggcacgccccgcuucgacuaccucugccaccuggccaagcggaaggacgugcugguccgcaagugcuucgacaacgacuacaacuccugcagccuccugaccaucgcggacgaccugcggcucgaggaggacggggagaagcugaaggugaucaacuaccgcaaggugcugggcuccaugaaguucaaggcccucuucggggacauccgguacaagagcuucaccgaggacaucgagcuggacgucgaggccuccugcgccggcugcaucaacugcuucgacaacauccacugcgagaucaagcugaccaacggccucgacaccagcugcuccuucgagagcuccugcgacgcguucaacagccgcauccuguucaacuccaaccagcacguguacagcacgaagcugaucugcaccaaggagcagaccaaggccuucgagaucaagaucugcgggaagaccaucaaggccgaccucguggucacggaggccaagcccauccuggagcugaccccgaucgaccagaccagcuacaucaaggaggaggacacccggugcggcacgugguucugccgccucaccaaggagggguucuccgugcugcuggagcccuucaagaaccucuucggcagcuaccuggggaucgccuacaccaucaucaucgcgcugcucugccuguucguguucaucuacaucauccugcccaugaucaugaagcucaaggagguccugaagcagaacgagaucgccuaccagaaggagcagaagaagcgguga

SEQ ID NO: 12585 - RNA, 4332 nt, Artificial Sequence
  derived and/or modified CDS sequence (opt1) from BWAV/PGAV(191B-07)__KJ867180.1__GP
augaucuacaucuacaucuucguggccaucuuccccgccaucuacgcgaucccggacagcuacucccgcugcuucaccggcgggaccgucgugaaggagauguggagcaaggacgccgugacggagcugugcaucaaggacgacgucuccaucgugaagaccgagaccagcuacaagaagaacggcaccgggacguucgcccucaacaaggugacccggaaguggcugaugaccgacugggagaagugcaagccccagaaguccagcuccggccacaucaacgucaucgaggugcgcgacgaccugacccucgccacgagcaccuacaucugcuccagcuccugcaccaucaacguggaccgggagaccgcccagauccagcugaacacggacagcaucaaccacuucgagaucgcggggaccaccaucaagaccggcugguucaaguccacgacccuggucgcccucgaccagaccugcgagcaccugaaggugagcugcggcaagcaguccgugcaguuccacgccugcuucaaccagcacaugagcugcguccgcuuccugcaccggaccauccuccccgggaacauggccaaguccaucugccagaacaucgagaucaucauccuggugggccugacgauccucaucuuccugcugcucugcauccugaccaagaccuacaucugcuacauccugcuccccaucuucaucccgcugagcuacgcguacggguacuucuacaacaaggccugcaagaagugcucccagugcggccugguguaccaccccuucaccgagugcgggagcaacugcgucugcggcgcccgcuacgacacgagcgagcggaugaagcuccaccgcaucuccggccugugccccggguacaagagccugcggaccgcccgcgugcucugcaaguccaagggcagcgccuccauccugagcauccugaucuccauccucauccugauguucgugacccccaucaacggguacaugaucaccaacgaguucgacgagggcaagcugacggucgacagccucccggacgacaugcuguccaugaucagccggcuguccgcgcuccaguucaucuucacccugaacaucgccugcagcgugcuggugacccuccugaccugccuguuccucaucaucuucuaccgcuuccagcaccgguuccuguccaaguacgccaucaacugcacggagugcgacauguaccaccagaagaagggccugaucuacaacggggacuucaccaacaagugcaugaccugcacgugcggcgaggucgacgacauggaggggcucaacaagcacaagaagcgcuacaacugccugaucaaguacaaggccgccugguuccugaaccucaccaucaccaucaucugccugaugcugaucaaggacggcagcaugauggcggccgccgaguccaacaucgagaccugcauggccaagcccagccucaccaccgacugcacggggcccuuccugaagaucaccaagugcgacgagucccagaaggcccugcccuuccaggagaucgcgaagcagcuggucaagagcaacgugcucacccugcuggacaagcacaucguggagaagcucccgaacgagaucgccggcucccugagcauccuggacaagaagcagcacuaccacgagcagcucgccguggaguacggcauccugagcaaguacugcgacuacuacgagcuguacaaguccaacagcggguacucccagagcaccuggcggacguaccuccgcucccacgacuucgagaucugccugcugcuccccuaccaguacgucugccggugcuucaagagcggcaccgggugcaccgacaccaaguucgaguucgagcagaagaugaacgagacguacaacuccaagaacgacauguacaacagcgacuucacccuggcccugaccgugcuccaccuggccaugcgcggcaccgcguccacguacaucaucgacaacgugcugcagaagaacuacagcaacgucaucgaguaccucaacaccaccaagaacaacuucaaguccaaccagguguucggggugcuggucgacuucaccaucuaccugcuccggcacgccagcuacgccaaguacaaccugccccagucccugaagaaguuccgcagcguguccagcgaccucacgaccaucuccggccggagcagcggccagaacaucguguccgaccugcaccagggggacgucaucaagaccugccugaacaucaagcagcucaacugcaucagcccccgcucccgcaccacgaccaccaaccugaucacgugcggcaccagccagaucuccguguacaaccugccgcgggggcagcucuacgagagcgugaccaccgagcacgggaccugcgccgacgacggccacugccugacggacuucaugcccaucaacuccgacuuccuggcgacccucaagaaguccaagugcuggaccaccgacauccccaacaucaucaagcuggucgagagcgacggcaagaucagcugccagcccaucgacgugggcuccugcaacgugagcgggaacaucuggacgaucaccaagugcuccgacaacaaguacuacuacaccgacaacaagcacguccacgacgacgccaaggacaucggccacuacugcauggaggagaccugcaaguucgugcgcuucccgaucaacgacaaguucgugagcaacugcgagugggaccugaaccacaucgagaucaacaagcucaaccaggucgagcuggacaacaucaacgccuacaagaaggugcugacggagaagcucaccuccagccuguccguguucaaguacaagcugacccagaaccucccccacgucauccccaaguucaaguacaucaccauccaggggacccagacgguggacggcaucgagaacagcuucaucgagguggagauccccgcccuguccggcgccgcgagcggguucaagaucaugaccaaggagaacaacgagcuguucgacgccauccucuacgucaagcaggccagcuucuccagcaucuacaagaagaucuacaccaccggcccgacgaucgggaucaacaccaagcacgacgagaagugcaccggcgccugccccgugaaccugccccacaacaccggguggcugacguucgccaaggagcggaccuccaccuggggcugcgaggaguacggcugccucgcgaucaacgacgggugcguguucggcagcugccaggacaucaucaaggacgagauguacaucuucaagaaggagaccgaggaggucgcccugguggagaucugcaucuccuucaaccacaagacguucugcaccgacguggacagcaccacccccaucaucacggacacccuggaggcccaguucaagaccgucgaguccuacaagcucccgaaccacguggcccugaagcagcacaagcuguacguggggcagaucaacgacuucggcgucuacaagaaggccugcgggaacgugcagaagaucaacaacaccaucuacggcgagggcacgccccgcuucgacuaccucugccaccuggcgaagcggaaggacgugcugguccgcaagugcuucgacaacgacuacaacagcugcucccuccugaccaucgccgacgaccugcggcucgaggaggacagcgagaagcugaaggugaucaacuaccgcaaggugcugggguccaugaaguucaaggcccucuucggcgacauccgguacaagagcuucaccgaggacaucgagcuggacgucgaggccuccugcgcggggugcaucaacugcuucgacaacauccacugcgagaucaagcugaccaacggccucgacacgagcugcuccuucgagagcuccugcgacgccuucaacagccgcauccuguucaacuccaaccagcacguguacagcaccaagcugaucugcaccaaggagcagaccaaggccuucgagaucaagaucugcgggaagacgaucaaggccgaccucguggucaccgaggccaagcccauccuggagcugaccccgaucgaccagaccagcuacaucaaggaggaggacacgcggugcggcaccugguucugccgccucaccaaggagggcuucuccgugcugcuggagcccuucaagaaccucuucgggagcuaccugggcaucgcguacaccgugaucaucgcccugcucugccuguucgucuucaucuacaucauccugcccaugaucaugaagcucaaggaggugcugaagcagaacgagaucgccuaccagaaggagcagaagaagcgguga

SEQ ID NO: 12586 - RNA, 4326 nt, Artificial Sequence
  derived and/or modified CDS sequence (opt1) from CEV(283)__KX817313.1__GP
augaucuucaugcugauccucuucgccguggccgcggccagccccgucuaccagcgcugcuuccaggacggcgccaucgugaagcagaacccguccaaggaggccgugaccgaggucugccugaaggacgacgugagcaugaucaagaccgaggcccgguacacgaagaacuccaccgggguguucagcaacaacgucgcgauccgcaaguggcugguguccgacuggcacgacugccggccccgcaagguggucggcgggcacaucaacgugaucgaggugggcgacgaccucacccugcacaccgagagcuacgucugcuccgccgacugcacgaucgggguggacaaggagaccgcccaggugcggcugcagaccgacaccacgaaccacuucgagaucgccggcaccaccgucaagagcggcugguucaaguccaccacguacaucagccucgaccagaccugcgagcaccugaagguguccugcgggcccaagagcauccaguuccacgcgugcuucaaccagcacauguccugcgugcgcuuccugcaccggaccauccuccccggcagcaucgccaacuccaucugccagaacgucgagaucaucauccuggugacccuggcccuccugaucuucauccugcucagcaucaucuccaagacguacaucugcuaccugcugaugccgaucuucauccccaucgccuacaucuacgggcucaucuacaacaagagcugcaagaagugcaagcugugcggccugguguaccaccccuucaccgagugcgggacccacugcgucugcggcgcccgcuacgacaccuccgaccggaugaagcuccaccgcgcgagcggccugugccccggguacaagagccugcgggccgcccgcgugaugugcaaguccaagggcccggccagcauccucuccaucaucacggccgugcugauccugaccuucgucacccccaucaacgcgaugauggugggggagagcaaggagaccuucgagcucgaggagcugcccgacgacaugcuggagauggccaacaaccucaacacguacuacaugcugugcgucgccaacuacgccgugaccuggucccugcucaucguggcccugaucaucggccugcuguucaagaaguaccagcaccgguuccuggacaucuacgcgauguacugcgaggagugcgacauguaccacgaccgcagcggcaucaaguggaacggggacuucaccaacaagugcggccacugcacgugcgggcaguacgaggacgccuccggccugcucguccaccggaagaccuacaacugccugauccaguacaagagcaaguggaucaugaacuuccuggugaccuacgugauccucguccugcugaaggacuccguggugaucguccaggccaaggggguggacuucagcgagugcaucgaggccgagaaggugcgcuggaacugcaccggccccuucgucaaccucggcaacugcgagaagaagcagaagaaggagccguacuccaacaucgccgcgcagcugaaggggcugggcgccaucagcauccucgacgugcccaucaucgccuccauccccgaggacaucgccggggcgcugcgguacaucgaggaccagcgcagcuaccacucccagcugaccguggaguacgccaugcugacgcgguacugcgacuacuacacccaguucagcgacaacuccggcuacagccagaccaccuggcgcgucuaccuccggucccacgacuucgaggccugcgugcuguaccccaaccagcacuucugccgcugcgugaagcacggggacaagugcagcagcuccaacugggacuucgccagcgagaugaagaacuacuacuccggcaagcagagcaaguucgacaaggaccugaaccucgcccugacgucccugcaccacgcguuccgcggcaccagcuccagcuacaucgccgggcuccuguccagcaaggccaacgacgagcugguccaguacaccuccaagauccgggagaaguucccgggcaacgcccuccugaaggccgugaucgacuacaucgcguacaugaaggggcugaccgagaugagcaacuucaagaaggacgaguucugggacgagcucguguacguccccgaccccaccaagcccccgaagcugucccgcagcuccggcacgguguacgacuucaagagcgccaccuccaaccugggggagaagaacugcaaggacgugaagggcgucgugugccucagcccccggagcggcgugaccuacgacuccaucaucgccugcggggagggcagcucccccaacaucuaccgcauccccaagaccggggucuaccagagcaacuccgagccgagcaacuacugcguguccgacagccacugccuggaggacuucgaggugaucaaccaggaggagcuggacgccaucaagaagucccggugcugggaggucgacuaccucuacgccaaccccagcaagcaguccgacggcauccgcagcugccggaugcgcgacgcgggccacugcaacgugacgaccaaccgguggcccaucauccagugcgacgacaacaaguacuacuacuccgagcugcagcgcgacuacgacaaggagcaggacaucgggcacuucugccugagcccccggugcaccaccgugcgcuucccgauccaccccaagcacgucuccaacugcgacuggcaggucagccacuccacgguggacaagguggacgugcacaaccucgaggacaucgagcaguaccggaaggccaucacccagaagcugcagaacagccuguccaucuucaaguacgcccgcaccaagaaccucccccacaucaagccgaucuacaaguacaucaccaucgagggcacggagaccgccgaggggaucgagagcgcguacaucgagagcgagauccccgcccuggccggcaccuccaucggguucaagaucaacaccaaggagggcaagcaccuccucgacgugaucgccuacgucaagcaggccagcuacuccagccuguacaacaagauguacgugacgggccccaccguggggaucaacaccaagcacgacgagcugugcaccggccccugcccggucaacgugccccacuccgacggguggcucacguucgcgcgggagcgcaccagcuccuggggcugcgaggaguucgggugccuggccaucagcgacggcugcguguucggcuccugccaggaccugaucaaggaggagcucgccgucuaccggaaggagaccgaggaggccaccaacguggagcugugccugacguucagcgacaagaccuacugcaccgagcucaaccccaucacccccaucaucacgaaccuguucgaggugcaguucaagaccgucgagaccuacucccugccgcgcgugguggccguccagaaccacgagauccggaucgggcagaucaacgaccucggcaucuacagcaaggggugcggcaacgugcagaaggucaacaacaccaucuacgggaacggcgugcccaaguucgacuaccugugccaccuggcgucccgcaaggaggugaucguccgcaagugcuucgacaacgacuuccaggccugcaaguuccuccagagcccgcccuccuaccggcuggaggaggacgacggcagcaucacggugaucgacuacaagaagauccuggggaccaucaagaugaaggccauccucggcgacgugaaguacaagaccuucgccgagaacaucgacaucaccgccgagggggucugcacgggcugcgugaacugcuucgagaacauccacugcgagcugaccauccacaccaccaucgaggcguccugccccgugaccagccccugcacgcuguuccacgaccgcauccucaucacccccgacgagcacaaguacgccaugaaggucaucugcaccgagaagcagaccgggacgcugcccuucaagaucugcaacuccaagguggacgccacccugacccucguggaggccaagccgauccuggagcuggcgagcgucgaccagaccgccuacauccgggagaaggacgagcgcugcaagacguggaugugccgggugcgcgacgagggcauccaggugauccucgagcccuucaagaaccuguucggcagcuacaucgggaucuucuacaccuccauccugaucgucaucaccaucuucaucaucaucuacgugauccuccccaucugcuucaagcugaaggacacccugcagaagcacgaggacgccuacaagcgggagaugaagauccgcuga

SEQ ID NO: 12587 - RNA, 4326 nt, Artificial Sequence
  derived and/or modified CDS sequence (opt1) from CEV(BFS283)__AF123483.1__GP
augaucuucauccugauccucuucgccguggccgcggccagccccgucuaccagcgcugcuuccaggacggcgccaucgugaagcagaacccguccaaggaggccgugaccgaggucugccugaaggacgacgugagcaugaucaagaccgaggcccgguacacgaagaacuccaccgggguguucagcaacaacgucgcgauccgcaaguggcugguguccgacuggcacgacugccggccccgcaagguggucggcgggcacaucaacgugaucgaggugggcgacgaccucacccugcacaccgagagcuacgucugcuccgccgacugcacgaucgggguggacaaggagaccgcccaggugcggcugcagaccgacaccacgaaccacuucgagaucgccggcaccaccgucaagagcggcugguucaaguccaccacguacaucagccucgaccagaccugcgagcaccugaagguguccugcgggcccaagagcauccaguuccacgcgugcuucaaccagcacauguccugcgugcgcuuccugcaccggaccauccuccccggcagcaucgccaacuccaucugccagaacgucgagaucaucauccuggugacccuggcccuccugaucuucauccugcucagcaucaucuccaagacguacaucugcuaccugcugaugccgaucuucauccccaucgccuacaucuacgggcucaucuacaacaagagcugcaagaagugcaagcugugcggccugguguaccaccccaucaccgagugcgggacccacugcgucugcggcgcccgcuacgacaccuccgaccggaugaagcuccaccgcgcgagcggccugugccccggguacaagagccugcgggccgcccgcgugaugugcaaguccaagggcccggccagcauccucuccaucaucacggccgugcugauccugaccuucgucacccccaucaacgcgaugauggucgggggcagcaaggagaccuucgagcucgaggagcugcccgacgacaugcuggagauggccaacaaccucaacacguacuacaugcugugcgugaccaacuacgccgugaccuggucccugcucaucaucgcccuggccaucggccugcuguucaagcgguaccagcaccgcuuccuggacaucuacgcgauguacugcgaggagugcgacauguaccacgaccggagcgggaucaaguggaacggcgacuucaccaacaagugcgggcagugcacgugcggccaguacgaggacgccuccgggcugcucgugcaccgcaagaccuacaacugccugauccaguacaagagcaaguggaucaugaacuuccugaucaccuacgucauccucgugcugcugaaggacuccguggucaucgugcaggccaagggcaccgacuucagcgagugcaucgacgccgacaagaucaaguggaacugcacgggccccuucgugaaccucgggaacugcgagaagaagcagaagaaggagccguacuccaacaucgccgcgcagcugaagggccugagcgccaucuccauccucgacguccccaucaucgccagcauccccgaggacaucgccggggcgcugcgguacaucgaggaccagcgcuccuaccacagccagcugaccguggaguacgccaugcugacccgguacugcgacuacuacacccaguucuccgacaacagcggcuacucccagacgaccuggcgcguguaccuccggagccacgucuucgaggccugcauccuguaccccaaccagcacuucugccgcugcgugaagcacggggacaagugcagcuccagcaacugggacuucgccuccgagaugaagaacuacuacagcggcaagcagaacaaguucaacaaggaccugaaccucgcccugaccucccugcaccacgcguuccgcggcaccagcuccagcuacaucgccgggcuccuguccaccaaggccaacgacgagcuggugcaguacacgagcaagauccgggagaaguucccgggcaacgcccuccugaaggccaucaucgacuacaucgcguacaugaaggggcugaccgagauguccaacuucaagaaggacgaguucugggacgagcucgucuacgugcccgaccccaccaagcccccgaagcugagccgcggcuccgagaccguguacgacuucaagagcgccacguccaaccugggggagaagaacugcaaggacgucaagggcguggugugccucagcccccgguccggcgucaccuacgacagcaucaucgccugcggggagggcagcucccccaacaucuacaagauccccaagaccgggguguaccagagcaacuccgagccgagcaacuacugcguguccgacagccacugccuggaggacuucgaggucaucucccaggaggagcuggacgccaucaagaagucccgcugcugggagguggacuaccucuacgccaacccgcccaagcaguccgacggcgugcggagcugccgcaugaaggacgcgggccacugcaacgucaccacgaaccgguggcccaucauccagugcgacgacaacaaguacuacuacuccgagcugcagcgcgacuacgacaaggagcaggacaucgggcacuucugccugagcccccggugcgccaccgugcgcuuccccauccaccccaagcacaucuccaacugcgacuggcaggucagccacuccaccguggacaaggugaacgugcacaaccucgaggacaucgagcaguaccggaaggccaucacccagaagcugcagaacagccuguccaucuucaaguacgcccgcacgaagaaccucccgcacaucaagcccaucuacaaguacaucaccaucgagggcaccgagaccgcggaggggaucgagagcgccuacaucgaguccgagauccccgcccuggccggcacgagcaucggguucaagaucaacaccaaggagggcaagcaccuccucgacgucaucgccuacgugaagcaggcgagcuacuccagccuguacaacaagauguacgugaccggccccaccgucgggaucaacacgaagcacgacgagcugugcaccggcccgugccccgugaacgugccccacuccgacggguggcucaccuucgcccgggagcgcaccagcuccuggggcugcgaggaguucgggugccuggccaucagcgacggcugcgucuucggcuccugccaggaccugaucaaggaggagcucacgguguaccggaaggagaccgaggaggccaccaacguggagcugugccugaccuucgccgacaagacguacugcaccgagcucaaccccgucaccccgaucaucaccaaccuguucgaggugcaguucaagacgguggagaccuacagccugccccgcgucguggcggugcagaaccacgagauccggaucgggcagaucaacgaccucggcgucuacuccaaggggugcggcaacgugcagaaggugaacaacaccaucuacgggaacggcguccccaaguucgacuaccugugccaccuggccagccgcaaggaggugaucguccggaagugcuucgacaacgacuuccaggccugcaaguuccuccagagcccgcccagcuaccgccuggaggaggacgacggcuccaucaccgugaucgacuacaagaagauccuggggacgaucaagaugaaggccauccucggcgacgugaaguacaagaccuucgccgagaacaucgacaucaccgcggagggggucugcaccggcugcaucaacugcuucgagaacauccacugcgagcugaccauccacacgaccaucgaggccagcugccccgugaccucccccugcacccuguuccacgaccgcauccucaucacgcccgacgagcacaaguacgccaucaaggugaucugcaccgagaagcagaccgggacccugccguucaagaucugcaacagcaagaucgacgccacgcugacccucgucgaggcgaagcccauccuggagcuggcccccguggaccagaccgccuacauccgggagaaggacgagcgcugcaagaccuggauguaccgggugcgcgacgagggcauccaggucauccucgagcccuucaagaaccuguucggcuccuacaucgggaucuucuacacgagcauccugguggugaucgccauguucaucaucgucuacgugauccucccgaucugcuucaagcugaaggacacccugcagcggcacgaggacgccuacaagcgcgagaugaagauccgguga

SEQ ID NO: 12588 - RNA, 4329 nt, Artificial Sequence
  derived and/or modified CDS sequence (opt1) from CHATV(Mohko ILO8-3)__KF719222.1__GP
augaugaucuucauccugauccucuucgccgugagcgccgcgucccccgucuaccagcgcugcuuccaggacggcgccaucgugaagcagaacccgagcaaggaggccgugaccgaggucugccugaaggacgacguguccaugaucaagaccgaggcccgguacgugaagaacgccacggggaucuacagcaacaacgucgcgauccgcaaguggcugguguccgacuggcacgacugccggccccgcaaggugagcggcgggcacaucaacgucaucgaggugggcgacgaccucucccugcacaccgagagcuacgugugcuccgccgacugcaccaucggggucgacaaggagaccgcccaggugcggcugcagacggacaccaccaaccacuucgagaucgccggcaccacggucaagagcggcugguucaaguccaccaccuacaucacccucgaccagacgugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggucacccugacccuccugaucuucgugcugcucuccauccugagcaagacguacaucugcuaccugcucaugccgaucuucauccccaucgccuacaucuacgggaucaucuacaacaaguccugcaagaagugcaagcugugcggccugguguaccaccccuucaccgagugcgggacccacugcgucugcggcgcccgcuacgacaccagcgaccggaugaagcuccaccgcagcuccggccugugccccggguacaagagccugcgggccgcgcgcgugaugugcaaguccaagggcccggccagcauccucuccaucaucacggccauccuggugcugaccuucgucacccccaucaacagcauggugaucggggaguccaaggaggucuucgagcucgaggagcugcccgacgacaugcuggagauggcccucaagaucaaccuguacuacuucgugugcgugaucaacuacgccgucaccuggagccuggugaucguggcgcuccugaucgcccugaucuucaagaaguaccagcaccgguuccucaaccuguacgccauguacugcgaggagugcgacauguaccacgaccgcaucggccugaagcggaacggcgacuucacgaacaagugccgccagugcacgugcgggcaguacgaggacgccaccggccucaugacccaccggaagaccuacaacugccugguccaguacaaguccaaguggauccugaacuuccucaucaccuacaugauccugacccugaucaaggacagcgccaucaucgugcaggcggccgggaccgacuucuccgccugccucgaggcccagagcguggacuggaacugcacgggccccuuccugaaccuggggaacugccagaagcagcagaagaaggaguccuacgccaacaucgcgacccagcucaagggccugcaggccaucagcguccuggacgugccgaugaucgccaacauccccgaggacaucgccggcgcgcugcgcuacaucgaggagaaggacaccuuccacgugcagcucaccgccgaguacgccaugcugacgcgguacugcgacuacuacacccaguucgccgacaacuccggguacagccagaccaccuggcgcgucuaccugcggucccacgacuucgacgccugcauccucuaccccaaccagcacuucugccgcugcgugaagcacggcgacaagugcagcuccagcaacugggacuucgcgaacgagaugaagaacuacuacagcgggaagcagaacaaguucgacaaggaccugaaccuggcccucauggccgugcaccacgccuuccgcggcaccuccagcgccuacaucgcgacgaugcuguccaagaaguccaacaacgaccuggucaccuacaccaacaagaucaaggagaaguuccccgggaacgcccuccugaaggccaucauggacuacaucagcuacaugaagggccugagcgagaugaccaacuucaaguacgacgaguucugggacgaccuccugcacaagccgucccccacgaacgccccgccccugagccgggacuccgagcccagcuacaacuucaaguccgugaucagcucccgcagcgugaaguccugcaagaacgucaagaacguggugugccucagcccccgguccggcgucagcuacgacagcauccuggccugcggggagcccaacggccccuccguguacaagaagccgagcgacgggguguuccaguccaacagcgacaagaccauguacugccuggcggacucccacugccucgaggacuucgaggucgugagccaggaggagcuggacgccaucaagaaguccaagugcugggugaccgaguaccccaacgucaagcugagcaagcucuccgacggcaucaccagcugccgcaugaaggacuccgggaagugcaacguggccgccaaccgguggcccaucauccagugcgagaacgacaaguucuacuacagcgagcugcagaacgacuacgacaagacgcaggacaucggccacuucugccugucccccggcugcagcaccauccgcuucccgaucaaccagaagcacaucuccaacugcaacuggcaggucagccgguccagcaucgcgaagaucgacgugcacgacaucgaggacaucgaccaguaccgcaaggccaucacccagaagcuccagaccgggcugucccuguucaaguacgccaagacgaagaaccucccccacaucaagcccaucuacaaguacaucaccaucgagggcaccgagaccgccgaggggaucgagagcgccuacaucgagagcgagaucccggcgcuggccggcacguccaucggcuucaagaucaacagcaaggaggggaagcaccuccuggacaucgugggcuacgugaaguccgccagcuacuccagcgucuacaccaagcuguacuccaccgggcccaccagcggcaucaacacgaagcacgacgagcugugcaccgggcccugccccgugaacaucaaccaccagaccggcuggcucaccuucgccaaggagcggacguccagcuggggcugcgaggaguucgggugccuggccaucuccgacggcugcguguucgggagcugccaggacaucguccgcgacgagcuguccguguaccggaaggagaccgaggaggugaccgacgucgagcucugccugaccuucagcgacaagacguacugcaccaaccugaacccgaucacccccaucaucaccgaccucuucgaggugcaguucaagacgguggagaccuacucccugccccgcaucgucgcgauccagaaccacgaggugaagaucggccagaucaacgaccuggggguguacagcaagggcugcggcaacguccagaaggugaacgggaccguguacggcaacgggguccccaaguucgacuaccucugccaccuggccucccggaaggaggugaucgugcgcaagugcuucgacaacgacuaccaggccugcaaguuccugcagaccccggccagcuaccggcucgaggaguccagcggcacggucaccgugaucgacuacaagaagauccuggggaccaucaagaugaaggccauccugggcgacgucaaguacaagaccuucgcggacaacguggacaugaccgccgagggcagcugcgccgggugcaucaacugcuucgagaacauccacugcgagcucacgcugcacaccaccaucgacgccuccugccccgugaccagccccugcacggucuuccacgaccgcauccugaucacccccaacgagcacaaguacgcgaugaaggugaucugcaccgagaagccgggcaacacccucacgaucaagaucugcgggaccaagaucgacgccucccuggcccugaucgacgccaagcccauccucgagcuggcccccguggaccagaccgcguacauccgggagaaggacgagcgcugcaagaccuggaugugccggguccgcgacgagggccuccaggugauccuggagcccuucaagaaccuguucgggagcuacaucggcaucuucuacacguucaucaucugcaucaucgugcugcucaucgucaucuacaucgugcugccgaucugcuucaagcugcgcgacacccuccggcagcacgaggacgccuacaagcgcgagaugaagauccgguga

SEQ ID NO: 12589 - RNA, 4329 nt, Artificial Sequence
  derived and/or modified CDS sequence (opt1) from CHATV(Mohko M07-1)__KF719225.1__GP
augaugaucuucauccugauccucuucgccgugagcgccgcgucccccgucuaccagcgcugcuuccaggacggcgccaucgugaagcagaacccgagcaaggaggccgugaccgaggucugccugaaggacgacguguccaugaucaagaccgaggcccgguacgugaagaacgccacggggaucuacagcaacaacgucgcgauccgcaaguggcugguguccgacuggcacgacugccggccccgcaaggugagcggcgggcacaucaacgucaucgaggugggcgacgaccucucccugcacaccgagagcuacgugugcuccgccgacugcaccaucggggucgacaaggagaccgcccaggugcggcugcagacggacaccaccaaccacuucgagaucgccggcaccacggucaagagcggcugguucaaguccaccaccuacaucacccucgaccagacgugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggucacccugacccuccugaucuucgugcugcucuccauccugagcaagacguacaucugcuaccugcucaugccgaucuucauccccaucgccuacauguacgggaucaucuacaacaaguccugcaagaagugcaagcugugcggccugguguaccaccccuucaccgagugcgggacccacugcgucugcggcgcccgcuacgacaccagcgaccggaugaagcuccaccgcagcuccggccugugccccggguacaagagccugcgggccgcgcgcgugaugugcaaguccaagggcccggccagcauccucuccaucaucacggccauccuggugcugaccuucgucacccccaucaacagcauggugaucggggaguccaaggaggucuucgagcucgaggagcugcccgacgacaugcuggagauggcccucaagaucaaccuguacuacuucgugugcgugaucaacuacgccgucaccuggagccugaucaucguggcgcuccugaucgcccugaucuucaagaaguaccagcaccgguuccucaaccuguacgccauguacugcgaggagugcgacauguaccacgaccgcaucggccugaagcggaacggcgacuucacgaacaagugccgccagugcacgugcgggcaguacgaggacgccaccggccucaugacccaccggaagaccuacaacugccuggugcaguacaaguccaaguggauccugaacuuccucaucaccuacaugguccugacccugaucaaggacagcgccaucaucgugcaggcggccgggaccgacuucuccgccugccucgaggcccagagcguggacuggaacugcacgggccccuuccugaaccuggggaacugccagaagcagcagaagaaggaguccuacgccaacaucgcgacccagcucaagggccugcaggccaucagcguccuggacgugccgaugaucgccaacauccccgaggacaucgccggcgcgcugcgcuacaucgaggagaaggacaccuuccacgugcagcucaccgccgaguacgccaugcugacgcgguacugcgacuacuacacccaguucgccgacaacuccggguacagccagaccaccuggcgcgucuaccugcggucccacgacuucgacgccugcauccucuaccccaaccagcacuucugccgcugcgugaagcacggcgacaagugcgggagcuccaaccgcgacuucgcgaacgagaugaagaacuacuacagcggcaagcagaacaaguucgacaaggaccugaaccuggcccucauggccgugcaccacgccuuccgggggaccagcuccgccuacaucgcgacgaugcugagcaagaaguccaacaacgaccuggucaccuacaccaacaagaucaaggagaaguuccccggcaacgcccuccugaaggccaucauggacuacaucagcuacaugaagggccuguccgagaugaccaacuucaaguacgacgaguucugggacgaccuccugcacaagccgagccccacgaacgccccgccccugucccgcgacagcgagcccuccuacaacuucaagagcgugaucuccagccgguccgucaagagcugcaagaacgugaagaacguggugugccucagcccccgcagcggggucuccuacgacagcauccuggccugcggcgagcccaacgggcccagcguguacaagaagccguccgacggcaucuuccagagcaacuccgacaagaccauguacugccuggcggacagccacugccucgaggacuucgagguggucucccaggaggagcuggacgccaucaagaaguccaagugcugggugaccgaguaccccaacgugaagcuguccaagcucagcgacgggaucaccuccugccggaugaaggacagcggcaagugcaacgucgccgccaaccgcuggcccaucauccagugcgagaacgacaaguucuacuacuccgagcugcagaacgacuacgacaagacgcaggacaucggccacuucugccugagccccgggugcuccaccauccgguucccgaucaaccagaagcacaucagcaacugcaacuggcaggucucccgcagcuccaucgcgaagaucgacgugcacgacaucgaggacaucgaccaguaccggaaggccaucacccagaagcuccagaccggccugagccuguucaaguacgccaagacgaagaaccucccccacaucaagcccaucuacaaguacaucaccaucgaggggaccgagaccgccgagggcaucgaguccgccuacaucgagagcgagaucccggcgcuggccggcacgagcaucggguucaagaucaacuccaaggagggcaagcaccuccuggacaucgugggguacgucaagagcgccuccuacagcuccguguacaccaagcuguacagcaccggccccaccuccgggaucaacacgaagcacgacgagcugugcaccggccccugccccgugaacaucaaccaccagaccggcuggcucaccuucgccaaggagcgcacgagcuccugggggugcgaggaguucggcugccuggccaucagcgacgggugcguguucggcuccugccaggacaucgugcgggacgagcugagcgucuaccgcaaggagaccgaggaggugaccgacguggagcucugccugaccuucuccgacaagacguacugcaccaaccugaacccgaucacccccaucaucaccgaccucuucgagguccaguucaagacgguggagaccuacagccugccccggaucguggcgauccagaaccacgaggucaagaucgggcagaucaacgaccugggcguguacuccaagggcugcgggaacgugcagaaggucaacggcaccguguacgggaacggcgugcccaaguucgacuaccucugccaccuggccagccgcaaggaggucaucgugcggaagugcuucgacaacgacuaccaggccugcaaguuccugcagaccccggccuccuaccgccucgaggagaacagcgggacggugaccgucaucgacuacaagaagauccugggcaccaucaagaugaaggccauccugggcgacgugaaguacaagaccuucgcggacaacgucgacaugaccgccgagggguccugcgccggcugcaucaacugcuucgagaacauccacugcgagcucacgcugcacaccaccaucgacgccagcugccccgugaccagccccugcacgguguuccacgaccggauccugaucacccccaacgagcacaaguacgcgaugaaggucaucugcaccgagaagccggggaacacccucacgaucaagaucugcggcaccaagaucgacgccucccuggcccugaucgacgccaagcccauccucgagcuggcccccguggaccagaccgcguacauccgcgagaaggacgagcggugcaagaccuggaugugccgcgugcgcgacgaggggcugcaggucauccucgagcccuucaagaaccuguucggcagcuacaucggcaucuucuacacguucaucaucugcaugaucgugcugcucaucgugaucuacaucguccugccgaucugcuucaagcugcgggacacccuccgccagcacgaggacgccuacaagcgggagaugaagauccgcuga

SEQ ID NO: 12590 - RNA, 4329 nt, Artificial Sequence
  derived and/or modified CDS sequence (opt1) from CHATV(Mohko M07-2-83)__KF719228.1__GP
augaugaucuucauccugauccucuucgccgugagcgccgcgucccccgucuaccagcgcugcuuccaggacggcgccaucgugaagcagaacccgagcaaggaggccgugaccgaggucugccugaaggacgacguguccaugaucaagaccgaggcccgguacgugaagaacgccacggggaucuacagcaacaacgucgcgauccgcaaguggcugguguccgacuggcacgacugccggccccgcaaggugagcggcgggcacaucaacgucaucgaggugggcgacgaccucucccugcacaccgagagcuacgugugcuccgccgacugcaccaucggggucgacaaggagaccgcccaggugcggcugcagacggacaccaccaaccacuucgagaucgccggcaccacggucaagagcggcugguucaaguccaccaccuacaucacccucgaccagacgugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggucacccugacccuccugaucuucgugcugcucuccauccugagcaagacguacaucugcuaccugcucaugccgaucuucauccccaucgccuacauguacgggaucaucuacaacaaguccugcaagaagugcaagcugugcggccugguguaccaccccuucaccgagugcgggacccacugcgucugcggcgcccgcuacgacaccagcgaccggaugaagcuccaccgcagcuccggccugugccccggguacaagagccugcgggccgcgcgcgugaugugcaaguccaagggcccggccagcauccucuccaucaucacggccauccuggugcugaccuucgucacccccaucaacagcauggugaucggggaguccaaggaggucuucgagcucgaggagcugcccgacgacaugcuggagauggcccucaagaucaaccuguacuacuucgugugcgugaucaacuacgccgucaccuggagccugaucaucguggcgcuccugaucgcccugaucuucaagaaguaccagcaccgguuccucaaccuguacgccauguacugcgaggagugcgacauguaccacgaccgcaucggccugaagcggaacggcgacuucacgaacaagugccgccagugcacgugcgggcaguacgaggacgccaccggccucaugacccaccggaagaccuacaacugccuggugcaguacaaguccaaguggauccugaacuuccucaucaccuacaugguccugacccugaucaaggacagcgccaucaucgugcaggcggccgggaccgacuucuccgccugccucgaggcccagagcguggacuggaacugcacgggccccuuccugaaccuggggaacugccagaagcagcagaagaaggaguccuacgccaacaucgcgacccagcucaagggccugcaggccaucagcguccuggacgugccgaugaucgccaacauccccgaggacaucgccggcgcgcugcgcuacaucgaggagaaggacaccuuccacgugcagcucaccgccgaguacgccaugcugacgcgguacugcgacuacuacacccaguucgccgacaacuccggguacagccagaccaccuggcgcgucuaccugcggucccacgacuucgacgccugcauccucuaccccaaccagcacuucugccgcugcgugaagcacggcgacaagugcgggagcuccaacugggacuucgcgaacgagaugaagaacuacuacagcggcaagcagaacaaguucgacaaggaccugaaccuggcccucauggccgugcaccacgccuuccgcgggaccagcuccgccuacaucgcgacgaugcugagcaagaaguccaacaacgaccuggucaccuacaccaacaagaucaaggagaaguuccccggcaacgcccuccugaaggccaucauggacuacaucagcuacaugaagggccuguccgagaugaccaacuucaaguacgacgaguucugggacgaccuccugcacaagccgagccccacgaacgccccgccccugucccgggacagcgagcccuccuacaacuucaagagcgugaucuccagccgcuccgucaagagcugcaagaacgugaagaacguggugugccucagcccccggagcggggucuccuacgacagcauccuggccugcggcgagcccaacgggcccagcguguacaagaagccguccgacggcaucuuccagagcaacuccgacaagaccauguacugccuggcggacagccacugccucgaggacuucgagguggucucccaggaggagcuggacgccaucaagaaguccaagugcugggugaccgaguaccccaacgugaagcuguccaagcucagcgacgggaucaccuccugccgcaugaaggacagcggcaagugcaacgucgccgccaaccgguggcccaucauccagugcgagaacgacaaguucuacuacuccgagcugcagaacgacuacgacaagacgcaggacaucggccacuucugccugagccccgggugcuccaccauccgcuucccgaucaaccagaagcacaucagcaacugcaacuggcaggucucccggagcuccaucgcgaagaucgacgugcacgacaucgaggacaucgaccaguaccgcaaggccaucacccagaagcuccagaccggccugagccuguucaaguacgccaagacgaagaaccucccccacaucaagcccaucuacaaguacaucaccaucgaggggaccgagaccgccgagggcaucgaguccgccuacaucgagagcgagaucccggcgcuggccggcacgagcaucggguucaagaucaacuccaaggagggcaagcaccuccuggacaucgugggguacgucaagagcgccuccuacagcuccguguacaccaagcuguacagcaccggccccaccuccgggaucaacacgaagcacgacgagcugugcaccggccccugccccgugaacaucaaccaccagaccggcuggcucaccuucgccaaggagcggacgagcuccugggggugcgaggaguucggcugccuggccaucagcgacgggugcguguucggcuccugccaggacaucgugcgcgacgagcugagcgucuaccggaaggagaccgaggaggugaccgacguggagcucugccugaccuucuccgacaagacguacugcaccaaccugaacccgaucacccccaucaucaccgaccucuucgagguccaguucaagacgguggagaccuacagccugccccgcaucguggcgauccagaaccacgaggucaagaucgggcagaucaacgaccugggcguguacuccaagggcugcgggaacgugcagaaggucaacggcaccguguacgggaacggcgugcccaaguucgacuaccucugccaccuggccagccggaaggaggucaucgugcgcaagugcuucgacaacgacuaccaggccugcaaguuccugcagaccccggccuccuaccggcucgaggagaacagcgggacggugaccgucaucgacuacaagaagauccugggcaccaucaagaugaaggccauccugggcgacgugaaguacaagaccuucgcggacaacgucgacaugaccgccgagggguccugcgccggcugcaucaacugcuucgagaacauccacugcgagcucacgcugcacaccaccaucgacgccagcugccccgugaccagccccugcacgguguuccacgaccgcauccugaucacccccaacgagcacaaguacgcgaugaaggucaucugcaccgagaagccggggaacacccucacgaucaagaucugcggcaccaagaucgacgccucccuggcccugaucgacgccaagcccauccucgagcuggcccccguggaccagaccgcguacauccgggagaaggacgagcgcugcaagaccuggaugugccgggugcgcgacgaggggcugcaggucauccucgagcccuucaagaaccuguucggcagcuacaucggcaucuucuacacguucaucaucugcaugaucgugcugcucaucgugaucuacaucguccugccgaucugcuucaagcugcgcgacacccuccggcagcacgaggacgccuacaagcgcgagaugaagauccgguga

SEQ ID NO: 12591 - RNA, 4326 nt, Artificial Sequence
  derived and/or modified CDS sequence (opt1) from CHATV(LEIV-15854)__HQ734820.1__GP
augaucuucauccugauccucuucgccgugagcgccgcgucccccgucuaccagcgcugcuuccaggacggcgccaucgugaagcagaacccgagcaaggaggccgugaccgaggucugccugaaggacgacguguccaugaucaagaccgaggcccgguacgugaagaacgccacggggaucuacagcaacaacgucgcgauccgcaaguggcugguguccgacuggcacgacugccggccccgcaaggugagcggcgggcacaucaacgucaucgaggugggcgacgaccucucccugcacaccgagagcuacgugugcuccgccgacugcaccaucggggucgacaaggagaccgcccaggugcggcugcagacggacaccaccaaccacuucgagaucgccggcaccacggucaagagcggcugguucaaguccaccaccuacaucacccucgaccagacgugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggucacccugacccuccugaucuucgugcugcucuccauccugagcaagacguacaucugcuaccugcucaugccgaucuucauccccaucgccuacguguacgggaucaucuacaacaaguccugcaagaagugcaagcugugcggccuggucuaccaccccuucaccgagugcgggacccacugcgugugcggcgcccgcuacgacaccagcgaccggaugaagcuccaccgcagcuccggccugugccccggguacaagagccugcgggccgcgcgcgugaugugcaaguccaagggcccggccagcauccucuccaucaucacggccauccugguccugaccuucgugacccccaucaacagcauggucaucggggaguccaaggagguguucgagcucgaggagcugcccgacgacaugcuggagauggcccucaagaucaaccuguacuacuucgugugcgucaugaacuacgccgugaccuggagccuggugaucgucgcgcuccugaucgcccugaucuucaagaaguaccagcaccgguuccucaaccuguacgccauguacugcgaggagugcgacauguaccacgaccgcaucggccugaagcggaacggcgacuucacgaacaagugccgccagugcacgugcgggcaguacgaggacgccaccggccucaugacccaccggaagaccuacaacugccuggugcaguacaaguccaaguggauccugaacuuccucaucaccuacauggugcugacccugaucaaggacagcgccaucaucguccaggcggccgggaccgacuucuccgccugccucgaggcccagagcguggacuggaacugcacgggccccuuccugaaccuggggaacugccagaagcagcagaagaaggaguccuacgccaacaucgcgacccagcucaagggccugcaggccaucagcgugcuggacgucccgaugaucgccaacauccccgaggacaucgccggcgcgcugcgcuacaucgaggagaaggacaccuuccacgugcagcucaccgccgaguacgccaugcugacgcgguacugcgacuacuacacccaguucgccgacaacuccggguacagccagaccaccuggcgcguguaccugcggucccacgacuucgacgccugcauccucuaccccaaccagcacuucugccgcugcgucaagcacggcgacaagugcagcuccagcaacugggacuucgcgaacgagaugaagaacuacuacagcgggaagcagaacaaguucgacaaggaccugaaccuggcccucauggccgugcaccacgccuuccgcggcaccuccagcgccuacaucgcgacgaugcuguccaagaagcugaacaacgaccucaucaccuacaccaacaagaucaaggagaaguuccccgggaacgcccugcugaaggccaucauggacuacaucagcuacaugaagggccucuccgagaugaccaacuucaaguacgacgaguucugggacgaccugcugcacaagccgagccccacgaacgccccgccccucucccgggacagcgagcccuccuacaacuucaagagcgugaucuccagccgcuccgucaagagcugcaagaacgugaagaacguggucugccugagcccccggagcggcgccuccuacgacagcauccuggcgugcggggagcccaacggccccagcguguacaagaagccguccgacgggguguuccagagcaacuccgacaagaccauguacugccucgccgacagccacugccuggaggacuucgaggucgugucccaggaggagcuggacgccaucaagaaguccaagugcugggugaccgaguaccccaacgucaagcucuccaagcugagcgacggcaucaccuccugccgcaugaaggacagcgggaagugcaacguggccgcgaaccgguggcccaucauccagugcgagaacgacaaguucuacuacuccgagcugcagaacgacuacgacaagacgcaggacaucggccacuucugccucagccccggcugcuccaccauccgcuucccgaucaaccagaagcacaucagcaacugcaacuggcaggucucccggagcuccaucgccaagaucgacgugcacgacaucgaggacaucgaccaguaccgcaaggccaucacccagaagcugcagaccgggcugagccucuucaaguacgccaagacgaagaaccugccccacaucaagcccaucuacaaguacaucaccaucgagggcaccgagaccgccgaggggaucgaguccgcguacaucgagagcgagaucccggcccuggccggcacgagcaucggcuucaagaucaacuccaaggaggggaagcaccuccuggacaucgugggcuacgucaagagcgccuccuacagcuccguguacaccaagcuguacagcaccgggcccaccuccggcaucaacacgaagcacgacgagcucugcaccgggcccugccccgugaacaucaaccaccagaccggcuggcugaccuucgccaaggagcggacgagcuccuggggcugcgaggaguucgggugccuggcgaucagcgacggcugcguguucggguccugccaggacaucguccgcgacgagcucagcguguaccggaaggagaccgaggaggugaccgacgucgagcugugccugaccuucuccgacaagacguacugcaccaaccucaacccgaucacccccaucaucaccgaccuguucgaggugcaguucaagacgguggagaccuacagccugccccgcaucgucgccgugcagaaccacgaggugaagaucggccagaucaacgaccucgggaucuacuccaagggcugcggcaacguccagaaggugaacgggaccguguacggcaacgggguccccaaguucgacuaccugugccaccuggccagccggaaggaggugaucgugcgcaagugcuucgacaacgacuaccaggccugcaaguuccuccagaccccggccuccuaccggcuggaggagaacagcggcacggucaccgugaucgacuacaagaagauccuggggaccaucaagaugaaggcgauccucggcgacgucaaguacaagaccuucgccgacaacguggacaugaccgccgagggcuccugcgccgggugcaucaacugcuucgagaacauccacugcgagcugacgcugcacaccaccaucgacgcgagcugccccgugaccagccccugcacggucuuccacgaccgcauccucaucacccccaacgagcacaaguacgccaugaaggugaucugcaccgagaagccgggcaacacccugacgaucaagaucugcuccaccaagaucgacgccagccuggcccucaucgacgccaagcccauccuggagcuggcgcccguggaccagaccgccuacauccgggagaaggacgagcgcugcaagaccuggaugugccggguccgcgacgaggggcuccaggugauccuggagcccuucaagaaccuguucggcuccuacaucgggaucuucuacacguucaucaucugcgugaucguccuccugaucgugaucuacaucgugcugccgaucugcuucaagcuccgcgacacccugcggcagcacgaggacgccuacaagcgcgagaugaagauccgguga

SEQ ID NO: 12592 - RNA, 4326 nt, Artificial Sequence
  derived and/or modified CDS sequence (opt1) from CHATV(LEIV-17756)__EU621834.1__GP
augaucuucauccugauccucuucgccgugagcaccgccucccccgucuaccagcgcugcuuccaggacggcgcgaucgugaagcagaacccgagcaaggaggccgugaccgaggucugccugaaggacgacguguccaugaucaagacggaggcccgguacauccgcaacgccaccgggaccuucagcaacaacguggccauccggaaguggaucgucuccgacuggcacgacugccgccccaagaaggugagcggcgggcacaucaacgugaucgaggucggcgacgaccugucccuccacaccgagagcuacgugugcuccgcggacugcacgaucgggguggacaaggagaccgcccagguccggcugcagaccgacaccacgaaccacuucgagaucgccggcaccaccgucaagagcggcugguucaaguccaccacguacaucacccuggaccagaccugcgagcaccucaaggugagcugcgggcccaaguccgugcaguuccacgccugcuucaaccagcacaugagcugcgugcgcuuccugcaccggaccauccugcccggcuccaucgcgaacagcaucugccagaacaucgagaucaucauccucgugacgcugacccugcucaucuucguccugcuguccauccucagcaagaccuacaucugcuaccugcugaugccgaucuucauccccaucgccuacaucuacgggaucaucuacaacaaguccugcaagaagugcaagcucugcggccugguguaccaccccuucaccgagugcgggacgcacugcgugugcggcgcccgcuacgacaccagcgaccggaugaagcugcaccgcagcuccggccucugccccggguacaagagccugcgggccgcccgcgucaugugcaaguccaagggcccggcgagcauccuguccaucaucaccgccauccucgugcugaccuucgugacgcccaucaacagcauggucgugggggaguccaaggaggucuucgagcuggaggagcuccccgacgacaugcuggagauggcccugaagaucaacuucuacuacuucgugugcgugaugaacuacgccgucaccuggggccucaucgugguggcccugcugaucggccucaucuucaagaaguaccagcaccgguuccugaaccuguacgcgauguacugcgaggagugcgacauguaccacgaccgcaccgggcucaagcggaacggcgacuucaccaacaagugccgccagugcacgugcgggcaguacgaggacgccaccggccugaugacccaccggaagaccuacaacugccugguccaguacaagagcaaguggauccucaacuuccugaucacguacauggugcugacccucaucaaggacuccgccaucgugguccaggccaccgggaccgacuucagcuccugccuggagacgcagagcgugaacuggaacugcaccggccccuuccugaaccucggcaacugccagaagcagcagaagaaggaguccuacgccaacaucgcgacccagcugaaggggcugcaggccaucagcgugcucgacaugccgaugaucgccuccauccccgaggacaucgccggcgcccugcgcuacaucgaggagcgggagaccuuccacguccagcugaccgcggaguacgccaugcugacgcgcuacugcgacuacuacacccaguucgccgacaacagcggguacucccagaccaccuggcggguguaccuccgcagccacgacuucgacgccugcauccuguaccccaaccagcacuucugccgcugcgugaagcacggcgacaagugcuccagcagcaacugggacuucgcgaacgagaugaagaacuacuacuccgggaagcagaacaaguucgacaaggaccugaaccucgcccugaugacgaugcaccacgccuuccggggcaccagcuccgccuacaucgccgcgcugcucagcaagcgcuccaacgacgaccuggucgccuacaccaacaagaucaaggagaaguuccccggcaacgcccugcucaaggccgugauggacuacaucagcuacaugaagucccugagcgagauguccaacuucaaguacgacgaguucugggacgaccugcuccacaagccgaaccccaccaaggcccccagccugucccgcggggacgagcccgcguacaacuucaagcuggccaucagcucccggagcaugaaguccugcaagaacgucaagagcguggugugccucuccccgcggagcggcgugagcuacgacuccauccuggccugcggggagcccaacgcccccagcguccaccgcaagcccuccgacggcguguuccagagcaacuccgacaagacgauguacugccuggccgacagccacugccucgaggacuucgagguggucucccaggaggagcuggacgcgaucaagaaguccgagugcugggugaccgaguacccgaacgugaagcugagcaagcucagcgacgggaucaaguccugccggaugaaggacagcggcaagugcaacgucgccaccaaccgcuggcccaucauccagugcgagaacgacaaguucuacuacuccgagcugcagaacgacuacgacaagacccaggacaucggccacuucugccugagccccgggugcuccacgauccgguuccccaucaaccagaagcacaucagcaacugcaacuggcaggucucccgcagcuccaucgccaagaucgacgugcacaacaucgaggacaucgagcaguaccggaaggccaucacccagaagcuccagaccagccugagccuguucaaguacgcgcgcaccaagaaccucccgcacaucaagcccaucuacaaguacaucacgaucgagggcaccgagaccgccgaggggaucgaguccgccuacaucgagagcgagauccccgcccuggccggcaccuccaucggcuucaagaucaacagcaaggaggggaagcaccuccuggacgugaucggcuacgugaaguccgcgagcuacuccagcguguacacgaagcuguacuccaccgggccgaccagcggcaucaacaccaagcacgacgagcugugcacggggcccugccccgccaacaucaagcaccagaccggcuggcucaccuucgcccgggagcgcaccuccagcuggggcugcgaggaguucgggugccuggccaucuccgacggcugcgucuucgggagcugccaggacaucgugcgggacgagcuguccguguaccgcaaggagacggaggaggucaccgacguggagcucugccugaccuucagcgacaagaccuacugcacgaaccugaaccccaucaccccgaucaucaccgaccucuucgaggugcaguucaagaccgucgagacguacucccugccccggaucguggccauccagaaccacgagaucaagaucggccagaucaacgaccuggggguguacagcaagggcugcggcaacguccagaaggugaacgggaccguguacggcaacgggguccccaaguucgacuaccucugccaccuggcgucccgcaaggaggugaucgugcggaagugcuucgacaacgacuaccaggccugcaaguuccugcagacccccgccagcuaccgccucgaggagaacagcggcaccgucaccgugaucgacuacaagaagauccuggggacgaucaagaugaaggccauccugggcgacgugaaguacaagaccuucgccgacaacgucgacaucaccgcggagggcuccugcaccgggugcaucaacugcuucgagaacauccacugcgagcucacgauccacaccaccaucgacgccagcugcccggugaccucccccugcacggucuuccacgaccgcauccuggugacccccaacgagcacaaguacgccaugaaggugaucugcaccgagaagcccggcagcacccuggccaucaagaucugcaacacgaagaucgacgcgucccucgcccugaucgacgccaagccgauccuggagcucgcccccgucgaccagaccgccuacauccgggagaaggacgagcgcugcaagaccuggaugugccgggugcgcgacgaggggcuccaggugauccuggagcccuucaagaaccuguucggcagcuacaucgggaucuucuacaccuucgucaucuccaucaucgcgcugcugaucgugaucuacaucauccuccccaucugcuucaagcugcgggacacgcugcgcaagcacgaggacgccuacaagcgggagaugaagauccgcuga

SEQ ID NO: 12593 - RNA, 4326 nt, Artificial Sequence
  derived and/or modified CDS sequence (opt1) from CHATV(LEIV-18733)__HQ734821.1__GP
augaucuucauccuggugcuccuggccgucagcaccgccucccccguguaccagcgcugcuuccaggacggcgcgaucgugaagcagaacccgagcaaggaggccgucaccgaggugugccugaaggacgacguguccaugaucaagacggaggcccgguacaugaagaacgccaccgggaccuucagcaacaacgucgccauccgcaaguggcucguguccgacuggcacgacugccggcccaagaaggugagcggcgggcacaucaacgucaucgaggugggcgacgaccugucccugcacaccgagagcuacgugugcuccgcggacugcacgaucggggucgacaaggagaccgcccaggugcgccuccagaccgacaccacgaaccacuucgagaucgccggcaccaccgucaagagcggcugguucaaguccaccacguacaucacccuggaccagaccugcgagcaccugaaggugagcugcgggcccaaguccgugcaguuccacgccugcuucaaccagcacaugagcugcgugcgguuccuccaccgcaccguccugcccggcuccaucgcgaacagcaucugccagaacaucgagaucaucauccuggugacgcucacccugcugaucuucgugcuccuguccauccugagcaagaccuacaucugcuaccuccugaugccgaucuucauccccaucgccuacgucuacgggaucaucuacaacaaguccugcaagaagugcaagcugugcggccucguguaccaccccuucaccgagugcgggacgcacugcgugugcggcgcccgguacgacaccagcgaccgcaugaagcugcaccggagcuccggccugugccccggguacaagagccuccgcgccgcccgggucaugugcaaguccaagggcccggcgagcauccuguccaucaucaccgccauccuggugcucaccuucgucacgcccaucaacagcauggugaucggggaguccaaggagguguucgagcuggaggagcugcccgacgacaugcucgagauggcccugaagaucaacuucuacuacuucgucugcgugaucaacuacgccgugaccuggggccugaucgucguggcccuccugaucggccugguguucaagaaguaccagcaccgcuuccucaaccuguacgcgauguacugcgaggagugcgacauguaccacgaccggaccgggcugaagcgcaacggcgacuucaccaacaagugccggcagugcacgugcgggcaguacgaggacgccaccggccucaucacccaccgcaagaccuacaacugccuggucaaguacaagagcaaguggauccugaacuuccucaucacguacauggugcugacccugaucaaggacuccgccaucgugguccaggccgccgggaccgacuucagcgcgugccucgaggcccaguccguggacuggaacugcaccggccccuuccugaaccugggcaacugccagaagcagcagaagaaggagagcuacgccaacaucgccacgcagcucaaggggcugcaggccaucuccgugcuggacaugccgaugaucgcgagcauccccgaggacaucgccggcgcccugcgguacaucgaggagaaggagaccuuccacguccagcucaccgccgaguacgcgaugcugacccgcuacugcgacuacuacacccaguucgccgacaacuccggguacagccagacgaccuggcggguguaccugcgcucccacgacuucgacgccugcauccucuaccccaaccagcacuucugccggugcgugaagcacggcgacaagugcagcuccagcaacugggacuucgccaacgagaugaagaacuacuacagcgggaagcaguccaaguucgacaaggaccugaaccuggcccucaugaccguccaccacgcguuccgcggcaccagcuccgccuacaucgccacgaugcugagcaagaaguccaacaacgaccugguggccuacaccaacaagaucaaggagaaguuccccggcaacgcccuccugaaggcggugauggacuacaucagcuacaugaagucccugagcgagaugaccaacuucaaguacgacgaguucugggacgaccuccuguaccgcccgaaccccaccaaggcccccucccugagccgggaguccgagacgagcuacaacuucaagcucgucaucucccccaagagcaugaaguccugcaagaacgucaagagcguggugugccuguccccgcgcagcggggccagcuacgacuccauccuggccugcggcgagcccaacgggcccagcguguaccggaagcccuccggcgggguguuccagagcaacuccgacaagaccauguacugccucgccgacagccacugccuggaggacuucgaggucaucggccaggaggagcuggacgcgaucaagaaguccgugugcugggccguggaguacccggacgucacccucagcaagcuguccgacggcgucaagagcugccgcaugaaggacuccgggaagugcaacguggccgccaaccgguggcccaucauccagugcgagaacgacaaguucuacuacagcgagcugcagaacgacuacgacaagacccaggacaucggccacuucugccucucccccgggugcagcacggugcgcuuccccaucaaccagaagcacaucuccaacugcaacuggcaggucagccgguccagcaucgcgaagaucgacgugcacgacaucgaggacaucgaccaguaccgcaaggccaucacccagaagcugcagaccucccugagccucuucaaguacgccaagaccaagaaccugccgcacaucaagcccaucuacaaguacaucacgaucgagggcaccgagaccgccgagggcaucgagagcgccuacaucgaguccgagauccccgcgcuggccgggaccagcgugggcuucaagaucaacuccaaggaggggaagcaccuccuggacaucaucggcuacgucaagagcgccuccuacagcuccguguacacgaagcuguacagcaccgggccgaccuccggcaucaacaccaagcacgacgagcucugcacgggccccugccccgccaacaucaaccaccagaacggguggcugaccuucgccaaggagcggaccagcuccuggggcugcgaggaguucgggugccuggcgaucagcgacggcugcguguucggguccugccaggacaucgugcgcgacgagcucagcguguaccggaaggagaccgaggaggucacggacguggagcugugccugaccuucuccgacaagaccuacugcaccaaccucaaccccaucacgccgaucaucaccgaccuguucgaggugcaguucaagaccgucgagaccuacagccugccccgcaucguggccauccagaaccacgagaucaagaucggccagaucaacgaccucggcguguacuccaaggggugcggcaacguccagaaggugaacgggacgguguacggcaacgggguccccaaguucgacuaccugugccaccuggccagccggaaggaggugaucguccgcaagugcuucgacaacgacuaccaggccugcaaguuccuccagacccccgccuccuaccggcuggaggagaacagcggcaccaucaccgugaucgacuacaagaagauccugggcaccaucaagaugaaggcgauccucggggacgugaaguacaagacguucgccgacaacgucgacaucaccguggagggcagcugcgccgggugcaucaacugcuucgagaacauccacugcgagcugaccauccacaccacgaucgaggccuccugcccggugaccagccccugcaccgucuuccacgaccgcauccugaucacccccaacgagcacaaguacgcgaugaagguggugugcacggagaagcccggcaacacccucacccugaaggucugcaacaccaagguggacgccucccuggcccucaucgacgccaagccgauccuggagcuggcccccguggaccagacggcguacauccgggagaaggacgagcgcugcaagaccuggaugugccggguccgcgacgaggggcuccaggugauccuggagcccuucaagaaccuguucggcagcuacaucggcaucuucuacaccaucaucaucuccaucaucgugcuccugaucgucaucuacaucauccugcccgugugcuucaagcuccgcgacacccugcggcagcacgaggacgccuacaagcgcgagaugaaggugcgguga

SEQ ID NO: 12594 - RNA, 4326 nt, Artificial Sequence
  derived and/or modified CDS sequence (opt1) from CHATV(LEIV-22712)__HQ734822.1__GP
augaucuucauccugauccucuucgccgugagcgccgcgucccccgucuaccagcgcugcuuccaggacggcgccaucgugaagcagaacccgagcaaggaggccgugaccgaggucugccugaaggacgacguguccaugaucaagaccgaggcccgguacacgaagaacgccaccgggaccuucagcaacaacguggcgauccgcaaguggcuggucuccgacuggcacgacugccggcccaagaaggugagcggcgggcacaucaacgugaucgaggucggcgacgaccucucccugcacaccgagagcuacgugugcuccgccgacugcacgaucgggguggacaaggagaccgcccagauccgccugcagaccgacaccacgaaccacuucgagaucgccggcaccaccgucaagagcggcugguucaaguccaccacguacaucacccucgaccagaccugcgagcaccugaaggugagcugcgggcccaaguccgugcaguuccacgcgugcuucaaccagcacaugagcugcguccgguuccugcaccgcaccgugcuccccggcuccaucgccaacagcaucugccagaacaucgagaucaucauccuggugacgcugacccuccugaucuucguccugcucuccauccugagcaagaccuacaucugcuaccugcucaugccgaucuucauccccaucgccuacguguacgggaucaucuacaacaaguccugcaagaagugcaagcugugcggccugguguaccaccccuucaccgagugcgggacgcacugcgucugcggcgcccgguacgacaccagcgaccgcaugaagcuccaccggagcuccggccugugccccggguacaagagccugcgcgccgcgcgggugaugugcaaguccaagggcccggccagcgugcucuccaucaucaccgccauccugguccugaccuucgugacgcccaucaacagcauggucgugggggaguccaaggagguguucgagcucgaggagcugcccgacgacaugcuggagauggcccucaagaucaacuucuacuacuucaucugcgucaugaacuacgccgugaccuggggccugaucguggucggccugcucaucgggcugguguucaagaaguaccagcaccgcuuccugaaccucuacgcgauguacugcgaggagugcgacauguaccacgaccggaccggccugaagcgcaacggggacuucaccaacaagugccggcagugcacgugcggccaguacgaggacgccaccgggcugaucacccaccgcaagaccuacaacugccucgugcaguacaagagcaaguggauccugaacuuccugaucgccuacaugacgcucacccugaucaaggacuccgccaucaucguccaggccaccggcaccgacuucaucagcugccuggagacgcaguccgugaacuggaacugcaccggccccuuccucaaccuggggaacugccagaagcagcagaagaaggagccguacgcgaacaucgccacccagcugaagggccuccaggccaucagcgugcuggacauccccaugaucgccaacauccccgaggacaucgccggggcgcugcgguacaucgaggagaaggagaccuuccacguccagcugaccgccgaguacgccaugcucacgcgcuacugcgacuacuacacccaguucgccgacaacuccggcuacagccagaccaccuggcggguguaccugcgcucccacgacuucgacgcgugcauccuguaccccaaccagcacuucugccggugcgugaagcacggggacaagugcagcuccagcaacugggacuucgccaacgagaugaagaacuacuacuccggcaagcagagcaaguucgacaaggaccucaaccuggcccugaugacgaugcaccacgccuuccgcggcaccagcuccgccuacaucgcgacccuccugagcaagaagcugaacgacgaccucgccgccuacaccaacaagaucaaggagaaguucccggggaacgcccugcugaaggccaugauggacuacaucuccuacaugaagucccucuccgagauggcgaacuucaaguacgacgaguucugggacgaccugcugcacaagcccgaccccacgaaggcgccccuccugagccgcggcuccgagccggucuacaacuucaagcugguggugagcucccggagcgucaaguccugcaagaacgucaagagcguggugugccucagcccccgcagcgggguguccuacgacagcgugcuggccugcggcgagcccaacgggcccuccgucuaccggaagccgagcgacggcguguuccagagcaacuccgacaagaccaucuacugccuggccgacagccacugccucgaggacuucgaggugaucucccaggaggagcuggacgccaucaagaaguccgagugcugggucaucgaguaccccaacgugaagcugaccaagcccagcgacggcaucaagagcugccgcaugaaggacuccgggaagugcaacguggccaccaaccgguggcccaucauccagugcgagaacaacaacuucuacuacagcgagcuccagaacgacuacgacaagacgcaggacaucggccacuucugccuguccccggggugcagcaccauccgcuaccccaucaaccagaagcacaucuccaacugcaacuggcaggucagccacuccagcaucgccaagaucgacgugcacaacaucgaggacaucgagcaguaccggaaggccaucacccagaagcugcagaccucccucagccuguucaaguacgccaagacgaagaaccugccccacaucaagccgaucuacaaguacaucaccaucgagggcaccgagaccgcggagggcaucgaguccgccuacaucgagagcgagauccccgcccucgccgggacguccaucggcuucaagaucaacagcaaggaggggaagcaccuccuggacgugaucggcuacgucaagagcgccuccuacagcuccguguacagcaagcuguacuccaccgggcccaccagcggcaucaacaccaagcacgacgagcugugcacgggccccugcccggagaacaucaagcaccagaccggguggcugaccuucgcgcgcgagcggaccuccagcuggggcugcgaggaguucgggugccucgccaucuccgacggcugcguguucgggagcugccaggacaucgucaaggacgagcuguccguguaccgcaaggagacggaggaggugaccgacgucgagcugugccucaccuucagcgacaagaccuacugcacgaaccugaaccccaucacccccaucaucaccaaccuguucgaggugcaguucaagaccguggagacguacucccucccccggaucgucgccauccagaaccacgagaucaagaucggccagaucaacgaccugggcguguacagcaaggggugcggcaacgugcagaaggucaacgggaccguguacggcaacggggugccgaaguucgacuaccugugccaccucgccucccgcaaggaggucaucgugcggaagugcuucgacaacgacuaccaggccugcaaguuccugcagacccccgcgagcuaccgccuggaggagaacuccggcgccaucaccgugaucgacuacaagaagauccucggcaccaucaagaugaaggccauccugggggacgucaaguacaagacguucgccgacaacguggacaucaccgccgagggcagcugcaccgggugcaucaacugcuucgagaacauccacugcgagcugaccauccacacgaccaucgaggcguccugccccgucaccagccccugcaccguguuccacgaccggauccucgugacgccgaacgagcacaaguacgccaugaaggucgugugcaccgagaagcccggcagcacccuggugaucaaggucugcaacaccaagaucgacgccucccuggcccucaucgacgcgaagcccauccuggagcuggcccccguggaccagacggccuacauccgcgagaaggacgagcggugcaagaccuggaugugccgcgugcgggacgaggggcuccaggucauccuggagccguucaagaaccuguucggcagcuacaucggcaucuucuacaccuucaucaucuccaucaucgugcuccugaucgugaucuacaucauccugcccaucugcuucaagcuccgcgacacccugcgcaagcacgaggacgccuacaagcgggagaugaagauccgcuga

SEQ ID NO: 12595 - RNA, 4332 nt, Artificial Sequence
  derived and/or modified CDS sequence (opt1) from INKV(KN3641)__U88059.1__GP
auggaggugcugaaccucaucuggcugcugacccucugcagcgccucccccgucuuccagcgcugcuuccaggacggcgccaucgugaagcagaacccgagcaaggaggcggugaccgaggucugccugaaggacgacguguccaugaucaagacggaggccaaguacaucaagaacaccaccgggaccuucgccaacaacaucgccaugcggaaguggcugguggccgacuggcacgacugccgcccccagaaguccuccggcgggcacaucaacgucaucgaggugggcgacgaccucagccugcacacggaguccuacaucugcagcgcggacugcgugaucaccgucgacaaggagaccgcccagauccggcugcagaccgacaacacgaaccacuucgagguggccgggaccaccgugaaguccggcugguucaagagcaccacguacaucacccucgaccagaccugcgagcaccugaaggucuccugcggccccaagagcauccaguuccacgccugcuucaaccagcacauguccugcgugcgcuuccugcaccggaccauccuccccgggagcaucgcgaacuccaucugccagaacaucgagaucaucauccuggugacgcugagccucgucaucuucaucuuccugaccaucguguccaagaccuacgugugcuaccugcucaugccgaucuucauccccaucgccuacaucuacggcuggaucuacaacaagagcugcaagaagugccgccugugcgggcuggucuaccaccccuucaccgagugcggcacgcacugcgugugcggggcccgguacgagaccuccgaccgcaugaagcuccaccgggccagcggccugugccccggcuacaagaaccugcgcgccgcgcgggugaugugcaagagcaaggggccggccuccguccucagcaucaugaccgccgugcugauccugaccuucgugacgcccaucuccgccauggucaucggcgagagcuccgagguguacacccucggggaccugcccgacgacauggucgagauggccgagcgcgugaacaucuacuaccagaucaucaucaucaacuacagcaucaccuggguguuccugcuccugggccugaucaucgcguacuucuuccggaaguaccagcaccgcuuccucuccuucuacgccauguacugcaaggagugcgacauguaccacgagcgggccggccugaccuacuggggcgacuucacgaacaagugccgccagugcacgugcgggcaguucgaggacgucaccgggcugauggugcacaagaaguccuacaacugcaucaucaaguacaaggccaaguggauccgggacaugcucaucaccuaccugcugaucaugcucaucaaggacagccugcuguucgugggcgccaccgggaccgacuucgcggccugcaucgacgagaagaccgucaccuggaaccgcacgggccccuuccucaaccugggccggugcgacaagagccagaagaagaccggguacaccgacaucgccgaccagcugaagggccucggggccaucuccgugcuggacaucccgaugaucaagaagaugcccgacgagaucagcggcucccugaagugcaucgacgaccucgagacccaccacgagcagcugaccgccgaguacgcguuccugacgcgcuacugcgacuacuacacccaguacaccgacaacagcggguacucccagaccguguggcggacguaccugcgcagccacgacuucggcgccugcgucguguaccccaaccagcacuucugccgcugcgugaagcacggcgacaagugcaacuccgccaagugggacuucgccaacgagaugaagaccuucuacaccgggcagaaggcgaaguucaacaaggaccucaaccuggcccugcucguccugcacaaggccuuccggggcaccgggacgagcuacaucgccgaguccauggcccgcaaggacaaccggagcaugacccacuucgcgcuggagaucaagaagaaguuccccaccaacgcccuccugaccgcccugaucgacuacaucagcuaccuccaguccccggccgagaugagcacguucgagcuggacgaggacugggaggacuucaaguacaagcccgagcccaccgagagcccccagcugcgcagccaccggaccgaccaguacaacuucaagaacgccgacuccaacagcaacgugaaggugugcaagaacauccagaaggucuccugcaucagcccgcgcucccgggcgaaguucgagaacaucaucgccugcggcgagcacgccaaccccagcguguacaccaugcccaacguguccaucuaccagagcaacuccgagcgcagccacuacugcaucgccgacucccacugccucgaggaguacgaggucguggagacggagcugcugaacgcccucaagaaguccaagugcugggcgcgggagauggacgacaucgugcugcacaagcaggucgacgggcugcgcagcugccggaugaaggacaccggcaacugcaacgugcaggagaacgacuggaccaucgugcucugcgagaacggcaacuacuacuacagcgaggcccaccgcgacuacgacaaggaccaggacgucgggcacuucugccugagcccccggugcuccaccauccgcuacccgaucagcaagcggcacaucaagaacugcgacuggcagaucucccacagcacgaucgacaagaucuccgugcaggagcuggccgacaucgagcaguacaagaaggccaucagccagaagcuccagaccucccugagcaucuucaaguacgugaagaccaagaaccugccccacaucaagcccgcguacaaguacaucaccgucgagggcguggagacgguggaggggaucgagaacgccuucaucgaguccgagauccccgcccucgccggcaccgccaucggcuucaagaucaacagccgcgaggggaacuaccugauggacgucaucggcuacgugaaguccgggagcuacuccgcgaccuacaccaagcuguacaucacgggcccgaccaucggggugaacaccaagcacgacgagaagugcaccggccccugccccgccaucaucgaccacaaggagggcuggcucacguucgccaaggggcggaccagcaccuggggcugcgaggaguucgggugccuggccgucuccgacggcugcguguucgggagcugccaggacaucaucaaggacgagcuggccgugcaccgcaagaccacggaggagccgaccaccgucgagcucugccugaccuucuccgacaagaccuacugcacgaaccugaacgcgaucacccccaucaucaccgacaaguucgaggugcaguucaagaccguggagagcuacacgcucccccggaucaucgccaucaagaaccacgagaucaaggucggccagaucaacgaccugggcguguacuccaaggggugcggcaacgugcagaagaucaacgggaccaacuacggcaacgggcugcccaaguucgacuaccucugccaccuggccggccgcaaggaggucaucauccgcaagugcuucgacaacgacuaccaggccugcaaguuccugcagagcccgcccagcuaccggcucgaggagcaccagggcaccgugaccgugaucgacuacaagaagauccuggggacgaucaagauggaggccauccugggcgacgucaaguaccgcaacuaccaguccaacaucgagaucaacgcgaaggggaccugcgccggcugcaucaacugcuucgagaacauccacugcgaguucaccauccacaccacgguggaggccagcugccccaucgugaccgacugggucuccuuccacgaccggauccucaucacccccgacgagcacaaguacgcccugaagguggugugccaggagaagccgaagcugagccucaaguucaagaucugcaacaccaacaucgacgcguccaugacggucguggacagcaagcccauccuggagcuggcccccgucgaccagaccaccuacauccgcgagcgggacgagcgcugcaagaccuggaugugccgggugcgcgacgagggguuccaggugauccucgagcccuucaagaaccuguucggcuccuacaucggcaucuucuacacggggauccugugcaucgucugccuccugaucgugaucuacaucauccugccgaucugcuucaagcuccgggacacccugcgccagcuggaggacgccuacaagaaggaggugaagauccgguga

SEQ ID NO: 12596 - RNA, 4332 nt, Artificial Sequence
  derived and/or modified CDS sequence (opt1) from INKV(SWAR83-161)__U88060.1__GP
auggaggugcugaaccucaucuggcugcugacccucugcagcgccucccccgucuuccagcgcugcuuccaggacggcgccaucgugaagcagaacccgagcaaggaggcggugaccgaggucugccugaaggacgacguguccaugaucaagacggaggccaaguacaucaagaacgccaccgggaccuucgccaacaacaucgccaugcggaaguggcugguggcggacuggcacgacugccgcccccagaaguccuccggcgggcacaucaacgucaucgaggugggcgacgaccucagccugcacaccgaguccuacaucugcagcgccgacugcgugaucacggucgacaaggagaccgcccagauccggcugcagaccgacaacaccaaccacuucgagguggccgggacgaccgugaaguccggcugguucaagagcaccaccuacaucacgcucgaccagaccugcgagcaccugaaggucuccugcggccccaagagcauccaguuccacgcgugcuucaaccagcacauguccugcgugcgcuuccugcaccggaccauccuccccgggagcaucgccaacuccaucugccagaacaucgagaucaucauccuggugacccugagccucgccaucuucaucuuccugacgaucgucuccaagaccuacgugugcuaccugcucaugccgaucuucauccccaucgccuacaucuacggcuggaucuacaacaagagcugcaagaagugcaagcugugcgggcugguguaccaccccuucaccgagugcggcacccacugcgucugcggggcccgcuacgagacguccgaccggaugaagcuccaccgcgcgagcggccugugccccggcuacaagaaccugcgggccgcccgcgugaugugcaagagcaaggggccggccuccgugcucagcaucaugaccgccauccugauccugaccuucgucacccccaucuccgcgauggugaucggcgagagcuccgagguguacacgcucgacgagcugcccgacgacaugguccagauggccgagcgggugaacaucuacuaccagaucaucaucaucaacuacagcaucaccugggccuuccuccuguucgggcugguccuggccuacuucuucaagaaguaccagcaccgcuuccucuccuucuacgccauguacugcaaggagugcgacauguaccacgagcgggcgggccugaccuacuggggcgacuucaccaacaagugccgccagugcacgugcgggcaguucgaggacgugaccggccugauggugcacaagaaguccuacaacugcaucaucaaguacaaggccaaguggauccgggacauccucaucaccuaccugaucaucaugcugaucaaggacucccuccuguucgucggggccaccggcacggacuucgccgccugcaucgacgagaagaccgugaccuggaacugcaccgggcccuuccugaaccucggcaagugcgacaagagccagaagaagaucggcuacgcggacaucgccgaccagcugaaggggcugggcgccaucuccgugcucgacaucccgaugaucaagcgcaugcccgacgagaucagcgggucccugaaguacaucgacggccuggagacguaccacgagcagcucaccgccgaguacgcguuccugacccgguacugcgacuacuacacccaguacaccgacaacagcggguacucccagacggucuggcgcaccuaccugcggagccacgacuucggcgccugcgugguguaccccaaccagcacuucugccgcugcgucaagcacggcgacaagugcaacuccgccaagugggacuucgccaacgagaugaagaccuucuacaccgggcagaaggccaaguucaacaaggaccugaaccucgcgcugcuggugcuccacaaggccuuccggggcacggggaccagcuacaucgccgaguccauggcccgcaaggacaaccgcagcaugacccacuucgcccuggagaucaagaagaaguuccccaccaacgcgcugcucacggcccugaucgacuacaucagcuaccugcagucccucgccgagaugagcaccuucgagcuggacgaggacugggaggacuucaaguacaagccggagcccaccgaggcgccccagcugcggucccaccgcaccgaccaguacaacuucaagaacgccgacagcaacuccaacgugaaggucugcaagaacauccagaaggugagcugcaucagcccccggagccgcgccaaguucgagaacaucaucgccugcggcgagcacgccaacccguccguguacaugaugcccaacgucagcaucuaccaguccaacagcgagcggucccacuacugcaucgccgacagccacugccucgaggaguacgaggugguggaguccgagcugcugaacgcgcucaagaaguccaagugcugggccaaggagauggacgacaucguccugcacaagcagagcgacgggcugcgcagcugccggaugaaggacacgggcaacugcaacgugcaggagaacgacuggaccaucgugcucugcgagaacggcaacuacuacuacagcgaggcccaccgcgacuacgacaaggaccaggacgucgggcacuucugccugagcccccggugcagcaccauccgcuaccccaucaacaagcggcacauccgcaacugcgacuggcagaucucccacagcaccaucgacaagaucuccgugcaggagcuggccgacaucgagcaguacaagaaggccaucagccagaagcuccagacgucccugagcaucuucaaguacgugaagaccaagaaccugccgcacaucaagcccgcguacaaguacaucaccgucgagggcaucgagaccguggaggggaucgagaacgccuucaucgaguccgagauccccgcccucgccggcacggccaucggcuucaagaucaacagccgggaggggaacuaccugauggacgugaucggcuacgucaaguccgcgagcuacuccgccaccuacaccaagcuguacaccacggggcccaccaucggcgugaacaccaagcacgacgagaagugcaccgggccgugcccgcccaucaucgaccacaaggagggcuggcucacguucgccaaggagcgcaccagcaccuggggcugcgaggaguucgggugccuggccguguccgacggcugcgucuucgggagcugccaggacaucaucaaggacgagcuggccguguaccggaagaccacggaggagcucaccaccguggagcugugccugaccuucuccgacaagacguacugcaccaaccucaacgcgaucacccccaucaucaccgacaaguucgagguccaguucaagaccguggagagcuacacgcugccccgcaucaucgccaucaagaaccacgagaucaaggugggccagaucaacgaccugggggucuacuccaagggcugcggcaacgugcagaagaucaacgggaccaacuacggcaacggggugcccaaguucgacuaccucugccaccuggccagccggaaggaggucaucauccgcaagugcuucgacaacgacuaccaggccugcaaguuccugcagagcccgcccuccuaccggcucgaggagcaccagggcaccgugaccgugaucgacuacaagaagauccuggggaucaucaagaugaaggcgauccugggcgacgucaaguacaagaacuaccagagcaacaucgagaucaacgccgagggcacgugcgccgggugcaucaacugcuucgagaacauccacugcgaguucaccauccacaccaccguggaggccuccugccccaucgugacggacugcgucagcuuccacgaccgcauccucaucacccccgacgagcacaaguacgcccugaagguggugugccaggagaagcccaagcugucccucaaguucaagaucugcaacaccaacaucgacgcgagcaugaccaucgucgacuccaagccgauccuggagcuggcccccguggaccagacgaccuacauccgcgagaaggacgagcggugcaagaccuggaugugccgcgugcgggacgagggcuuccaggucauccucgagcccuucaagaaccuguucgggagcuacaucggcaucuucuacaccgggauccugugcaucaucugccuccugaucgugaucuacaucauccugcccaucugcuucaagcuccgcgacacgcugcggcagcacgaggacgccuacaagaaggagaugaagauccgcuga

SEQ ID NO: 12597 - RNA, 4332 nt, Artificial Sequence
  derived and/or modified CDS sequence (opt1) from INKV(Lovanger)__KU681435.1__GP
auggaggugcugaaccucaucuggcugcugacccucugcagcgccucccccgucuuccagcgcugcuuccaggacggcgccaucgugaagcagaacccgagcaaggaggcggugaccgaggucugccugaaggacgacguguccaugaucaagacggaggccaaguacaucaagaacgccaccgggaccuucgccaacaacaucgccaugcggaaguggcugguggcggacuggcacgacugccgcccccagaaguccuccggcgggcacaucaacgucaucgaggugggcgacgaccucagccugcacaccgaguccuacaucugcagcgccgacugcgugaucacggucgacaaggagaccgcccagauccggcugcagaccgacaacaccaaccacuucgagguggccgggacgaccgugaaguccggcugguucaagagcaccaccuacaucacgcucgaccagaccugcgagcaccugaaggucuccugcggccccaagagcauccaguuccacgcgugcuucaaccagcacauguccugcgugcgcuuccugcaccggaccauccuccccgggagcaucgccaacuccaucugccagaacaucgagaucaucauccuggugacccugagccucgccaucuucaucuuccugacgaucgucuccaagaccuacgugugcuaccugcucaugccgaucuucauccccaucgccuacaucuacggcuggaucuacaacaagagcugcaagaagugcaagcugugcgggcugguguaccaccccuucaccgagugcggcacccacugcgucugcggggcccgcuacgagacguccgaccggaugaagcuccaccgcgcgagcggccugugccccggcuacaagagccugcgggccgcccgcgugaugugcaagucccgggggccggccagcgugcucuccaucaugaccgccauccugauccugaccuucgucacccccaucagcgcgauggugaucggcgaguccagcgagguguacacgcucgacgagcugcccgacgacaugguccagauggccgagcgcgugaacaucuacuaccagaucaucaucaucaacuacuccaucaccugggccuuccuccuguucgggcugguccuggccuacuucuucaagaaguaccagcaccgguuccucagcuucuacgccauguacugcaaggagugcgacauguaccacgagcgcgcgggccugaccuacuggggcgacuucaccaacaagugccggcagugcacgugcgggcaguucgaggacgugaccggccugauggugcacaagaaguccuacaacugcaucaucaaguacaaggccaaguggauccgcgacauccucaucaccuaccugaucaucaugcugaucaaggacagccuccuguucgucggggccaccggcacggacuucgccgccugcaucgacgagaagaccgugaccuggaacugcaccgggcccuuccugaaccucggccggugcgacaagucccagaagaagaucggcuacgcggacaucgccgaccagcugaaggggcugggcgccaucagcgugcucgacaucccgaugaucaagcgcaugcccgacgagaucuccgggagccugaaguacaucgacggccuggagacguaccacgagcagcucaccgccgaguacgcguuccugacccgguacugcgacuacuacacccaguacaccgacaacuccggguacagccagacggucuggcgcaccuaccugcggucccacgacuucggcgccugcgugguguaccccaaccagcacuucugccgcugcgucaagcacggcgacaagugcaacagcgccaagugggacuucgccaacgagaugaagaccuucuacaccgggcagaaggccaaguucaacaaggaccugaaccucgcgcugcuggugcuccacaaggccuuccgcggcacggggaccuccuacaucgccgagagcauggcccggaaggacaaccgcagcaugacccacuucgcccuggagaucaagaagaaguuccccaccaacgcgcugcucacggcccugaucgacuacaucuccuaccugcagagccucgccgagauguccaccuucgagcuggacgaggacugggaggacuucaaguacaagccggagcccaccgaggcgccccagcugcggagccaccgcaccgaccaguacaacuucaagaacgccgacuccaacagcaacgugaaggucugcaagaacauccagaagguguccugcaucagcccccggucccgcgccaaguucgagaacaucaucgccugcggcgagcacgccaacccgagcguguacaugaugcccaacgucuccaucuaccagagcaacuccgagcggagccacuacugcaucgccgacucccacugccucgaggaguacgaggugguggagagcgagcugcugaacgcgcucaagaaguccaagugcugggccaaggagauggacgacaucguccugcacaagcaggccgacgggcugcgcagcugccggaugaaggacacgggcaacugcaacgugcaggagaacgacuggaccaucgugcucugcgagaacggcaacuacuacuacagcgaggcccaccgcgacuacgacaaggaccaggacgucgggcacuucugccugagcccccggugcagcaccauccgcuaccccaucaacaagcggcacauccgcaacugcgacuggcagaucucccacagcaccaucgacaagaucuccgugcaggagcuggccgacaucgagcaguacaagaaggcgaucagccagaagcuccagacgucccugagcaucuucaaguacgugaagaccaagaaccugccgcacaucaagcccgccuacaaguacaucaccgucgagggcguggagaccguggaggggaucgagaacgccuucaucgaguccgagauccccgcccucgccggcacggcgaucggcuucaagaucaacagccgggaggggaacuaccugauggacgucaucggcuacgugaaguccgccagcuacuccgccaccuacaccaagcuguacaccacggggcccaccaucggcgugaacaccaagcacgacgagaagugcaccgggccgugcccgcccaucaucgaccacaaggagggcuggcucacguucgccaaggagcgcaccagcaccuggggcugcgaggaguucgggugccuggccgucuccgacggcugcguguucgggagcugccaggacaucaucaaggacgagcugguggucuaccggaagaccacggaggagcucaccaccguggagcugugccugaccuucuccgacaagacguacugcaccaaccucaacgcgaucacccccaucaucaccgacaaguucgaggugcaguucaagaccgucgagagcuacacgcugccccgcaucaucgccaucaagaaccacgagaucaaggugggccagaucaacgaccuggggguguacuccaagggcugcggcaacguccagaagaucaacgggaccaacuacggcaacggguggcccaaguucgacuaccucugccaccuggccagccggaaggaggugaucauccgcaagugcuucgacaacgacuacaaggccugcaaguuccugcagagcccgcccuccuaccgccucgaggagcaccagggcaccgugaccgucaucgacuacaagaagauccuggggacgaucaagaugaaggcgauccugggcgacgugaaguacaagaacuaccagagcaacaucgagaucaacgccgaggggaccugcgccggcugcaucaacugcuucgagaacauccacugcgaguucaccauccacaccacgguggaggccuccugccccaucgucaccgacugcgugagcuuccacgaccggauccucaucacccccgacgagcacaaguacgcccugaagguggucugccaggagaagcccaagcugucccucaaguucaagaucugcaacaccaacaucgacgcgagcaugacgaucguggacuccaagccgauccuggagcuggcccccguggaccagaccaccuacauccgcgagaaggacgagcggugcaagaccuggaugugccgcguccgggacgagggcuuccaggugauccucgagcccuucaagaaccuguucgggagcuacaucggcaucuucuacacggggauccugugcaucaucugccuccugaucaucaucuacaucauccugcccaucugcuucaagcuccgcgacacccugcggcagcacgaggacgccuacaagaaggagaugaagauccgcuga

SEQ ID NO: 12598 - RNA, 4332 nt, Artificial Sequence
  derived and/or modified CDS sequence (opt1) from INKV(Lovanger)__KX554936.1__GP
auggaggugcugaaccucaucuggcugcugacccucugcagcgccucccccgucuuccagcgcugcuuccaggacggcgccaucgugaagcagaacccgagcaaggaggcggugaccgaggucugccugaaggacgacguguccaugaucaagacggaggccaaguacaucaagaacgccaccgggaccuucgccaacaacaucgccaugcggaaguggcugguggcggacuggcacgacugccgcccccagaaguccuccggcgggcacaucaacgucaucgaggugggcgacgaccucagccugcacaccgaguccuacaucugcagcgccgacugcgugaucacggucgacaaggagaccgcccagauccggcugcagaccgacaacaccaaccacuucgagguggccgggacgaccgugaaguccggcugguucaagagcaccaccuacaucacgcucgaccagaccugcgagcaccugaaggucuccugcggccccaagagcauccaguuccacgcgugcuucaaccagcacauguccugcgugcgcuuccugcaccggaccauccuccccgggagcaucgccaacuccaucugccagaacaucgagaucaucauccuggugacccugagccucgccaucuucaucuuccugacgaucgucuccaagaccuacgugugcuaccugcucaugccgaucuucauccccaucgccuacaucuacggcuggaucuacaacaagagcugcaagaagugcaagcugugcgggcugguguaccaccccuucaccgagugcggcacccacugcgucugcggggcccgcuacgagacguccgaccggaugaagcuccaccgcgcgagcggccugugccccggcuacaagagccugcgggccgcccgcgugaugugcaagucccgggggccggccagcgugcucuccaucaugaccgccauccugauccugaccuucgucacccccaucagcgcgauggugaucggcgaguccagcgagguguacacgcucgacgagcugcccgacgacaugguccagauggccgagcgcgugaacaucuacuaccagaucaucaucaucaacuacgggaucaccugggccuuccuccuguucggccugguccuggccuacuucuucaagaaguaccagcaccgguuccucuccuucuacgccauguacugcaaggagugcgacauguaccacgagcgcgcgggccugaccuacuggggcgacuucaccaacaagugccggcagugcacgugcgggcaguucgaggacgugaccgggcugauggugcacaagaaguccuacaacugcaucaucaaguacaaggccaaguggauccgcgacauccucaucaccuaccugaucaucaugcugaucaaggacagccuccuguucgucggcgccaccgggacggacuucgccgccugcaucgacgagaagaccgugaccuggaacugcaccggccccuuccugaaccucggccggugcgacaagagccagaagaagaucggguacgcggacaucgccgaccagcugaagggccugggggccaucuccgugcucgacaucccgaugaucaagcgcauccccgacgagaucagcggcucccugaaguacaucgacgggcuggagacguaccacgagcagcucaccgccgaguacgcguuccugacccgguacugcgacuacuacacccaguacaccgacaacagcggcuacucccagacggucuggcgcaccuaccugcggagccacgacuucggcgccugcgugguguaccccaaccagcacuucugccgcugcgucaagcacggggacaagugcaacuccgccaagugggacuucgccaacgagaugaagaccuucuacaccggccagaaggccaaguucaacaaggaccugaaccucgcgcugcuggugcuccacaaggccuuccgcgggacgggcaccagcuacaucgccgaguccauggcccggaaggacaaccgcagcaugacccacuucgcccuggagaucaagaagaaguuccccaccaacgcgcugcucacggcccugaucgacuacaucagcuaccugcagucccucgccgagaugagcaccuucgagcuggacgaggacugggaggacuucaaguacaagccggagcccaccgaggcgccccagcugcggucccaccgcaccgaccaguacaaccucaagaacgccgacagcaacuccaacgugaaggucugcaagaacauccagaaggugagcugcaucagcccccggagccgcgccaaguucgagaacaucaucgccugcggggagcacgccaacccguccguguacaugaugcccaacgucagcaucuaccaguccaacagcgagcggucccacuacugcaucgccgacagccacugccuggaggaguacgaggugguggaguccgagcugcucaacgcgcugaagaaguccaagugcugggccaaggagauggacgacaucguccugcacaagcaggccgacggccuccgcagcugccggaugaaggacacgggcaacugcaacgugcaggagaacgacuggaccaucgugcugugcgagaacgggaacuacuacuacagcgaggcccaccgcgacuacgacaaggaccaggacgucggccacuucugccugagcccccggugcuccaccauccgcuaccccaucaacaagcggcacauccgcaacugcgacuggcagaucagccacuccaccaucgacaagaucagcgugcaggagcucgccgacaucgagcaguacaagaaggcgaucucccagaagcugcagacgagccuguccaucuucaaguacgugaagaccaagaaccucccgcacaucaagcccgccuacaaguacaucaccgucgaggggguggagaccguggagggcaucgagaacgccuucaucgagagcgagauccccgcccuggccggcacggcgaucggguucaagaucaacucccgggagggcaacuaccugauggacgucaucggguacgucaagagcgccuccuacagcgccaccuacaccaagcucuacaccacgggccccaccaucggggugaacaccaagcacgacgagaagugcaccggcccgugcccgcccaucaucgaccacaaggagggcuggcugacguucgccaaggagcgcaccuccaccugggggugcgaggaguucggcugccuggccgugagcgacgggugcguguucggcuccugccaggacaucaucaaggacgagcucgcgguguaccggaagaccacggaggagcugaccaccgucgagcugugccucaccuucagcgacaagacguacugcaccaaccugaacgccaucacccccaucaucaccgacaaguucgaggugcaguucaagaccguggaguccuacacgcugccccgcaucaucgccaucaagaaccacgagaucaaggucgggcagaucaacgaccucggcguguacagcaagggcugcgggaacgugcagaagaucaacggcaccaacuacgggaacggccugcccaaguucgacuaccugugccaccucgccucccggaaggaggucaucauccgcaagugcuucgacaacgacuaccaggcgugcaaguuccugcagagcccgcccagcuaccgccuggaggagcaccaggggaccgugaccgugaucgacuacaagaagauccucggcacgaucaagaugaaggccauccugggcgacgucaaguacaagaacuaccaguccaacaucgagaucaacgccgaggggaccugcgccggcugcaucaacugcuucgagaacauccacugcgaguucaccauccacaccacgguggaggccagcugccccaucgugaccgacugcgucuccuuccacgaccggauccugaucacccccgacgagcacaaguacgcgcucaagguggugugccaggagaagcccaagcugagccugaaguucaagaucugcaacaccaacaucgacgccuccaugacgaucgucgacagcaagccgauccucgagcuggcccccguggaccagaccaccuacauccgcgagaaggacgagcggugcaagaccuggaugugccgcgugcgggacgagggguuccaggucauccuggagcccuucaagaaccucuucggcuccuacaucgggaucuucuacacgggcauccugugcaucaucugccugcucaucgugaucuacaucauccugcccaucugcuucaagcugcgcgacacccuccggcagcacgaggacgccuacaagaaggagaugaagauccgcuga

SEQ ID NO: 12599 - RNA, 4335 nt, Artificial Sequence
  derived and/or modified CDS sequence (opt1) from JSV__AF123487.1__GP
auggaggugcugaaccucaucuggcugcuggcccucugcagcgccucccccgucuuccagcgcugcuuccaggacggcgcgaucgugaagcagaacccgagcaaggaggccgugaccgaggucugccugaaggacgacguguccaugaucaagaccgaggccaaguacgugaagaacacgaccgggaccuucgccaacaacaucgccaugcggaaguggcuggucgcggacuggcacgacugccgcccccagaaguccuccggcgggcacaucaacgugaucgaggugggcgacgaccucagccugcacaccgaguccuacaucugcagcgccgacugcgucaucacgguggacaaggagaccgcccagauccggcugcagaccgacaacaccaaccacuucgagguggccgggacgaccgucaaguccggcugguucaagagcaccaccuacaucacgcucgaccagaccugcgagcaccugaagguguccugcggccccaagagcauccaguuccacgcgugcuucaaccagcacauguccugcgugcgcuuccugcaccggaccauccuccccgggagcaucgccaacuccaucugccagaacaucgagaucaucauccuggucacccugagccucgugaucuucaucuuccuguccaucgugagcaagacguacgucugcuaccugcucaugccgaucuucauccccaucgccuucaucuacggcuggaucuacaacaaguccugcaagaagugcaagcugugcgggcugguguaccaccccuucaccgagugcggcacccacugcgugugcggggcccgcuacgagaccagcgaccggaugaagcuccaccgcgccagcggccugugccccggcuacaagucccugcgggcggcccgcgucaugugcaagagcaaggggccggccuccauccucagcaucaugacggccauccugauccugaccuucgugacccccaucuccgccauggugaucggcgagagcuccgaggucuacacccucgacgaccugcccgacgacauggugcagauggcggagcgggucaacaucuacuaccagaucaucaucaucaacuacggggugacgugggccuuccugcuccugggccugauccucgccuacuucuucaagaaguaccagcacaaguuccuggacuucuacgccauguacugcgaggagugcgacauguaccacgagaaguccggccugacccacuggggcgacuucaccaacaagugccgccagugcacgugcgggcaguucgaggacguggccgggcucaugauccaccgcaagagcuacaacugccuggucaaguacaaggcgcgguggauccgggacauccugaucauguaccucgccaugauccugaucaaggacagccuccuguucgugggcgccuccgggaccgacuucgccgccugcaucgacgagaagguggucaccuggaacugcaccggccccuuccugaaccugggccgcugcgacaagagccagaagaagaccaacuacgaggggaucgcgaaccagcucaagggccugggggugaucuccgugcuggacaucccgaugaucaagaacaugcccgacgagaucagcggcucccucaaguacaucgacagccuggagacguaccacgagcagcugaccgccgaguacgccuuccugacccgguacugcgacuacuacacccaguacacggacaacuccggguacagccgcaccgucuggcggaccuaccuccgcucccacgacuucggcgccugcgugguguaccccaaccaccaccugugccggugcgucaaguacggcgacaagugcaacagcgcgaagugggacuucgccaacgagaugaagaccuucuacaccgggcagaaggugaaguucaacaaggaccugaaccucgcccugcuggugcuccacaaggccuuccgcggcacggggaccgccuacgucgcggaggccauggcccgcaaggacaacggcagcauggcccacuucgcccuggagauccggaagaaguuccccaccaacgcgcugcucgccgcccugaucgacuacaucguguaccugcagucccucgccgagaucgccaccuucgagcuggacgaggacugggaggacuucaaguacaagccggagcccacggagagcacgccccaggcgcgcucccaccggaacgaccaguacaacuucaagaacgccgagagcaacuccaacaccaaggugugcaagaacguccagaaggugcugugcaucagcccccgcuccaaggccaaguucgagaacaucaucgccugcggggagcacgcgaacccgagcguguacaugaugcccaacgucuccaucuaccagagcaacuccgagcggagccacuacugcaucgccgacucccacugccucgagaaguacgaggugguggagaccgagcugcugaacgcccucaagaaguccaagugcugggccaaggagauggacgacaucguccugcacaagcagagcgacggccugcgcagcugccggaucaaggacaccggcaacugcaacgugcaggagaacgacuggaccaucgugcucugcgagaacgggaacuacuacuacuccgagguccacaaggacuacgacaaggaccaggacgugggccacuucugccugagcccccgcugcaccaccauccgguaccccaucagccgccggcacauccgcaagugcgaguggcagaucucccacagcacgaucgacaagaucuccgugcaggagcuggccgacaucgagcaguacaagaaggcgaucagccagaagcuccagaccucccugagcaucuucaaguacguccggaccaagaaccugccgcacaucaagcccgccuacaaguacaucaccguggaggggguggagacgaucgagggcaucgagaacgccuucaucgaguccgagauccccgcccucgccggcaccgcgaucggguucaagaucaacagccgcgagggcaacuaccugauggacgucaucggguacgugaaguccgccagcuacuccgccguguacaccaagcuguacaccacgggccccaccaucgggaucaacaccaagcacgacgagaagugcaccggcccgugccccgccgucaucgaccacaaggacggcuggcucacguucagcaaggagcggaccuccaccugggggugcgaggaguucggcugccuggccgugagcgacgggugcguguucggcuccugccaggacaucaucaaggacgagcuggcggucuaccgcaagaccacggaggagcucaccaccguggagcugugccugaccuucagcgacaagacguacugcaccaaccucaacgccaucacccccaucaucaccgacaaguucgaggugcaguucaagacggucgaguccuacacccugccgcgggugaucgccaucaagaaccacgagaucaagguggggcagaucaacgaccugggcgucuacagcaagggcugcgggaacgugcagaaggugaacggcaccaacuacgggaacggcagcccccgcuucgacuaccucugccaccuggccagccggaaggaggucauccugcgcaagugcuucgacaacgacuaccaggcgugcaaguuccuccagagccccuccagcuaccgccuggaggagcaccaggggaccgugaccgugaucgacuacaagaagauccugggcacgaucaagaugaaggccauccucggcgacgucaucuacaucaacuaccagaacaacaucgagaucaacgccgaggggaccugcgccggcugcaucgacugcuucgagaacauccacugcgaguucaccauccacaccacgguggaggccuccugccccaucaccaccgagugcgucagcuuccacgaccggauccugaucaccccggacgagcacaaguacgcgcugaagaucgugugccacgacaagcccaaggugucccucaaguucaagaucugcaacacgaacgucgacgccgccaugaccaucguggacagcaagcccauccuggagcuggcccccguggaccagaccaccuacauccgcgagaaggacgagcggugcaagacguggaugugccgcguccgggacgagggguuccaggugauccucgagccguucaagaaccuguucggcuccuacaucgggaucuucuacaccggcauccugagcaucaucugccuccugaucguggucuacaucauccugcccaucugcuucaagcuccgcgacacccugcggcagcacgaggacgccuaccgcaaggagaugaagauccgguga

SEQ ID NO: 12600 - RNA, 4335 nt, Artificial Sequence
  derived and/or modified CDS sequence (opt1) from JSV(BFS 4474)__KX817319.1__GP
auggaggugcugaaccucaucuggcugcuggcccucugcagcgccucccccgucuuccagcgcugcuuccaggacggcgcgaucgugaagcagaacccgagcaaggaggccgugaccgaggucugccugaaggacgacguguccaugaucaagaccgaggccaaguacgugaagaacacgaccgggaccuucgccaacaacaucgccaugcggaaguggcuggucgcggacuggcacgacugccgcccccagaaguccuccggcgggcacaucaacgugaucgaggugggcgacgaccucagccugcacaccgaguccuacaucugcagcgccgacugcgucaucacgguggacaaggagaccgcccagauccggcugcagaccgacaacaccaaccacuucgagguggccgggacgaccgucaaguccggcugguucaagagcaccaccuacaucacgcucgaccagaccugcgagcaccugaagguguccugcggccccaagagcauccaguuccacgcgugcuucaaccagcacauguccugcgugcgcuuccugcaccggaccauccuccccgggagcaucgccaacuccaucugccagaacaucgagaucaucauccuggucacccugagccucgugaucuucaucuuccuguccaucgugagcaagacguacgucugcuaccugcucaugccgaucuucauccccaucgccuucaucuacggcuggaucuacaacaaguccugcaagaagugcaagcugugcgggcugguguaccaccccuucaccgagugcggcacccacugcgugugcggggcccgcuacgagaccagcgaccggaugaagcuccaccgcgccagcggccugugccccggcuacaagucccugcgggcggcccgcgucaugugcaagagcaaggggccggccuccauccucagcaucaugacggccauccugauccugaccuucgugacccccaucuccgccauggugaucggcgagagcuccgaggucuacacccucgacgaccugcccgacgacauggugcagauggcggagcgggucaacaucuacuaccagaucaucaucaucaacuacggggugacgugggccuuccugcuccugggccugauccucgccuacuucuucaagaaguaccagcacaaguuccuggacuucuacgccauguacugcgaggagugcgacauguaccacgagaaguccggccugacccacuggggcgacuucaccaacaagugccgccagugcacgugcgggcaguucgaggacguggccgggcucaugauccaccgcaagagcuacaacugccuggucaaguacaaggcgcgguggauccgggacauccugaucauguaccucgccaugauccugaucaaggacagccuccuguucgugggcgccuccgggaccgacuucgccgccugcaucgacgagaagguggucaccuggaacugcaccggccccuuccugaaccugggccgcugcgacaagagccagaagaagaccaacuacgaggggaucgcgaaccagcucaagggccugggggugaucuccgugcuggacaucccgaugaucaagaacaugcccgacgagaucagcggcucccucaaguacaucgacagccuggagacguaccacgagcagcugaccgccgaguacgccuuccugacccgguacugcgacuacuacacccaguacacggacaacuccggguacagcaagaccgucuggcgcaccuaccuccggucccacgacuucggcgccugcgugguguaccccaaccagcacuucugccgcugcgucaaguacggcgacaagugcaacagcgcgaagugggacuucgccaacgagaugaagaccuucuacaccgggcagaaggugaaguucaacaaggaccugaaccuggcccuccuggugcugcacaaggccuuccggggcacggggaccgccuacgucgcggaggccauggcccgcaaggacaacggcagcauggcccacuucgcccucgagauccgcaagaaguuccccaccaacgcgcugcuggccgcccucaucgacuacaucguguaccugcagucccuggccgagaucgccaccuucgagcucgacgaggacugggaggacuucaaguacaagccggagcccacggagagcacgccccaggcgcggucccaccgcaacgaccaguacaacuucaagaacgccgagagcaacuccaacaccaaggugugcaagaacguccagaaggugcugugcaucagcccccgguccaaggccaaguucgagaacaucaucgccugcggggagcacgcgaacccgagcguguacaugaugcccaacgucuccaucuaccagagcaacuccgagcgcagccacuacugcaucgccgacucccacugccuggagaaguacgaggugguggagaccgagcuccugaacgcccugaagaaguccaagugcugggccaaggagauggacgacaucguccuccacaagcagagcgacggccugcggagcugccgcaucaaggacaccggcaacugcaacgugcaggagaacgacuggaccaucgugcugugcgagaacgggaacuacuacuacuccgagguccacaaggacuacgacaaggaccaggacgugggccacuucugccucagcccccggugcaccaccauccgcuaccccaucagccggcgccacauccggaagugcgaguggcagaucucccacagcacgaucgacaagaucuccgugcaggagcuggccgacaucgagcaguacaagaaggcgaucagccagaagcugcagaccucccucagcaucuucaaguacguccgcaccaagaaccugccgcacaucaagcccgccuacaaguacaucaccguggaggggguggagacgaucgagggcaucgagaacgccuucaucgaguccgagauccccgcccuggccggcaccgcgaucggguucaagaucaacagccgggagggcaacuaccucauggacgucaucggguacgugaaguccgccagcuacuccgccguguacaccaagcuguacaccacgggccccaccaucgggaucaacaccaagcacgacgagaagugcaccggcccgugccccgccgucaucgaccacaaggacggcuggcugacguucagcaaggagcgcaccuccaccugggggugcgaggaguucggcugccucgccgugagcgacgggugcguguucggcuccugccaggacaucaucaaggacgagcuggcggucuaccggaagaccacggaggagcugaccaccguggagcucugccugaccuucagcgacaagacguacugcaccaaccugaacgccaucacccccaucaucaccgacaaguucgaggugcaguucaagacggucgaguccuacacccucccgcgcgugaucgccaucaagaaccacgagaucaagguggggcagaucaacgaccugggcgucuacagcaagggcugcgggaacgugcagaaggugaacggcaccaacuacgggaacggcagcccccgguucgacuaccugugccaccucgccagccgcaaggaggucauccugcggaagugcuucgacaacgacuaccaggcgugcaaguuccugcagagccccuccagcuaccgccucgaggagcaccaggggaccgugaccgugaucgacuacaagaagauccugggcacgaucaagaugaaggccauccugggcgacgucaaguacaagaacuaccagaacaacaucgagaucaacgccgaggggaccugcgccggcugcaucgacugcuucgagaacauccacugcgaguucaccauccacaccacgguggaggccuccugccccaucaccaccgagugcgucagcuuccacgaccgcauccucaucaccccggacgagcacaaguacgcgcugaagaucgugugccacgacaagcccaaggugucccugaaguucaagaucugcaacacgaacgucgacgccgccaugaccaucguggacagcaagcccauccucgagcuggcccccguggaccagaccaccuacauccgggagaaggacgagcgcugcaagacguggaugugccggguccgcgacgagggguuccaggugauccuggagccguucaagaaccucuucggcuccuacaucgggaucuucuacaccggcauccugagcaucaucugccugcucaucguggucuacaucauccugcccaucugcuucaagcugcgggacacccuccgccagcacgaggacgccuaccggaaggagaugaagauccgcuga

SEQ ID NO: 12601 - RNA, 4323 nt, Artificial Sequence
  derived and/or modified CDS sequence (opt1) from LUMV__AF123484.1__GP
augauccuggugcuguucuucgucgcccugagcgccgcgggccccguguaccagcgcugcuuccaggacggggccaucgugaagcaguccccgagcaagcaggccgucaccgaggugugccugaaggacgacguguccaugaucaagaccgaggcccgguacuucaagaacacgaccggcaucuacgccaacaacgucgcgauccgcaaguggcucguggccgacuggcacgacugccggcccaagaaggugagcgggggccacaucaacgucaucgaggugggggacgaccugacccugcacaccgaggccuacgugugcaacgccgacugcaucaucggcgucgacaaggagacggcccaggugcgccuccagaccgacaccaccaaccacuucgagaucgcgggcacgaccgugaaguccgggugguucaagagcaccaccuacaucacgcugggccagaccugcgagcaccugaaggucuccugcgggcccaagagcauccaguuccacgccugcuucaaccagcacauguccugcgugcgguuccuccaccgcaccauccugcccggcagcaucgccaacuccgugugccagaacaucgagaucaucauccugaccguccucacgcugcugaucuucacccuccugagcauccuguccaagaccuacaucugcuacauccucaugccgaucuucaucccccuggccuacaucuacgggcugaucuacaacaagagcugcaagaagugcaagcucugcggccugguguaccaccccuucaccgagugcggcacgcacugcgugugcggggcgcgguacgacaccuccgaccgcaugaagcugcaccgggccagcggccucugccccggguacaagucccugcgcgccgcccgggucaugugcaagagcaagggcccggccuccgugcugagcaucaucaccgcggugcucauccugaccuucaucacgcccaucaacgccaugaucgccggcgagacccaggagaccuucaagcuggaggaccuccccgacgacaugcugagcauggccaugaagaucaacauguacuacaucaugugcaugcugaacuacgucgccaccugguccuucaucuucugcgcgcucaucaucgcccugaucuucaagaaguaccagcacaaguuccugagcuacuacgccauguacugccaggagugcgacauguaccacgaccgcuccgggcucaaguacaacggcggguucacgaacaagugccggcagugcacgugcggccaguacgaggacgccaccgggcugauggcccaccgcaagaccuacaacugccugauccaguacaagagcaaguggcucgugaacuuccugaucaccuacaucauccugaugcucaucaaggacuccguccugaucgugcacgcggagggcaccgacuucgagaagugcagcuccgacaucaacaucguguggaacugcaccggccccuuccugagccucgggaacugcgagaagaagcagaagaaggaguccuacaacgacaucgccgcccagcugaagggccuggacgccaucagcguccucgacaucccgaugaucuccaagauccccgaggacaucgcgggggcccugcgguucaucgaggagcagaacagcuaccacgugcagcugaccguggaguacgccaugcugacgcgcuacugcgacuacuacacccaguucuccgacaacagcggcuacucccagaccaccuggcggaccuaccuccgcagccacgacuucgaggccugcauccuguaccccaaccagcacuucugccggugcgucaagcacggggacaagugcucccgcagcaacugggacuucgccaacgagaugaagaacuacuacuccggcaagcagagcaaguacaacaaggaccugaaccucgcgcugaugagcuuccaccacgccuuccggggcacguccagcuucuacaccgccaagcugcuccgcgagaagaagaccgaggagcugaagaacuacaucgacaagauccgcaccgaguaccccgggaacgcccugcucaaggccgugaucgacuacaucaaguacaugaugggccugacggagguguccaacuucaagcacgacgagaugugggacgacuucaucuucgagaacccgagcacccgguccagccugucccgcaacagcgaguccagcuacgacuucaagaccaacaucaacuccgaccccaccaacacgugcaagaacaucaaggcggugaccugccucagccccaaguccggggugagcuucgacuccgugaucgccugcggcgagagcaaccagcccuccaucuaccagaagccgcggaagcaggucuaccagagcaacagcgagcagacccacuucugccugcuggacacccacugccucgagggguacgagacggugggcgaggaggugcuguccgccaucaagaaguccaagugcugggagaccgacuucaccgaguacauccaguucaagcaguccgacggcguccgcagcugccggaugaaggacuccggggagugcaccgugacgaccaacaaguggcccaucauccugugcgagaacaaccgcuacuacuacagcgagcuccacaaggacuacgacaaggaccaggacaucggccacuucugccugagcccccggugcaacaccauccgcuaccccaucaaccagaaccacaucagcaacugcaccuggcagguccggcacaacaacaucgacaagaucgagguccacgagcuggaggaccucgagcaguaccgcaaggccaucacgcagaagcugcagaccucccugacccucuucaaguacagccggaccaagaaccugccgcacaucaagcccaucuacaaguacaucacgaucgaggggaccgagaccgccgagggcaucgaguccgcguacaucgagagcgagauccccgcccuggccggcaccuccaucggguucaagaucacgagcaaguccggcaagcaccuccuggacgugaucagcuacgugaaguccgccagcuacuccgcggucuacaccaagcuguacaccaccgggcccacgaucggcgugaacaccaagcacgacgagcucugcaccgggagcugcccggugaacgucccccacaacaccggcuggcugacguucgcccgcgagcggaccagcuccuggggcugcgaggaguucgggugccuggccaucagcgacggcugcguguucggguccugccaggacaucaucaaggacgagcucaccguguaccgcgaggagaccgaggagaccacgaacgucgagcugugccugaccuucgccgacaagaccuacugcaccaaccucaacgccaucacgcccaucaucaccgaccaguucgaggugcaguucaagaccguggaggcguacagccugccgcggaucaucgccguccgcaaccacgagaucauggugggccagaucaacgacaucgggguguacuccaagggcugcggcaacguccagaagaucaacaacaccaacuacgggaacggcgugcccaaguucgacuaccugugccaccucgccagccggaaggaggugaucauccgcaagugcuucgacaacgacuaccaggccugcaaguuccugcagacgcccgccuccuaccggcuggaggaggagggcgggagcgucaccgugaucgacuacaagaagauccucgggaccaucaagaugaaggcgauccugggcgacgugaaguacaagaccuucgccgacaacgucgacaucacgguggagggcgccugcaccgggugcaucaacugcuucgacaacauccacugcgagcugaccauccacuccaccguggaggccagcugccccaucacguccagcugcaccgucuuccacgaccgcauccucaucaccccgaacgagcacaaguacgccaucaaggugaucugcaacggcaagcccgggaucucccugcccuucaagaucugcaacaccaagguggacgcggccaugacgcugaccgacgccaagcagauccucgagcuggcccccgucgaccagaccaccuacaucaaggagaaggacgagcgcugcaagacguggaugugccgggugcgcgacgagggccuccaggugaucuucgagccguucaagaaccucuucgggagcuacaucggcaucuucuacaccuucgucaucuuccugguggugaucuucaucgucaucuacaucgugcugcccaucugcuucaagcuccgggacacccugcgccagcacgaggacgcguacaagcgggagaugaagauccgcuga

SEQ ID NO: 12602 - RNA, 4323 nt, Artificial Sequence
  derived and/or modified CDS sequence (opt1) from LUMV(SAAr 1881)__KX817325.1__GP
augauccuggugcuguucuucgucgcccugagcgccgcgggccccguguaccagcgcugcuuccaggacggggccaucgugaagcaguccccgagcaagcaggccgucaccgaggugugccugaaggacgacguguccaugaucaagaccgaggcccgguacuucaagaacacgaccggcaucuacgccaacaacgucgcgauccgcaaguggcucguggccgacuggcacgacugccggcccaagaaggugagcgggggccacaucaacgucaucgaggugggggacgaccugacccugcacaccgaggccuacgugugcaacgccgacugcaucaucggcgucgacaaggagacggcccaggugcgccuccagaccgacaccaccaaccacuucgagaucgcgggcacgaccgugaaguccgggugguucaagagcaccaccuacaucacgcuggaccagaccugcgagcaccugaaggucuccugcggccccaagagcauccaguuccacgccugcuucaaccagcacauguccugcgugcgguuccuccaccgcaccauccugcccgggagcaucgccaacuccgugugccagaacaucgagaucaucauccugaccguccucacgcugcugaucuucacccuccugagcauccuguccaagaccuacaucugcuacauccucaugccgaucuucaucccccuggccuacaucuacggccugaucuacaacaagagcugcaagaagugcaagcucugcgggcugguguaccaccccuucaccgagugcggcacgcacugcgugugcggcgcgcgguacgacaccuccgaccgcaugaagcugcaccgggccagcgggcucugccccggcuacaagucccugcgcgccgcccgggucaugugcaagagcaaggggccggccuccgugcugagcaucaucaccgcggugcucauccugaccuucaucacgcccaucaacgccaugaucgccggcgagacccaggagaccuucaagcuggaggaccuccccgacgacaugcugagcauggccaugaagaucaacauguacuacaucaugugcaugcugaacuacgucgccaccugguccuucaucuucugcgcgcucaucaucgcccugaucuucaagaaguaccagcacaaguuccugagcuacuacgccauguacugccaggagugcgacauguaccacgaccgcuccggccucaaguacaacgggggcuucacgaacaagugccggcagugcacgugcgggcaguacgaggacgccaccggccugauggcccaccgcaagaccuacaacugccugauccaguacaagagcaaguggcucgugaacuuccugaucaccuacaucauccugaugcucaucaaggacuccguccugaucgugcacgcggaggggaccgacuucgagaagugcagcuccgacaucaacaucguguggaacugcaccggccccuuccugagccucggcaacugcgagaagaagcagaagaaggaguccuacaacgacaucgccgcccagcugaaggggcuggacgccaucagcguccucgacaucccgaugaucuccaagauccccgaggacaucgcgggcgcccugcgguucaucgaggagcagaacagcuaccacgugcagcugaccguggaguacgccaugcugacgcgcuacugcgacuacuacacccaguucuccgacaacagcggguacucccagaccaccuggcggaccuaccuccgcagccacgacuucgaggccugcauccuguaccccaaccagcacuucugccggugcgucaagcacggcgacaagugcucccgcagcaacugggacuucgccaacgagaugaagaacuacuacuccgggaagcagagcaaguacaacaaggaccugaaccucgcgcugaugagcuuccaccacgccuuccggggcacguccagcuucuacaccgccaagcugcuccgcgagaagaagaccgaggagcugaagaacuacaucgacaagauccgcaccaaguaccccggcaacgcccugcucaaggccgugaucgacuacaucaaguacaugauggggcugacggagguguccaacuucaagcacgacgagaugugggacgacuucaucuucgagaacccgagcacccgguccagccugucccgcaacagcgaguccagcuacgacuucaagaccaacaucaacuccgaccccaccaacacgugcaagaacaucaaggcggugaccugccucagccccaaguccggcgugagcuucgacuccgugaucgccugcggggagagcaaccagcccuccaucuaccagaagccgcggaagcaggucuaccagagcaacagcgagcagacccacuucugccugcuggacacccacugccucgagggcuacgagacggugggggaggaggugcuguccgccaucaagaaguccaagugcugggagaccgacuucaccgaguacauccaguucaagcaguccgacggcguccgcagcugccggaugaaggacuccggcgagugcaccgugacgaccaacaaguggcccaucauccugugcgagaacaaccgcuacuacuacagcgagcuccacaaggacuacgacaaggaccaggacaucgggcacuucugccugagcccccggugcaacaccauccgcuaccccaucaaccagaaccacaucagcaacugcaccuggcagguccggcacaacaacaucgacaagaucgagguccacgagcuggaggaccucgagcaguaccgcaaggccaucacgcagaagcugcagaccucccugacccucuucaaguacagccggaccaagaaccugccgcacaucaagcccaucuacaaguacaucacgaucgagggcaccgagaccgccgaggggaucgaguccgcguacaucgagagcgagauccccgcccuggccggcaccuccaucggcuucaagaucacgagcaaguccgggaagcaccuccuggacgugaucagcuacgugaaguccgccagcuacuccgcggucuacaccaagcuguacaccaccggccccacgaucggggugaacaccaagcacgacgagcucugcaccggcagcugcccggugaacgucccccacaacaccggguggcugacguucgcccgcgagcggaccagcuccuggggcugcgaggaguucggcugccuggccaucagcgacgggugcguguucggcuccugccaggacaucaucaaggacgagcucaccguguaccgcaaggagaccgaggagaccacgaacgucgagcugugccugaccuucgccgacaagaccuacugcaccaaccucaacgccaucacgcccaucaucaccgaccaguucgaggugcaguucaagaccguggaggcguacagccugccgcggaucaucgccguccgcaaccacgagaucaugguggggcagaucaacgacaucggcguguacuccaaggggugcggcaacguccagaagaucaacaacaccaacuacggcaacggggugcccaaguucgacuaccugugccaccucgccagccggaaggaggugaucauccgcaagugcuucgacaacgacuaccaggccugcaaguuccugcagacgcccgccuccuaccggcuggaggaggagggcgggagcgucaccgugaucgacuacaagaagauccucggcaccaucaagaugaaggcgauccugggggacgugaaguacaagaccuucgccgacaacgucgacaucacgguggagggcgccugcaccggcugcaucaacugcuucgacaacauccacugcgagcugaccauccacuccaccguggaggccagcugccccaucacguccagcugcaccgucuuccacgaccgcauccucaucaccccgaacgagcacaaguacgccaucaaggugaucugcaacgggaagcccggcaucucccugcccuucaagaucugcaacaccaagguggacgcggccaugacgcugaccgacgccaagcagauccucgagcuggcccccgucgaccagaccaccuacaucaaggagaaggacgagcgcugcaagacguggaugugccgggugcgcgacgaggggcuccaggugaucuucgagccguucaagaaccucuucggcagcuacaucgggaucuucuacaccuucgucaucuuccugguggugaucuucaucgucaucuacaucgugcugcccaucugcuucaagcuccgggacacccugcgccagcacgaggacgcguacaagcgggagaugaagauccgcuga

SEQ ID NO: 12603 - RNA, 4329 nt, Artificial Sequence
  derived and/or modified CDS sequence (opt1) from MELV__U88057.1__GP
augaucgcccugaucuuccucaucgccaucgcggccgccagccccguguaccagcgcugcuuccaggacggcgggaucgucaagcagaacccguccaaggacgccgugaccgaggugugccugaaggacgacgucagcaugaucaagaccgaggccaaguacaugaagaacgacacgggcaccuucuccaacaacguggcgaugcggaaguggcugguggccgacuggcacgacugccgcccccagaaguccuccgggggccacaucaacgucaucgaggugggggacgaccucagccugcacaccgaggccuacaucugcuccgccgacugcaugaucagcguggacaaggagaccgcgcagauccggcugcagacggacuccaccacccacuucgagaucgccggcaccacggucaagagcggcugguucaaguccaccaccuacaucacccucgaccagacgugcgagcaccugaaggugagcugcgggcccaaguccauccaguuccacgccugcuucaaccagcacaugagcugcgugcgcuuccugcaccggaccauccuccccggcuccaucgccaacagcaucugccagaacaucgagaucaucauccuggucacccugacccuccugaucuucaucuuccuguccauccucagcaagacguacaucugcuacauccugaugccgauguucauccccguggccuacaucuacggguggaucuacaacaaguccugcaagaagugcaagcugugcggccucguguaccaccccuucaccgagugcgggacccacugcgucugcggcgcgcgcuacgagaccagcgaccggaugaagcugcaccgcagcuccggccugugccccggguacaagagccuccgggccgcccgcgugaugugcaaguccaagggcccggccagcauccuguccgugcugacggccguccucauccugaccuucgugacccccaugaacgcgcugacccucgggagcuccgaggagaacuacaagcuggagaaccugcccgacgacaugcucgacauggccgagcggaucgacaucuacuaccugagcaucauccugaacuacuccaucacguggggccucgugauccugcugggccucaccuucauccuguuccgccgguuccagcaccgcuuccugaacugcuacgccauguacugcagcgagugcgacauguaccacgacaagaacgggcucguccggaacggcgacuucaccaacaagugccgccagugcacgugcgggcaguacgaggacgccgccggccugaucauccaccagaaguccuacaacugccugaucaaguacaaggcgaaguggauccggaacauccuccugaccuacaucauccugauccucaucaaggacagcgugcugcugaccuccgccgaggggcccgacuucagcgugugcaucgagcagaaggccaucuccuggaacugcaccggcccguuccucaaccugggccgcugcgagaagacccagaagaaggccagcuacgccacgaucgcgacccagcugcgguccaucgacgccaucagcguccuggacauccccaugaucgccaagauccccgaggacaucuccggggcccucaaguacaucgagagccugaagaccuaccacgagcagcugaccgcggaguacgccaugcucacgcgcuacugcgacuacuacacccaguucagcgacaacuccggcuacagccagaccuccuggcggaaguuccugcgcagccacgacuucgaguccugcaucaucuaccccaaccagcacuucugccgcugcgugaagcaggacgagaagugcagcuccgccaagugggacuucgccagcgagaugaagggguucuaccugaacaagcaggccaaguucaacaaggaccucaaccuggcgcuguccaccuuccacaaggccuuccggggcaccccgaucagcuacgucacggagcucaucuccaagaacaagaacagcucccugcugauguacgugagcgagaucaagcgcaaguuccccgggaacgcccuccugguggcccugcucgacuucaucauguaccugcagucccugagcgagaucuccggcuucgagcucggcgacgagugggaggacuucaaguacgaccccgagcccaccgagccggcccugaugccccggagccaccgcagcgaccaguacaacuucaagaacgcggccuccgucagcaagaccaagaccugcgagaacaucaagcgggugcugugccucagcccccgcagccgggccacguucgacgacguggucgccugcggggaguucgccaaccccuccguguacaugcugccgaacaucaccaucuaccagagcaacaucgagcgcucccacuacugcaucgcggacagccacugccuggaggaguucgagcucgugaagcccgagcugcugaccgcccucaagaaguccacgugcugggccggcgagaucgacgacaucguccugcacaagcagagcgacgggcugcgguccugccgcaucaaggacaccgggaccugcgacgugcucggcaacgaguggaccaucgugcugugcgagaacaacaacuucuacuacagcgagguccaccgggacuacgacaaggaccaggacaucggccacuucugccugagcccccgcugcaacaucauccgguaccccaucaacccgcgccacauccggaccugcaaguggcagaucagccacuccacgaucgacaagaucaccgugcacgagcucgccgacaucgagcaguacaagaaggcgaucacccagaagcugcagaacagccuguccaucuucaaguacaagcgcaccaagaaccucccccacaucaagcccaucuacaaguacaucgccaucgagggcacggagaccguggaggggaucgagaacgccuacaucgagagcgagaucccggcccuggccggcaccgcgaucggguucaagaucaacuccaaggacggcaaccaccugauggacgucaucggcuacgugaaguccgccagcuacuccagcaccuacacgaagcucuacaccaccgggcccaccaucggcaucaacacgaagcacgacgagaagugcaccggguccugccccacccaggugaagcacaagaccggcuggcugacguucgccaaggagcggaccagcaccugggggugcgaggaguucggcugccuggccaucuccgacggcugcgucuucgggagcugccaggacaucaucaaggacgagcucaccguguaccgcaagacgaccgacgaggugaccgagcuggagcugugccucaccuucgccgacaagacguacugcaccaaccugaacgcggucacccccaucaucaccgacaaguucgaggugcaguucaagaccguggaguccuacagccugccgcggaucaucgccgucaagaaccacgagaucaaggugggccagaucaacgacaucgggguguacuccaagggcugcgggaacguccagaaggugaacggcacgagcuacggcaacggggugcccaaguucgacuaccucugccaccuggccucccgcaaggaggucaccauccgcaagugcuucgacaacgacuaccaggccugcaaguuccugcagacccccagcuccuaccggcucgaggagcaccagggcaccgugacgaucaucgacuacaagaagauccuggggagcaucaagaugaaggccauccugggcgacgugaaguacaagaacuacgcguccaacaucgacaucaacgccgaggggagcugcgccggcugcaucaacugcuucgagaacauccacugcgaguucaccauccacuccaccgucgagaccagcugccagaucgaguccgacugcacgagcuuccacgaccgcgugcucaucacccccaacgagcacaaguacgcccugaagcugaucugccacgacaagccggcgagcucccucaaguucaagaucugcaacaccaagguggaggccgccaugacccuggucgacgcccggcccaucaucgagcuggcccccguggaccagacggcguacauccgcgagaaggacgagcggugcaagaccuggaugugccgcgugcgggacgagggcauccaggucaucuucgagcccuucaagaaccucuucgggagcuacaucggcaucuucuacgccaucgugaucugcaucaucgugcuguuccugaucgucuacaucgugcucccgaucugcuucaagcugaaggacacccugaagcagcacgaggacgccuacaagcgcgagaugaagauccgguga

SEQ ID NO: 12604 - RNA, 4326 nt, Artificial Sequence
  derived and/or modified CDS sequence (opt1) from SAV__AF123486.1__GP
augaucccccuccuguuccuggugacccuggucagcgccggcccgguguuccagcgcugcuuccaggacggggccaucgugaagcagaaccccuccaaggaggcggucaccgaggugugcaucaaggacgacgugagcaugaucaagacggaggcccgguacguccgcaacuccagcggcguguucuccaacaacguggcccuccggaaguggcuggucagcgacuggcacgacugcaagcccaagaagguguccgggggccacaucaacgugaucgaggucgggaacgaccugacccuccacaccgagagcuacgugugcuccgccgacugcaccaucggcaucgacaaggagacggcccagauccgccugcagaccgacaccaccaaccacuucgagguggcgggcacgaccgucaagagcgggugguucaaguccaccaccuacaucacgcuggaccagaccugcgagcaccucaaggugagcugcggccccaaguccauccaguuccacgccugcuucaaccagcacaugagcugcgugcgguuccugcaccgcaccauccugccgggguccauggccaacagcaucugccagaacaucgagaucaucauccucaccacgcuggcccugcucaucuuccugcugcucaccauccuguccaagaccuacaucugcuaccugcucaugcccaucuucauccccaucgcgcaccuguacggccugaucuacaacaagagcugcaagaagugccagcucugcgggcuggucuaccaccccuucaccgagugcggcacgcacugcgugugcggcgcccgguacgagaccuccgaccgcaugaagcugcaccgggccagcgggcucugcccgggcuacaagagccugcgcgccgcccgggugaugugcaaguccaaggggcccgcgagcaaccuguccaucaucaccgccguccucacccugacguucgugacccccaucaacggccugaccaucggcgacagcaaggaggugcucaaccccgacgagcugccggacgacaugcuggagauggcccagaagcucaacauguaccagcugaucugcaucaucaacuacaccgccacgugguccaucaucaucaucgggcuggccgucuucuacaucuucaagaaguaccagcaccgcuucuacaacuacuacgcgauguacugccaggagugcgacauguaccacgagcggagcggccucaaguggaacggggacuucaccaacaagugccgccagugcacgugcggcgaguacgaggacgccgccgggcugaucucccaccgcaagagcuacaacugccugcuccaguacaaggugaagugggucaugaacuuccugaccaucuacguggcccugaucauccucaaggacuccacccugaucgugcaggccgcgggcaccgacuucagcgacugcaucgagaccgaggagcugaacuggaacugcaccggccccuuccucaaccuggggaacugcgagaagaagcagaagaaggaguccuacagcaacaucgccgagcagcugaagggccugcaggccaucuccguccucgacaucccccugaucgcccggauccccgaggacaucagcgggggccugcgguacaucgaguccauccgcacgcaccacgcccagcucaccgcggaguacgccaugcugacccgguacugcgacuaccacaagcuguucggggacaacagcggcuacucccagaccaccuggcgcauguaccuccggagccacgacuucggcgccugcauccuguacccgaaccagcacuucugccgcugcgugaagcacggggagaagugcuccagcagcuccugggacuucgccagcgagaugaagaacuacuacuccggcaagcaggggaaguucaacaaggaccugaaccucgcgcugcagagcauccaccacgccuuccgcggcacguccagcuccuacaucgccaccauccugagcgagaagcggaacgaccagcucguggaguacauggagaagcugcgcgagaaguucaucgggaacgcccugcuccgggccguccuggacuucaucaccuacaugaagucccugaccgagaugacgaacuucaagcacgacgaguucugggacgaguucgugcaccuccccgcgcccaccaaggcccccagcaugcgccgguccggcaacgagaacuacgacuucaaggccccgaccagccccgccggcaccaaguccugcaagaacaucaagaacguggucugccugagcccccgcuccggggccagcuacgagggcaucguggcgugcggggagcccuccgccccgcagaucuucaagaugcccagcgagagcaucuaccacaacaacgccgaccaguccauguacugcaucgccgacacgcacugccugcaggacuacagccccguggaggacgaggagcucaacgccaucaagaaguccaagugcugggagaccgaguucaccaacgcgguccccuucaagcagagcgacggcauccgguccugccgcaugcgggacagcggcaacugcaacgugaccacgaaccuguggccggugaugcagugcgacgacgggaaguucuacuacuccgagcaccagaaggacuacgacaaggaccaggacaucggccacuucugccugagcccccgcugcaacaugguccgguuccccaucuccgagaagaacauccucgccugcgacuggaucgugagccacccgaacaucgacaagaucgacgugcacucccuggaggaccuggagcaguacaagaaggccaucacccagaagcuccagaccagccuguccaucuucaaguacgccaagaccaugaaccugccccacgucaagcccaucuacaaguacaucagcaucgaggggacggagaccgcggagggcguggagaacgccuucaucgaguccgagauccccgcccucgccgggaccagcaucggcuucaaggugaacuccaaggacggcaagcacaucauggacaucaucggguacgucaagaccgccagcuacuccagcguguacacgaagcuguacaccaccagcccgaccacgggcgugaacaccaagcacgacgagcugugcaccgggcccugccccaagcagaucgagcacaagaacggcuggaucaccuucuccaaggagcgcacgagcuccugggggugcgaggaguucggcugccucgcgaucagcgacggcugcgucuucggguccugccaggacaucaucaaggacgagaugagcguguaccggaaggagaccgaggagaccaccaucguggagcugugccugacguucuccgacaagaccuacugcgucgagcucaaccccgugaccccgaucaucaccgaccuguucgaggugcaguucaagacggucgagagcuacacccugccccgcaucguggccgugaagaaccacgaggucauggugggccagaucaacgaccucgggguguacuccaagggcugcgggaacguccagaaggugaacggcaccguguacggcaacgggguccccaaguucgacuaccugugccaccuggccagccggaaggaggugaucauccgcaagugcuucgacaacgacuaccaggccugcaaguuccuccagucccccagcuccuaccggcuggaggaggacgccagcaccguguccaucaucgacuacaagaagauccugggcaccaucaagaugaaggcgauccucggggacguccgcuacaagacguucagcgaguccaucgacaucagcgccgaggggaccugcaccggcugcgugaacugcuucgagaacauccacugcgaguucaccauccacuccacgguggaggccagcugcccggucgugagcacgugcacccuguuccacgaccggauccugaucggccccgacaaccacaaguacgccaugaaggugaucugcaccgaggcccccaagaccucccucagcuucaagaucugcaacaccaaggucgacgcggccaucaccaucguggacuccaagcccaucguggagcuggccccggucgaccagaccgccuacauccgcgagaaggacgaccgcugcaagacguggaugugccgggugcgcgacgagggcaugcagguccugagcgagcccuucaagaaccucuucggguccuacaucggcaucuucuacaccgggcuggcggugcugaucaucgcccucaucgccguguacaucgucaugcccaucugcuucaaggugaaggacauccugaagaagcacgacgacgccuaccggcgcgagcugaagauccgguga

SEQ ID NO: 12605 - RNA, 4326 nt, Artificial Sequence
  derived and/or modified CDS sequence (opt1) from SAV(20230)__KX817331.1__GP
augaucccccuccuguuccuggugacccuggucagcgccggcccgguguuccagcgcugcuuccaggacggggccaucgugaagcagaaccccuccaaggaggcggucaccgaggugugcaucaaggacgacgugagcaugaucaagacggaggcccgguacguccgcaacuccagcggcguguucuccaacaacguggcccuccggaaguggcuggucagcgacuggcacgacugcaagcccaagaagguguccgggggccacaucaacgugaucgaggucgggaacgaccugacccuccacaccgagagcuacgugugcuccgccgacugcaccaucggcaucgacaaggagacggcccagauccgccugcagaccgacaccaccaaccacuucgagguggcgggcacgaccgucaagagcgggugguucaaguccaccaccuacaucacgcuggaccagaccugcgagcaccucaaggugagcugcggccccaaguccauccaguuccacgccugcuucaaccagcacaugagcugcgugcgguuccugcaccgcaccauccugccgggguccauggccaacagcaucugccagaacaucgagaucaucauccucaccacgcuggcccugcucaucuuccugcugcucaccauccuguccaagaccuacaucugcuaccugcucaugcccaucuucauccccaucgcguaccuguacggccugaucuacaacaagagcugcaagaagugccagcucugcgggcuggucuaccaccccuucaccgagugcggcacgcacugcgugugcggcgcccgguacgagaccuccgaccgcaugaagcugcaccgggccagcgggcucugcccgggcuacaagagccugcgcgccgcccgggugaugugcaaguccaaggggcccgcgagcauccuguccaucaucaccgccguccucauccugaccuucgugacgcccaucaacggccugaccaucggcgacagcaaggagguguucaaccucgacgagcugcccgacgacaugcuggagauggcccagaagcucaacauguaccagcugaucugcaucaucaacuacaccgccaccugguccaucaucaucaucgggcuggccgucuucuacaucuucaagaaguaccagcaccgcuucuacaacuacuacgcgauguacugccaggagugcgacauguaccacgagcggagcggccucaaguggaacggggacuucacgaacaagugccgccagugcacgugcggcgaguacgaggacgccgccgggcugaucucccacaagaaguccuacaacugccugcuccaguacaaggugaagugggucaugaacuuccugaccaucuacguggcccugaucauccucaaggacagcacccugaucgugcaggccgcgggcaccgacuucagcgacugcaucgagaccgaggagcugaacuggaacugcaccggcccguuccucaaccuggggaacugcgagaagaagcagaagaaggaguccuacagcaacaucgccgagcagcugaagggccugcaggccaucuccguccucgacaucccccugaucgcccggauccccgaggacaucagcgggggccugcgcuacaucgaguccauccggacccaccacgcccagcucacggcggaguacgccaugcugacccgcuacugcgacuacuacaagcuguucggggacaacagcggcuacucccagaccaccuggcggauguaccuccgcagccacgacuucgaggccugcauccuguaccccaaccggcacuucugccgcugcgugaagcacggcgagaagugcuccagcagcuccugggacuucgccagcgagaugaagaacuacuacuccgggaagcagggcaaguucaacaaggaccugaaccucgcgcugcagagcauccaccacgccuuccgcgggaccuccagcuccuacaucgccacgauccugagcgagaagcggaacgaccagcucguggaguacaugaagaagcugcgcgagaaguucaucggcaacgcccugcuccgggccguccuggacuucaucaccuacaugaagucccugaccgagaugaccaacuucaagcacgacgaguucugggacgaguucgugcaccucccggcgcccacgaaggcccccagcaugcgccgguccgggaacgagaacuacgacuucaaggcccccaccagcccggccggcaccaaguccugcaagaacaucaagaacguggucugccugagcccccgcuccggcgccagcuacgaggggaucguggcgugcggcgagcccuccgcgccccagaucuucaagaugccgagcgagagcaucuaccacaacaacgccgaccaguccauguacugcaucgccgacacccacugccugcaggacuacagccccguggaggacgaggagcucaacgccaucaagaaguccaagugcugggagacggaguucaccaacgccguccccuucaagcagagcgacgggauccgguccugccgcaugcgggacagcggcaacugcaacgugaccaccaaccuguggcccgugaugcagugcgacgacggcaaguucuacuacuccgagcaccagaaggacuacgacaaggaccaggacaucgggcacuucugccugagcccgcgcugcaacaugguccgguuccccaucuccgagaagaacauccucgccugcgacuggaucgugagccaccccaacaucgacaagaucgacgugcacucccuggaggaccuggagcaguacaagaaggccaucacgcagaagcuccagaccagccuguccaucuucaaguacgccaagaccaugaaccugccgcacaucaagcccaucuacaaguacaucagcaucgagggcaccgagacggcggagggggucgagaacgccuucaucgaguccgagauccccgcccucgccggcaccagcaucggguucaaggugaacuccaaggacggcaagcacaucauggacaucaucggcuacgugaagaccgccagcuacuccagcgucuacaccaagcuguacacgaccgggcccaccaccggcgugaacacgaagcacgacgagcugugcaccgggccgugccccaagcagaucgagcacaagaacggcuggaucaccuucagcaaggagcgcaccuccagcugggggugcgaggaguucggcugccucgcgaucuccgacggcugcguguucgggagcugccaggacaucaucaaggacgagauguccgucuaccggaaggagacggaggagaccaccaucguggagcugugccugaccuucagcgacaagacguacugcguggagcucaaccccgucacccccaucaucaccgaccuguucgaggugcaguucaagaccguggaguccuacacgcugccgcgcaucgucgccgugaagaaccacgaggugauggucggccagaucaacgaccucgggguguacagcaagggcugcgggaacgugcagaaggucaacggcaccguguacggcaacggggugcccaaguucgacuaccugugccaccuggccucccggaaggaggucaucauccgcaagugcuucgacaacgacuaccaggccugcaaguuccuccagagccccuccagcuaccggcuggaggaggacgccuccaccgugagcaucaucgacuacaagaagauccugggcaccaucaagaugaaggcgauccucggggacgugcgcuacaagaccuucuccgagagcaucgacaucuccgccgagggcacgugcaccgggugcgucaacugcuucgagaacauccacugcgaguucaccauccacagcaccguggaggccuccugccccguggucagcacgugcacccuguuccacgaccggauccugaucggcccggacaaccacaaguacgccaugaaggugaucugcaccgaggcccccaagaccagccucuccuucaagaucugcaacacgaagguggacgcggccaucaccaucgucgacagcaagcccaucguggagcuggcccccguggaccagaccgccuacauccgcgagaaggacgaccgcugcaagaccuggaugugccggguccgcgacgagggcaugcagguccugcucgagccguucaagaaccuguucggguccuacaucggcaucuucuacacggggcuggcggugcucaucaucgcccugaucgccguguacaucgugaugcccaucugcuucaaggucaaggacauccugaagaagcacgacgacgccuaccggcgcgagcucaagauccgguga

SEQ ID NO: 12606 - RNA, 4329 nt, Artificial Sequence
  derived and/or modified CDS sequence (opt1) from SDNV__AF123490.1__GP
augaucugcauccugcuccugaucgcccuggccagcgcgucccccguguaccagcgcugcuuccaggacggcgccaucgucaagcaguacccggccaaggacgccgugaccgaggugugccucaaggacgacgucagcaugaucaagacccaggccaacuacaugaagaacacgaccgggaccuucuccaacaacguggcgaugcggaaguggcugguggccgacuggcacgacugccgcccccagaaguccuccggcgggcacaucaacgucaucgaggugggcgacgaccugagccuccacaccgaggccuacaucugcuccgccgacugcgugaucagcaucgacaaggagacggcgcagauccggcugcagaccgacuccaccaaccacuucgaggucagcgggaccacggugaaguccggcugguucaagagcaccaccuacaucacccuggaccagacgugcgagcaccucaagguguccugcggccccaagagcauccaguuccacgccugcuucaaccagcacauguccugcguccgcuuccugcaccggaccauccugcccgggagcauggccaacuccaucugccagaacaucgagaucaucauccucgugacccugacccugaugaucuucauccuccugacgaucaucagcaagaccuacaucugcuacauccugaugccgaucuucauccccaucgccuacaucuacggcuggaucuacaacaaguccugcaagaagugcaagcucugcgggcugguguaccaccccuucaccgagugcggcacccacugcgucugcggggcccgcuacgagacgagcgaccggaugaagcugcaccgcagcuccggccucugccccggcuacaagagccugcgggcggcccgcgugaugugcaagucccgggggccggccagcauccuguccauccucaccgccgugcugauccugaccuucgucacccccaugagcgcccucgugaucggcuccagcgaggagcuguacaagcuggacgagcuccccgacgacaugaucgacauggcggagaaggugaaccuguacuaccuggucaucgugcucaacuacuccgccacgugggggcugcugcuccugaugggcauccuggcccuccuguucaagaaguaccagcacaucuuccugaacuacuacgccauguacugcaccgagugcgacauguaccacgacaagaaggagcucaccuacaacggcgacagccccaccaacgccuggcagugcacgugcgggcaguacgaggacgcgaccggccugaucgugcaccagaaguccuacaacugccuggucaaguacaaggugaaguggaucaagaacauccucaucauguacaucguccugacccugaucaaggacagcgugcucaucgccuccgccgaggggccggacuucgcgaccugcaucgaggagaagacgaucaccuggaacugcaccggccccuuccugaaccuggggcgcugcgacaagacccagaagaagacggacuacgccaccaucgccagccagcugaagggcaucgacgccaucuccauccucgacgugcccaugaucagcaagauccccgaggacaucuccggcgcccugaaguacaucgagagccugaagaccuaccacgagcagcucaccgccgaguacgcgauguucacccgguacugcgacuacuacacgcaguucuccgacaacagcggguacagccagaccaccuggcgcaccuaccugcggucccacgacuucgaggucugcaucgccuacccgaaccagcacuucugccgcugcgugaagaacggcgagaagugcagcuccgcccagugggacuucgccacggagaucaagggguacuacaccggccggcagaacaaguucaacaaggaccugaaccucgcccugaugaccuuccacaccgcguuccgcgggacggccaccagcuacgugaccgagcugaucuccaagggcaagaacagcucccuccugauguacgccagcgccaucaaguccaaguucaacggcaacgcccugcucaaggcgcugcuggacuucaugauguaccuccagagccugggggagaucuccggcuucaagcugaccgacgagugggaggacuucaaguacgaggaggagcccacggagcagacccucaugccccgggggcaccgcggcgggcaguacaacuucaagaacgccgccagcaacggcaagaccaaggucugcaagaacgugaagaaggugcugugccugagcccccggagccgcgccaccuucgacgacgucaucgccugcggcgagcacgcgaacccguccguguacaugauccccaacacgaccaucuaccagagcaacaccgagcgcucccacuacugcaucgccgacagccacugccucgaggaguacgagcuggugaagcccgagcugcucaccgcccugaagaagucccggugcugggccggggacaucgacacgaucguccugcacaagcaguccgacggccuccgcagcugccggaucaaggacaccggguccugcaacgugaugggcaacgacuggaccaucgugcugugcgaggacaacaaguacuacuacagcgagguccaccaggacuacgacaaggaccaggacgugggccacuucugccugagcccccgcugcaacaccauccgguacccgaucagcccccgccacaucaacuccugcaaguggcagaucagccacuccacgaucgggaagaucagcgugcacgagcucgcggacaucgagcaguacaagaaggccaucucccagaagcugcagaccagccuguccaucuucaaguacgccaagaccaagaaccucccccacaucaagcccgucuacaaguacaucgccaucgagggcaccgagacgguggaggggguggagaacgccuucaucgagagcgagaucccggcgcuggccggcaccgccaucggguucaagaucaacuccaaggagggcuaccaccugauggacaucaucggcuacgucaagagcgccuccuacagcuccaccuacaccaagcucuacacgaccgggcccaccaucggcaucaacaccaagcacgacgagaagugcacggggagcugccccggcaccauccaccacaagaccggguggcugaccuucagcaaggagcggaccuccacguggggcugcgaggaguucggcugccuggccgugagcgacgggugcguguacggcuccugccaggacaucaucaaggacgagcucaccgucuaccgcaagaucagcgacgaggugaccgagguggagcugugccugaccuucuccgacaagacguacugcaccaaccucaacgcggucaccccgaucaucaccgacaaguucgaggugcaguucaagacgguggagagcuacucccugccccggaucgucggggugcgcaaccacaagauccagaucggccagaucaacgacaucgggguguacagcaagggcugcggcaacguccagaaggugaacgggaccaacuacggcaacggggugcccaaguucgacuaccugugccaccucgccucccggaaggaggucaucauccgcaagugcuucgacaacgacuaccaggccugcaaguuccugcagacccccgccagcuaccggcuggaggagcaccagggcaccgugacgaucaucaacuacaagaagauccucggguccaucaagaugaagccguacugggugaugcugcgcuacaagaacuacgccaacagccuggacaucaacgcggaggggaccugcuccggcugcgucggcugcuucgagaacauccacugcgaguucaccauccacaccacgaucgaggccagcugccagaucgaguccgacugcaccaccuuccacgaccggauccucgugacccccaacgagcacaaguacgcccugaaggugaucugccacgacaagcccaagacgaucuucaacuucaagaucugcaacaccgagaucgaggccgcgaucgccaucgucgacgccaagcccaucaucgagcuggccccgguggaccagaccgccuacauccgcgagaaggacgagcggugcaagaccuggaugugccgcgugcgggacgagggcauccagguccuccuggagcccuucaagaaccuguucgggagcuacaucggcaucuucuacacgauccucaucgugaucuucauccuggugaucaucaucuacaucauccugcccaucugcuucaagcuccaggacacccugaagcagcacgaggacgcguacaagcgcgagaugaagauccgcuga

SEQ ID NO: 12607 - RNA, 4329 nt, Artificial Sequence
  derived and/or modified CDS sequence (opt1) from SDNV(BeAr103645)__KX817334.1__GP
augaucugcauccugcuccugaucgcccuggccagcgcgucccccguguaccagcgcugcuuccaggacggcgccaucgucaagcaguacccggccaaggacgccgugaccgaggugugccucaaggacgacgucagcaugaucaagacccaggccaacuacaugaagaacacgaccgggaccuucuccaacaacguggcgaugcggaaguggcugguggccgacuggcacgacugccgcccccagaaguccuccggcgggcacaucaacgucaucgaggugggcgacgaccugagccuccacaccgaggccuacaucugcuccgccgacugcgugaucagcaucgacaaggagacggcgcagauccggcugcagaccgacuccaccaaccacuucgaggucagcgggaccacggugaaguccggcugguucaagagcaccaccuacaucacccuggaccagacgugcgagcaccucaagguguccugcggccccaagagcauccaguuccacgccugcuucaaccagcacauguccugcguccgcuuccugcaccggaccauccugcccgggagcauggccaacuccaucugccagaacaucgagaucaucauccucgugacccugacccugaugaucuucauccuccugacgaucaucagcaagaccuacaucugcuacauccugaugccgaucuucauccccaucgccuacaucuacggcuggaucuacaacaaguccugcaagaagugcaagcucugcgggcugguguaccaccccuucaccgagugcggcacccacugcgucugcggggcccgcuacgagacgagcgaccggaugaagcugcaccgcagcuccggccucugccccggcuacaagagccugcgggcggcccgcgugaugugcaagucccgggggccggccagcauccuguccauccucaccgccgugcugauccugaccuucgucacccccaugagcgcccucgugaucggcuccagcgaggagcuguacaagcuggacgagcuccccgacgacaugaucgacauggcggagaaggugaaccuguacuaccuggucaucgugcucaacuacuccgccacgugggggcugcugcuccugaugggcauccuggcccuccuguucaagaaguaccagcacaucuuccugaacuacuacgccauguacugcaccgagugcgacauguaccacgacaagaaggagcucaccuacaacggcgacuucaccaacaagugccgccagugcacgugcgggcaguacgaggacgccaccggccugaucgugcaccagaaguccuacaacugccuggucaaguacaaggugaaguggaucaagaacauccucaucauguacaucauccugacccugaucaaggacuccguccucaucgcgagcgccgaggggcccgacuucgcgaccugcaucgaggagaagacgaucaccuggaacugcaccggcccguuccugaaccuggggcggugcgacaagacccagaagaagacggacuacgccaccaucgccucccagcugaagggcaucgacgccaucagcauccucgacgugcccaugaucuccaagauccccgaggacaucagcggcgcccugaaguacaucgagucccugaagaccuaccacgagcagcucaccgccgaguacgccauguucacccgcuacugcgacuacuacacgcaguucagcgacaacuccggguacagccagaccaccuggcggaccuaccugcgcagccacgacuucgaggugugcaucgcguaccccaaccagcacuucugccggugcgucaagaacggcgagaagugcuccagcgcccagugggacuucgccacggagaucaagggguacuacaccggcaagcagaacaaguucaacaaggaccugaaccucgcccugaugaccuuccacaccgccuuccgcgggacggcgaccuccuacgugaccgagcugaucagcaagggcaagaacuccagccuccugauguacgccuccgccaucaagagcaaguucaacggcaacgcccugcucaaggcccugcuggacuucaugauguaccuccagucccugggggagaucagcggcuucaagcugaccgacgagugggaggacuucaaguacgaggaggagccgacggagcagacccucaugccccgggggcaccgcggcgggcaguacaacuucaagaacgcggccuccaacagcaagaccaaggugugcaagaacgucaagaaggugcugugccugagcccccggagccgcgccaccuucgacgacgugaucgccugcggcgagcacgccaaccccuccgucuacaugaucccgaacacgaccaucuaccagagcaacaccgagcgcucccacuacugcaucgcggacagccacugccucgaggaguacgagcuggugaagcccgagcugcucaccgcccugaagaagucccggugcugggccggcgacaucgacacgaucgugcugcacaagcagagcgacgggcuccgcagcugccggaucaaggacaccggcuccugcaacgucauggggaacgacuggaccaucgugcugugcgaggacaacaaguacuacuacagcgaggugcaccaggacuacgacaaggaccaggacgucggccacuucugccugagcccccgcugcaacaccauccgguaccccaucagcccgcgccacaucaacuccugcaaguggcagaucagccacuccacgaucggcaagaucagcgugcacgagcucgccgacaucgagcaguacaagaaggcgaucucccagaagcugcagaccagccuguccaucuucaaguacgccaagaccaagaaccucccccacaucaagcccguguacaaguacaucgccaucgaggggaccgagacggucgagggcguggagaacgccuucaucgagagcgagauccccgcccuggcggggaccgccaucggcuucaagaucaacuccaaggaggggaaccaccugauggacaucaucggcuacgucaagagcgccuccuacagcuccaccuacaccaagcucuacacgaccggcccgaccaucgggaucaacaccaagcacgacgagaagugcacgggcagcugccccgggaccauccaccacaagaccggcuggcugaccuucagcaaggagcggaccuccacgugggggugcgaggaguucggcugccuggccgugagcgacggcugcguguacggguccugccaggacaucaucaaggacgagcucaccguguaccgcaagaucagcgacgaggucaccgagguggagcugugccugaccuucuccgacaagacguacugcaccaaccucaacgccgugacccccaucaucaccgacaaguucgagguccaguucaagacgguggagagcuacucccugccgcggaucgugggcguccgcaaccacaagauccagaucgggcagaucaacgacaucggcguguacagcaaggggugcggcaacgugcagaaggucaacggcaccaacuacgggaacggcgugcccaaguucgacuaccugugccaccucgcgucccggaaggaggugaucauccgcaagugcuucgacaacgacuaccaggccugcaaguuccugcagacccccgccagcuaccggcuggaggagcaccaggggaccgucacgaucaucgacuacaagaagauccucggcuccaucaagaugaaggccauccugggggacgugcgcuacaagaacuacgccaacagccuggacaucaacgcggaggggaccugcgccggcugcgugggcugcuucgagaacauccacugcgaguucaccauccacaccacgaucgaggccuccugccagaucgagagcgacugcaccaccuuccacgaccggauccucgucacccccaacgagcacaaguacgcccugaaggugaucugccacgacaagccgaagacgauccugaacuucaagaucugcaacaccaagaucgaggcggccaucaccaucguggacgccaagcccaucaucgagcucgcccccgucgaccagaccgccuacauccgcgagaaggacgagcggugcaagacguggaugugccgcgugcgggacgagggcauccaggugcugcuggagcccuucaagaaccucuucggguccuacaucggcaucuucuacaccauccugaucgucaucuucauccuggugaucaucaucuacaucauccucccgaucugcuucaagcugcaggacacccugaagcagcacgaggacgcguacaagcgcgagaugaagauccgcuga

SEQ ID NO: 12608 - RNA, 4326 nt, Artificial Sequence
  derived and/or modified CDS sequence (opt1) from SSHV__EU262553.1__GP
augaucugcauccugauccucuucgccgugaccgccgcgagccccgucuaccagcgcugcuuccaggacggcgccaucgugaagcagaacccguccaaggaggccgugaccgaggucugccugaaggacgacgugagcaugaucaagacggaggcccgguacaucaagaacgccaccgggguguucuccaacaacgucgcgauccgcaaguggcuggugagcgacuggcacgacugccggcccaagaagaucaccggcgggcacaucaacgugaucgaggucggcgacgaccucucccugcacaccgagagcuacgugugcuccgccgacugcacgaucgggguggacaaggagaccgcccagguccgccugcagaccgacaccacgaaccacuucgagaucgccggcaccaccgucaagagcggcugguucaaguccaccacguacaucacccucgaccagaccugcgagcaccugaaggugagcugcgggcccaaguccauccaguuccacgcgugcuucaaccagcacaugagcugcgugcgguuccugcaccgcaccauccuccccggcuccaucgccaacagcaucugccagaacaucgagaucaucauccuggugacgcugacccuccugaucuucauccugcucuccgugcugagcaagaccuacaucugcuaccugcucaugccggucuucauccccaucgccuacgccuacgggaucaucuacaacaaguccugcaagaagugcaagcugugcggccugguguaccaccccuucaccgagugcgggacgcacugcgugugcggcgcccgguacgacaccagcgaccgcaugaagcuccaccgggcguccggccugugccccggguacaagagccugcgcgccgcccgggucaugugcaagagcaagggcccggccuccauccucagcgugaucaccgccauccugauccugaccuucgugacgcccaucaacuccauggucgugggggagagcaaggaggucuucgagcucgagcagcugcccgacgacaugcuggacauggcgcuccgcaucaacuucuacuacuucgugugcaucaugaacuacgccgugaccuggggccugaucaucaucggccugcucaucgggcugcuguucaagaaguaccagcaccgguucuccaaccucuacgccauguacugcgaggagugcgacauguaccacgaccgcagcggccugaagcggaacggggacuucaccaacaagugccgccagugcacgugcggccaguacgaggacgccaccgggcugaugacccaccggaagaccuacaacugccucguccgcuacaaggccaagugggugaugaacuuccugaucgcguacaugcugcucacccugaucaaggacuccgccaucgugguccaggccgccggcacggacuucacgaccugccuggagaccgagaacaucaacuggaacugcaccggccccuuccucaaccuggggaacugccagaagcagcagaagaaggagccguacgccaacaucgcgacccagcugaagggccuccaggccaucagcgugcuggacaugcccaugaucgccuccauccccgaggacaucgccggggcgcugcgguacaucgaggagaaggagaccuuccacgugcagcugaccgccgaguacgccaugcucagccgcuacugcgacuacuacgcccaguucuccgacaacagcggcuacucccagaccacguggcgggucuaccugcgcagccacgacuucgacgccugcauccuguaccccaaccagcacuucugccgcugcgugaagcacggggacaagugcuccagcuccaaccgggacuucgcgaacgagaugaagaacuacuacagcggcaagcagaacaaguucgacaaggaccucaaccuggcccugauggcccuccaccacgccuuccgcggcaccuccagcgccuacaucgcgaccaugcugagcaagaaguccaacgacgaccugaucgccuacaccaacaagaucaaggagaaguucccggggaacgcccuccugaaggccaucguggacuacaucgccuacaugaagucccugagcgagaugagcuccuucaaguacgacgaguucugggacgaccuccuguacaagagcgcgcccacgaaggcccccucccugagccggggcuccgagcccagcuacaacuucaagcucgucguguccagccgcuccaucaagagcugcaagaacgugaaguccgucgugugccugagcccgcgguccggggugagcuacgacagcaucaucgccugcggcgaccccaacgggcccuccgucuaccgcaagcccagcgacggcguguuccaguccaacgccgaccagagcaccuacugccuggcggacucccacugccucgaggacuucgagguggucagccaggaggagcuggacgccaucaagaaguccaagugcugggaggccgaguacccggacgugaagcugagcaagcucaccgacggcgugaaguccugccggaugaaggacagcgggaacugcaacgucgccgccaaccgcuggcccaucauccagugcgagaacgacaaguucuacuacuccgagcugcagaaggacuacgacaagacccaggacaucggccacuucugccugagccccgggugcuccacggugcgguuccccaucaacccgaagcacaucagcaacugcaacuggcaggucucccgcagcuccaucgcgaagaucgacgugcacaacaucgaggacaucgaccaguaccggaaggccaucacccagaagcuccagaccagccugucccuguucaaguacgccaagaccaagaaccucccccacaucaagcccaucuacaaguacaucacgaucgagggcaccgagaccgccgagggcaucgagagcgccuacaucgagagcgagaucccggcgcuggccgggaccuccaucggcuucaagaucacgagcaaggaggggaagcaccuccuggacgugaucggcuacgugaaguccgccagcuacuccagcaucuacaccaagcuguacaccaccgggcccacguccggcaucaacaccaagcacgacgagcugugcaccggccccugccccgccaagaucaaccaccagaccggguggcucacguucgccaaggagcgcaccagcuccuggggcugcgaggaguucgggugccuggcgaucagcgacggcugcgucuucggguccugccaggacaucauccgggacgagcugaccguguaccgcaaggagaccgacgaggugacggacgucgagcucugccugaccuucagcgacaagaccuacugcaccaaccugaacccgaucacgcccaucaucaccgaccucuucgaggugcaguucaagaccguggagaccuacucccugccccggaucgucgccauccagaaccacgagaucaagaucggccaggugaacgaccugggcguguacagcaaggggugcggcaacguccagaaggugaacgggacgguguacggcaacgggguccccaaguucgacuaccucugccaccuggccucccgcaaggaggugaucgugcggaagugcuucgacaacgacuaccaggccugcaaguuccugcagagcccggcguccuaccgccucgaggaggacagcggcaccgucaccgugaucgacuacaagaagauccugggcaccaucaagaugaaggccauccugggggacgugaaguacaagaccuucgccgacaacgucgacaugacggccgagggcuccugcaccgggugcaucaacugcuucgagaacauccacugcgagcucacccugcacaccacgaucgaggccagcugccccaucgugagcacgugcaccguguuccacgaccggauccuggucacccccaacgagcacaaguacgcgcucaagguggucugcaccgagaagcccggcaacacccugaccauccgcaucugcaacaccaagguggaggccucccuggcccucguggacgccaagccgauccuggagcuggcccccgucgaccagacggcguacauccgcgagaaggacgagcggugcaagaccuggaugugccgcgugcgggacgaggggcuccaggugauccuggagcccuucaagaaccuguucggcagcuacaucggcaucuucuacaccuucaucaucuccaucaucgcccuccugaucaucaucuacaucguccugcccaucugcuucaagcuccgcgacacccugcggaagcacgaggacgccuacaagcgcgagaugaagauccgguga

SEQ ID NO: 12609 - RNA, 4326 nt, Artificial Sequence
  derived and/or modified CDS sequence (opt1) from SSHV__K02539.1__GP
augaucugcauccugauccucuucgccgugaccgccgcgagccccgucuaccagcgcugcuuccaggacggcgccaucgugaagcagaacccguccaaggaggccgugaccgaggucugccugaaggacgacgugagcaugaucaagacggaggcccgguacaucaagaacgccaccgggguguucuccaacaacgucgcgauccgcaaguggcuggugagcgacuggcacgacugccggcccaagaagaucaccggcgggcacaucaacgugaucgaggucggcgacgaccucucccugcacaccgagagcuacgugugcuccgccgacugcacgaucgggguggacaaggagaccgcccagguccgccugcagaccgacaccacgaaccacuucgagaucgccggcaccaucgucaagagcggcugguucaaguccaccaccuacaucacgcucgaccagaccugcgagcaccugaaggugagcugcgggcccaaguccauccaguuccacgcgugcuucaaccagcacaugagcugcgugcgguuccugcaccgcaccauccuccccggcuccaucgccaacagcaucugccagaacaucgagaucaucauccuggugacccugacgcuccugaucuucauccugcucuccgugcugagcaagaccuacaucugcuaccugcucaugccggucuucauccccaucgccuacgccuacgggaucaucuacaacaaguccugcaagaagugcaagcugugcggccugguguaccaccccuucaccgagugcgggacccacugcgugugcggcgcccgguacgacacgagcgaccgcaugaagcuccaccgggcguccggccugugccccggguacaagagccugcgcgccgcccgggucaugugcaagagcaagggcccggccuccauccucagcgugaucaccgccauccugauccugaccuucgugacccccaucaacuccauggucgugggggagagcaaggaggucuucgagcucgagcagcugcccgacgacaugcuggacauggcgcuccgcaucaacuucuacuacuucgugugcaucaugaacuacgccgugacguggggccugaucaucaucggccugcucaucgggcugcuguucaagaaguaccagcaccgguucuccaaccucuacgccauguacugcgaggagugcgacauguaccacgaccgcagcggccugaagcggaacggggacuucaccaacaagugccgccagugcacgugcggccaguacgaggacgccaccgggcugaugacccaccggaagaccuacaacugccucguccgcuacaaggccaagugggugaugaacuuccugaucgcguacaugcugcucacccugaucaaggacuccgccaucgugguccaggccgccggcaccgacuucacgaccugccuggagaccgagaacaucaacuggaacugcaccggccccuuccucaaccuggggaacugccagaagcagcagaagaaggagccguacgccaacaucgcgacgcagcugaagggccuccaggccaucagcgugcuggacaugcccaugaucgccuccauccccgaggacaucgccggggcgcugcgguacaucgaggagaaggagaccuuccacgugcagcugaccgccgaguacgccaugcucagccgcuacugcgacuacuacgcccaguucuccgacaacagcggcuacucccagaccaccuggcgggucuaccugcgcagccacgacuucgacgccugcauccuguaccccaaccagcacuucugccgcugcgugaagcgcggggacaagugcuccagcuccaacggcgacuucgcgaacgagaugaagaacuacuacagcggcaagcagaacaaguucgacaaggaccucaaccuggcccugauggcccuccaccacgccuuccgggggacguccagcgccuacaucgcgaccaugcugagcaagaaguccaacgacgaccugaucgccuacaccaacaagaucaaggagaaguucccgggcaacgcccuccugaaggccaucguggacuacaucgccuacaugaagucccugagcgagaugagcuccuucaaguacgacgaguucugggacgaccuccuguacaagagcgcgcccaccaaggcccccucccugagccggggguccgagcccagcuacaacuucaagcucgucguguccagccgcuccaucaagagcugcaagaacgugaaguccgucgugugccugagcccgcgguccggcgugagcuacgacagcaucaucgccugcggggaccccaacggccccuccgucuaccgcaagcccagcgacggcguguuccaguccaacgccgaccagagcacguacugccuggcggacucccacugccucgaggacuucgagguggucagccaggaggagcuggacgccaucaagaaguccaagugcugggaggccgaguacccggacgugaagcugagcaagcucaccgacggggugaaguccugccggaugaaggacagcggcaacugcaacgucgccgccaaccgcuggcccaucauccagugcgagaacgacaaguucuacuacuccgagcugcagaaggacuacgacaagacccaggacaucgggcacuucugccugagccccggcugcuccaccgugcgguuccccaucaacccgaagcacaucagcaacugcaacuggcaggucucccgcagcuccaucgcgaagaucgacgugcacaacaucgaggacaucgaccaguaccggaaggccaucacgcagaagcuccagaccagccugucccuguucaaguacgccaagaccaagaaccucccccacaucaagcccaucuacaaguacaucaccaucgagggcacggagaccgccgaggggaucgagagcgccuacaucgagagcgagaucccggcgcuggccggcaccuccaucggguucaagaucaccagcaaggagggcaagcaccuccuggacgugaucggguacgugaaguccgccagcugcuccagcaucuacacgaagcuguacaccaccggccccaccuccggcaucaacacgaagcacgacgagcugugcaccgggcccugccccgccaagaucaaccaccagaccggcuggcucaccuucgccaaggagcgcacgagcuccugggggugcgaggaguucggcugccuggcgaucagcgacgggugcgucuucggcuccugccaggacaucauccgggacgagcugaccguguaccgcaaggagaccgacgaggugaccgacgucgagcucugccugacguucagcgacaagaccuacugcaccaaccugaacccgaucacccccaucaucacggaccucuucgaggugcaguucaagaccguggagaccuacucccugccccggaucgucgccauccagaaccacgagaucaagaucggccaggugaacgaccuggggguguacagcaagggcugcgggaacguccagaaggugaacggcaccguguacgggaacggcguccccaaguucgacuaccucugccaccuggccucccgcaaggaggugaucgugcggaagugcuucgacaacgacuaccaggccugcaaguuccugcagagcccggcguccuaccgccucgaggaggacagcggcacggucaccgugaucgacuacaagaagauccuggggaccaucaagaugaaggccauccugggcgacgugaaguacaagaccuucgccgacaacgucgacaugaccgccgagggguccugcacgggcugcaucaacugcuucgagaacauccacugcgagcucacccugcacaccaccaucgaggccagcugccccaucgugagcacgugcaccguguuccacgaccggauccuggucacccccaacgagcacaaguacgcgcucaagguggucugcaccgagaagcccgggaacacgcugaccauccgcaucugcaacaccaagguggaggccucccuggcccucguggacgccaagccgauccuggagcuggcccccgucgaccagaccgcguacauccgcgagaaggacgagcggugcaagacguggaugugccgcgugcgggacgagggccuccaggugauccuggagcccuucaagaaccuguucggcagcuacaucgggaucuucuacaccuucaucaucuccaucaucgcccuccugaucaucaucuacaucguccugcccaucugcuucaagcuccgcgacacccugcggaagcacgaggacgccuacaagcgcgagaugaagauccgguga

SEQ ID NO: 12610 - RNA, 4335 nt, Artificial Sequence
  derived and/or modified CDS sequence (opt1) from SORV__AF123488.1__GP
auggaggugcugagccucaucuggcugcugacccucugcuccgccagccccgucuuccagcgcugcuuccaggacggcgccaucgugaagcagaacccguccaaggaggcggugaccgaggucugccugaaggacgacgugagcaugaucaagacggagaccaaguacgugaagaacaccaccgggacguucgccaacaacaucgccaugcggaaguggcuggucgccgacuggcacgacugccgcccccagaaguccagcggcgggcacaucaacgugaucgaggugggcgacgaccucucccugcacaccgagagcuacaucugcuccgccgacugcgucaucaccguggacaaggagaccgcgcagauccggcugcagacggacaacaccaaccacuucgagguggccgggaccaccgucaagagcggcugguucaaguccacgaccuacaucacccucgaccagaccugcgagcaccugaaggugagcugcggccccaaguccauccaguuccacgccugcuucaaccagcacaugagcugcgugcgcuuccugcaccggacgauccuccccggguccaucgccaacagcaucugccagaacaucgagaucaucauccuggucacccugucccucgugaucuucaucuuccugaccaucgugagcaagaccuacaucugcuaccugcucaugccgaucuucauccccaucgcguucaucuacggcuggaucuacaacaaguccugcaagaagugcaagcugugcgggcuggucuaccaccccuucacggagugcggcacccacugcgugugcggggcccgcuacgagaccagcgaccggaugaagcuccaccgcgccagcggccugugccccggcuacaagucccugcgggccgcccgcgugaugugcaagagcaaggggccggcguccauccucagcauccugaccgccauccugauccucacguucgucacccccaucuccgccaugguggugggcgagagcaacgagaucuacacccuggacgaccugcccgacgacaugguccagauggccgagcggaucaacaucuacuaccagauccucaucaucaacuacggggugaccugggccuuccugcugcucggccugguccuggcguacuucuucaagaaguaccagcacaaguuccucgacuacuacgccauguacugcgaggagugcgacauguaccacgagaaguccggcaugacguacuggggcgacuucaccaacaagugccgccagugcacgugcgggcaguucgaggacgccaccgggcugauggugcacaagaaguccuacaacugccuggugaaguacaaggccaaguggauccggaacauccucaucgccuaccugaugaucaugcuggucaaggacagccuccuguucgugggcgcgacccgcgccgacuucgccagcugcguggacgagaagaccgucaccuggaacugcaccgggcccuuccugaaccucggccggugcgacaagacgcagaagaagaccggcuacaaggacaucgccaaccagcugaaggggcugggcgugaucuccauccucgacaucccgaugaucgagaagaugcccgacgagaucagcgggucccugaaguacaucgacagccuggagaccuaccacgagcagcugaccgccgaguacgcguuccucacccgcuacugcgacuacuacacgcaguacaccgacaacuccggcuacagccagaccguguggcggaccuaccugcgcucccacgacuucggggccugcgucguguaccccaaccagcacuucugccggugcgugaaguacgacgacaagugcaacagcgccaagugggacuucgccaacgagaugaagacguucuacaccggccgcaaggucaaguucaacaaggaccugaaccucgcgcugcuggugcuccacaaggccuuccggggcaccgggaccgccuacaucgccgaggccauggcgcgcaaggacaacggcuccauggcccacuucgcccuggagauccgcaagaaguuccccacgaacgcccugcucgccgcgcugaucgacuacaucguguaccugcagagccucgccgagaucagcaccuucgagcuggaggaggacugggaggacuucaaguacaagccggagcccaccgaguccacccugcagccccggagccaccgcuccgaccaguacaacuucaagaacgccgacagcaacuccaacgucaaggugugcaagaacgugaagaagguccucugcgugagcccccggucccgcgccaaguucgagaacaucaucgccugcggggagcacgcgaacccgagcguguacaugaugcccaacaucuccaucuaccagagcaacuccgagcggagccacuacugcaucgccgacucccacugccuggaggaguacgagaucgucaacacggagcugcucaccgcccugaagaagucccgcugcugggccaaggagauggacgacguggugcugcacaagcagagcgacggccuccggagcugccgcaucaaggacaccggguccugcaacguccugggcaacgacuggaccaucgugcugugcgagaacggcaacuacuacuacagcgagauccacaaggacuacgacaaggaccaggacguggggcacuucugccucagcccccggugcuccacgauccgcuaccccaucaaccggcgccacauccggaagugcgacuggcagaucagccacuccaccaucgacaagaucagcguccaggagcuggcggacaucgagcaguacaagaaggccaucucccagaagcugcagaccagccucuccaucuucaaguacgugaagaccaagaaccugccgcacaucaagcccgccuacaaguacaucacgguggagggcaccgagaccaucgaggggaucgagaacgccuucaucgagagcgagauccccgcccuggcgggcaccgccaucggcuucaagaucaacucccgcgaggggaacuaccucauggacgucaucggcuacgucaagagcgccuccuacagcgccacguacaccaagcuguacaccaccgggcccacgaucggcaucaacacccggcacgacgagaagugcaccgggccgugccccgugaccaucgaccacaaggacggcuggcugacguucuccaaggagcgcaccagcaccuggggcugcgaggaguucgggugccucgccguguccgacggcugcguguucgggagcugccaggacaucaucaaggacgagcuggcgguguaccggaagaccacggaggagcugaccaccgucgagcucugccugaccuucuccgacaagaccuacugcacgaaccugaacgccaucacccccaucaucaccgacaaguucgaggugcaguucaagaccguggagagcuacacgcucccgcgcaucaucgccgucaagaaccacgagaucaaggugggccagaucaacgaccuggggguguacuccaagggcugcggcaacguccagaaggugaacgggaccaacuacggcaacggggugcccaaguucgacuaccugugccaccucgccagccggaaggaggucauccugcgcaagugcuucgacaacgacuaccaggccugcaaguuccugcagagccccgcguccuaccgccucgaggagcaccagggcaccgugaccgugaucgacuacaagaagauccuggggagcaucaagaugaaggccauccugggcgacgucaaguacaagaacuaccaguccaacaucgagaucaacgccgagggcacgugcgccgggugcgugaacugcuucgagaacauccacugcgaguucaccauccacaccaccguggagacgagcugccccaucgucaccgacugcguguccuuccacgaccggauccucaucaccccggacgagcacaaguacgcgcugaagaucgucugccaggacaagcccaaggugagccugaaguucaagaucugcaacaccaacaucgacgccuccaugacgaucguggacagcaagcccauccucgagcuggcccccgucgaccagaccgccuacaucaaggagaaggacgagcgcugcaagaccuggaugugccgggugcgcgacgagggcuuccaggugauccuggagccguucaagaaccucuucggguccuacaucggcaucuucuacaccgggauccugagcgucaucugccugcucaucgugaucuacaucgugcugcccaucugcuucaagcugcgggacacgcucaagcagcacgaggacgccuacaagaaggagaugaagauccgcuga

SEQ ID NO: 12611 - RNA, 4335 nt, Artificial Sequence
  derived and/or modified CDS sequence (opt1) from SORV(SORV-252)__JN815081.1__GP
auggaggugcugagccucaucuggcugcuggccgucugcuccgccaaccccguguuccagcgcugcuuccaggacggcgcgaucgugaagcagaacccgagcaaggaggccgucaccgaggugugccucaaggacgacguguccaugaucaagaccgaggccaaguacgucaagaacacgaccgggaccuucagcaacaacguggccaugcggaaguggcugguggccgacuggcacgacugccgcccccagaaguccagcggcgggcacaucaacgucaucgaggugggcgacgaccugucccuccacaccgagagcuacaucugcuccgcggacugcgugaucacggucgacaaggagaccgcccagauccggcugcagaccgacagcaccaaccacuucgagguggccgggacgaccgugaaguccggcugguucaagagcaccaccuacaucacgcuggaccagaccugcgagcaccucaaggucuccugcggccccaagagcauccaguuccacgccugcuucaaccagcacauguccugcgugcgcuuccugcaccggaccauccugcccgggagcaucgcgaacuccaucugccagaacaucgagaucaucauccucgugacccugagccugaucaucuucaucuuccucacgaucgucuccaagaccuacaucugcuaccugcugaugccgaucuucauccccaucgccuucaucuacggcuggaucuacaacaagagcugcaagaagugcaagcucugcgggcugguguaccaccccuucaccgagugcggcacccacugcgugugcggggcccgcuacgagacgagcgaccggaugaagcugcaccgcgccuccggccucugccccggcuacaagagccugcgggccgcgcgcgucaugugcaaguccaaggggccggccagcauccuguccauccucaccgccgugcugauccugaccuucgugacccccaucagcgccaucaucaucgacgaguccaaggagaucuacacgcucgacgaccugcccgacgacaugguccagauggccgagcggaucaacaucuacuaccagauccugcucaucaacuacggcgugaccugggcguuccugcugcucgggcugauccuggccuacuucuucaagaaguaccagcacaaguuccucgacuacuacgccauguacugcgaggagugcgacauguaccacgagaaguccggcaugaccuacuggggcgacuucaccaacaagugccgccagugcacgugcgggcaguacgaggacgccgccggccugaugguccacaagaaguccuacaacugccugaucaaguacaaggcgaaguggaucaagaacauccucauccuguaccugaucaugauccucgugaaggacagccugcuguucgugggggccaccggcaccgacuucgccgccugcaucgacgagaaguccgucaccuggaacugcacggggcccuuccucaaccugggccggugcgacaagccgcagaagaaggccagcuucaaggacaucgcgaaccagcugaagggccucggggugaucuccgugcuggacauccccaugaucgagaagaugcccgacgacaucagcggcucccugaaguacaucgacagccugcgcaccuaccacgagcagcucaccgccgaguacgccuuccugacccgguacugcgacuacuacgcccaguacacggacaacuccggguacagccagaccgucuggcgcaccuaccugcggucccacgacuucggcgcgugcgugguguaccccaaccagcacuucugccgcugcgucaaguacggggacaagugcaacagcgccaagugggacuucgccaacgagaugaaguccuucuacaccggccagaaggccaaguucaacaaggaccucaaccuggcccugcucgugcugcacaaggcguuccggggcaccgggacggccuacaucgccgagacccuggcccgcaaggacaacggcagcauggugcacuucgcccucgagauccggaagaaguucccgaccaacgcgcugcuggccgcccucaucgacuacaucgucuaccugcagagccuggccgagaucuccaccuucgagcccgaggaggacugggaggacagcaaguaccagcccgagcccacggaguccgugcuccagccgcgcgcccaccgcagcgaccaguacaacuucaagaacgcggacuccaacagcaacgugaaggucugcaagaacaucaagaaggugcugugcaucagcccccggagccgcgccaaguucgagaacaucaucgccugcggggagcacgccaaccccuccguguacaugaugcccaacaccagcaucuaccaguccaacagcgagcggucccacuacugcaucgcggacagccacugccuggaggaguacgagaucgucaacaccgagcuccugaccgccuucaagaagucccgcugcugggccaaggagaucgacgacaucgugcugcacaagcagagcgacggccuccggagcugccgcaucaaggacacgggguccugcaacgugcugggcaacgacuggaccaucguccugugcgagaacggcaacuacuacuacagcgaggugcacaaggacuacgacaaggaccaggacguggggcacuucugccucuccccgcggugcaacaccauccgcuaccccaucagccggcgccacaucggcgagugcaacuggcagaucacccacuccacgaucgacaagaucagcguccaggagcuggccgacaucgagcaguacaagaaggccaucucccagaagcugcagaccagccucuccaucuucaaguacgugaagaccaagaaccugccccacaucaagcccgcguaccgguacaucaccgucgggggcacggagaccaucgagggcguggagaacgccuucaucgagagcgagaucccggcccuggccgggaccgccaucggcuucaagaucaacucccgcgaggggaacuaccucauggacgugaucggcuacgucaagagcgcguccuacagcgccaccuacacgaagcuguacaccaccgggcccaccaucggcaucaacacgaagcacgacgagaagugcaccggcuccugccccgugaccaucaaccacaaggacggguggcugaccuucagcaaggagcggacguccaccuggggcugcgaggaguucgggugccucgccgugagcgacggcugcguguucggguccugccaggacaucaucaaggacgagcuggccgucuaccgcaagaccaccgaggagcugacgaccguggagcucugccugaccuucagcgacaagaccuacugcacggaccugaacgccaucaccccgaucaucaccgacaaguucgaggugcaguucaagaccgucgagagcuacacccucccccggaucaucgcggugaagaaccacgagauccgcacgggccagaucaacgaccugggcguguacuccaaggggugcggcaacguccagaaggugaacgggaccagcuacggcaacggggugcccaaguucgacuaccugugccaccucgccucccggaaggaggucauccugcgcaagugcuucgacaacgacuaccaggccugcaaguuccugcagagccccgccuccuaccggcucgaggagcaccagggcaccgugaccgugaucgacuacaagaagauccugggcagcaucaagaugaaggcgaugcugggggacgucaaguacaagaacuaccaguccaacaucgagaucaacgccgagggcacgugcgccgggugcaucgacugcuucgagaacauccacugcgaguucaccauccacaccaccguggaggccagcugcccgaucacgaccgacugcguguccuuccacgaccgcauccucaucacccccgaggagcacaaguacgcccugaagaucgucugccaggacaagcccaaggugagccugaaguucaagaucugcaacaccaacguggaggcguccaugacgaucaucgacagcaagcccauccucgagcuggccccggucgaccagaccaccuacaucaaggagaaggacgagcgcugcaagaccuggaugugccgggugcgcgacgagggcuuccaggucauccuggagcccuucaagaaccucuucggguccuacaucggcaucuucuacacgggcgugcugagcaucaucugccugcucaucgugaucuacaucauccugcccaucugcuacaagcugcgggacacccucaagcagcacgaggacgccuacaagaaggagaugaagauccgcuga

SEQ ID NO: 12612 - RNA, 4335 nt, Artificial Sequence
  derived and/or modified CDS sequence (opt1) from SORV(NJO-94F)__KX817337.1__GP
auggaggugcugagccucaucuggcugcugacccucugcuccgccagccccgucuuccagcgcugcuuccaggacggcgccaucgugaagcagaacccguccaaggaggcggugaccgaggucugccugaaggacgacgugagcaugaucaagacggagaccaaguacgugaagaacaccaccgggacguucgccaacaacaucgccaugcggaaguggcuggucgccgacuggcacgacugccgcccccagaaguccagcggcgggcacaucaacgugaucgaggugggcgacgaccucucccugcacaccgagagcuacaucugcuccgccgacugcgucaucaccguggacaaggagaccgcgcagauccggcugcagacggacaacaccaaccacuucgagguggccgggaccaccgucaagagcggcugguucaaguccacgaccuacaucacccucgaccagaccugcgagcaccugaaggugagcugcggccccaaguccauccaguuccacgccugcuucaaccagcacaugagcugcgugcgcuuccugcaccggacgauccuccccggguccaucgccaacagcaucugccagaacaucgagaucaucauccuggucacccugucccucgugaucuucaucuuccugaccaucgugagcaagaccuacaucugcuaccugcucaugccgaucuucauccccaucgcguucaucuacggcuggaucuacaacaaguccugcaagaagugcaagcugugcgggcuggucuaccaccccuucacggagugcggcacccacugcgugugcggggcccgcuacgagaccagcgaccggaugaagcuccaccgcgccagcggccugugccccggcuacaagucccugcgggccgcccgcgugaugugcaagagcaaggggccggcguccauccucagcauccugaccgccauccugauccucacguucgucacccccaucuccgccaugguggugggcgagagcaacgagaucuacacccuggacgaccugcccgacgacaugguccagauggccgagcggaucaacaucuacuaccagauccucaucaucaacuacggggugaccugggccuuccugcugcucggccugguccuggcguacuucuucaagaaguaccagcacaaguuccucgacuacuacgccauguacugcgaggagugcgacauguaccacgagaaguccggcaugacguacuggggcgacuucaccaacaagugccgccagugcacgugcgggcaguucgaggacgccaccgggcugauggugcacaagaaguccuacaacugccuggugaaguacaaggccaaguggauccggaacauccucaucgccuaccugaugaucaugcuggucaaggacagccuccuguucgugggcgcgacccgcgccgacuucgccagcugcguggacgagaagaccgucaccuggaacugcaccgggcccuuccugaaccucggccggugcgacaagacgcagaagaagaccggcuacaaggacaucgccaaccagcugaaggggcugggcgugaucuccauccucgacaucccgaugaucgagaagaugcccgacgagaucagcgggucccugaaguacaucgacagccuggagaccuaccacgagcagcugaccgccgaguacgcguuccucacccgcuacugcgacuacuacacgcaguacaccgacaacuccggcuacagccagaccguguggcggaccuaccugcgcucccacgacuucggggccugcgucguguaccccaaccagcacuucugccggugcgugaaguacggcgacaagugcaacagcgccaagugggacuucgccaacgagaugaagacguucuacaccggccgcaaggucaaguucaacaaggaccugaaccucgcgcugcuggugcuccacaaggccuuccgggggaccggcaccgccuacaucgccgaggccauggcgcgcaaggacaacggguccauggcccacuucgcccuggagauccgcaagaaguuccccacgaacgcccugcucgccgcgcugaucgacuacaucguguaccugcagagccucgccgagaucagcaccuucgagcuggaggaggacugggaggacuucaaguacaagccggagcccaccgaguccacccugcagccccggagccaccgcuccgaccaguacaacuucaagaacgccgacagcaacuccaacgucaaggugugcaagaacgugaagaagguccucugcgugagcccccggucccgcgccaaguucgagaacaucaucgccugcggcgagcacgcgaacccgagcguguacaugaugcccaacaucuccaucuaccagagcaacuccgagcggagccacuacugcaucgccgacucccacugccuggaggaguacgagaucgucaacacggagcugcucaccgcccugaagaagucccgcugcugggccaaggagauggacgacguggugcugcacaagcagagcgacgggcuccggagcugccgcaucaaggacaccggcuccugcaacguccugggcaacgacuggaccaucgugcugugcgagaacgggaacuacuacuacagcgagauccacaaggacuacgacaaggaccaggacgugggccacuucugccucagcccccggugcuccacgauccgcuaccccaucaaccggcgccacauccggaagugcgacuggcagaucagccacuccaccaucgacaagaucagcguccaggagcuggcggacaucgagcaguacaagaaggccaucucccagaagcugcagaccagccucuccaucuucaaguacgugaagaccaagaaccugccgcacaucaagcccgccuacaaguacaucacgguggaggggaccgagaccaucgagggcaucgagaacgccuucaucgagagcgagauccccgcccuggcgggcaccgccaucggguucaagaucaacucccgcgagggcaacuaccucauggacgucaucggguacgucaagagcgccuccuacagcgccacguacaccaagcuguacaccaccggccccacgaucgggaucaacacccggcacgacgagaagugcaccggcccgugccccgugaccaucgaccacaaggacggcuggcugacguucuccaaggagcgcaccagcaccugggggugcgaggaguucggcugccucgccguguccgacgggugcguguucggcagcugccaggacaucaucaaggacgagcuggcgguguaccggaagaccacggaggagcugaccaccgucgagcucugccugaccuucuccgacaagaccuacugcacgaaccugaacgccaucacccccaucaucaccgacaaguucgaggugcaguucaagaccguggagagcuacacgcucccgcgcaucaucgccgucaagaaccacgagaucaagguggggcagaucaacgaccugggcguguacuccaagggcugcgggaacguccagaaggugaacggcaccaacuacgggaacggcgugcccaaguucgacuaccugugccaccucgccagccggaaggaggucauccugcgcaagugcuucgacaacgacuaccaggccugcaaguuccugcagagccccgcguccuaccgccucgaggagcaccaggggaccgugaccgugaucgacuacaagaagauccugggcagcaucaagaugaaggccauccugggcgacgucaaguacaagaacuaccaguccaacaucgagaucaacgccgaggggacgugcgccggcugcgugaacugcuucgagaacauccacugcgaguucaccauccacaccaccguggagacgagcugccccaucgucaccgacugcguguccuuccacgaccggauccucaucaccccggacgagcacaaguacgcgcugaagaucgucugccaggacaagcccaaggugagccugaaguucaagaucugcaacaccaacaucgacgccuccaugacgaucguggacagcaagcccauccucgagcuggcccccgucgaccagaccgccuacaucaaggagaaggacgagcgcugcaagaccuggaugugccgggugcgcgacgagggguuccaggugauccuggagccguucaagaaccucuucggcuccuacaucgggaucuucuacaccggcauccugagcgucaucugccugcucaucgugaucuacaucgugcugcccaucugcuucaagcugcgggacacgcucaagcagcacgaggacgccuacaagaaggagaugaagauccgcuga

SEQ ID NO: 12613 - RNA, 4323 nt, Artificial Sequence
  derived and/or modified CDS sequence (opt1) from TAHV__AF123485.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgugaaguccggcugguucaaguccaccacguacaucacccucgaccagaccugcgagcaccugaaggugagcugcgggcccaaguccauccaguuccacgccugcuucaaccagcacaugagcugcguccgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucacgaacaagugccggcagugcacgugcgggcaguacgaggacgccgccggccugcugacccaccgcaagaccuacaacugccucgugcaguacaaguccaaguggcugacgaacuuccugaucguguacaucauccucaugcugaucaaggacagcguccugaucgugcacgcggacgggaccgacuucgagaagugcuccggcgagguggacaucaccuggaacugcaccgggcccuuccucaaccugggcaacugcgagaagaagcagaagaaggagagcuacaacaacaucgccacgcagcugaagggccucgacgccaucuccguccuggacaucccgaugaucagcaagauccccgaggacaucgccggggcgcugcgguucaucgaggagcagcgcuccuaccacgugcagcugaccgccgaguacgccaugcucacccgguacugcgacuacuacacccaguucaccgacaacagcggcuacucccagacgaccuggcgcguguaccugcggagccacgacuucaaggccugcauccuguaccccaaccagcacuucugccgcugcgucaagcacggggacaagugcuccagcuccaacugggacuucgccaacgagaugaagaacuacuacagcggcaagcaguccaaguucgacaaggaccucaaccuggcgcugaugagccuccaccacgccuuccgcgggaccagcuccuucuacaucgccaagcugcugaaggagaagaagaacgaggaccucgugaccuacgccgagaagaucaagggcaaguaccccggcaacgcccugcugaaggcgaucaucgacuacaucaaguacauggaggaccucacggagaugaacaacuucaagcacgacgagaugugggacgacuucaucuucgaggugccgcccaccaagagccccuccauccggcgccuggagagcuccuacgacuucaagaccaacgucaacagcaaccccucccacaucugcaagaacaucaagaccguggugugccugagcccgaaguccggggucagcuacgacuccaucaucgccugcggcgagcccagccagcccuccaucuaccggaagcccgacagccagguguuccaguccaacgccgaccagacgcacuucugccucagcgacacccacugccuggagaacuacgagaccgugggggaggagaucaucgacgccaucaagaaguccaagugcugggagaccgaguucacggaguacauccaguucaagcagagcgacggcguccgcagcugccggaugaaggacuccggggagugcaccgugaccaccaaccgcuggccgaucauccugugcgacaacgacaaguucuacuacagcgagcuccagaaggacuacgacaaggaccaggacaucggccacuucugccugagcccccggugcaacacgauccgccaccccaucaaccggaagcacaucagcaacugcaccuggcaggucucccacaacaacaucgacaagaucgaggugcacgagcuggaggaccucgagcaguacaagaaggccaucacccagaagcugcagaccagccugacccucuucaaguacuccaagaccaagaaccugccccacaucaagccgauguacaaguacaucaccaucgagggcaccgagacggcggaggggcuggagagcgccuacaucgaguccgagauccccgcccucgccggcaccagcaucggguucaagaucaccuccaagagcggcaagcaccuccuggacgugaucggcuacgugaaguccgcgagcuacuccgccgucuacaccaagcuguacacgaccgggcccaccaucggcgugaacaccaagcacgacgagcugugcacggggccgugccccgugaacgucccccacggcaccggguggcugaccuucgccaaggagcgcaccagcuccuggggcugcgaggaguucggcugccucgccaucagcgacgggugcguguucggcuccugccaggacaucaucaaggacgagaucacgguguaccggaaggagaccgaggagaccaccgacgucgagcugugccugaccuucgccgacaagacguacugcaccaaccucaacgcgaucacccccaucaucaccgaccaguucgaggugcaguucaagacgguggaggccuacagccugccgcgcaucaucgccguccggaaccacgagaucaugguggggcagaucaacgacaucggcguguacagcaaggggugcggcaacguccagaaggugaacaacaccaacuacggcaacggggugcccaaguucgacuaccugugccaccucgccucccgcaaggaggucaucgugcggaagugcuucgacaacgacuaccaggccugcaaguuccugcagacccccgcgagcuaccgccuggaggaggagggcggguccgugaccgucaucgacuacaagaagauccucggcacgaucaagaugaaggccauccugggggacgugaaguacaagaccuucgccgacaacguggaccugaccgucgagggcgugugcaccggcugcaucaacugcuucgagaacauccacugcgagcucacgauccacagcaccguggaggccuccugccccgucgugagcuccugcaccguguuccacgaccggauccugaucaccccgaacgagcacaaguacgccaucaaggucaucugcaacgagaagcccgggcccacgcugcccuucaagaucugcagcgcgaagaccgacgccgccaugacccucgccgacgcgaagccgauccuggagcuggcccccguggaccagaccacguacaucaaggagaaggacgagcgcugcaagaccuggaugugccggguccgcgacgagggcuuccaggugaucuucgagcccuucaagaaccucuucggguccuacaucggcaucuucuacaccuucaucaucagccugauggccaucuucaucgugaucuacaucguccugcccaucugcuucaagcuccgcgacacccugcggcagcacgaggacgccuacaagcgcgagaugaagauccgguga

SEQ ID NO: 12614 - RNA, 4323 nt, Artificial Sequence
  derived and/or modified CDS sequence (opt1) from TAHV__AF229129.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgucaagagcggcugguucaaguccaccacguacaucacccucgaccagaccugcgagcaccugaaggugagcugcgggcccaaguccauccaguuccacgccugcuucaaccagcacaugagcugcgugcgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucacgaacaagugccggcagugcacgugcgggcaguacggcgacgccgccgggcugcugacccaccgcaagaccuacaacugccucgugcaguacaaguccaaguggcugaccaacuuccugaucggcuacaucauccucaugcugaucaaggacagcgugcugcucguccacgcggacgggaccgacuucgagaagugcuccggcgaggccgacaucaccuggaacugcaccggccccuuccugagccuggggaacugcgagaagaagcagaagaaggaguccuacaacaacaucgccacgcagcucaagggccuggacgccaucagcgugcuggacaucccgaugaucuccaagauccccgaggacaucgcgggggcccugcgguucaucgaggagcagcgcagcuaccacgugcagcucaccgccgaguacgccaugcugacccgguacugcgacuacuacacccaguucaccgacaacuccggcuacagccagacgaccuggcgcgucuaccugcggucccacgacuucgaggccugcauccucuaccccaaccgccacuucugccgcugcgugaagcacggggacaagugcagcuccagcaacugggacuucgcgaacgagaugaagaacuacuacuccggcaagcagagcaaguucaacaaggaccugaaccuggcccucaugagccugcaccacgccuuccggggcaccuccagcuucuacaucgccaagcugcucaaggagaagaagaacgaggaccuggugaccuacgccgagaagaucaaggggaaguaccccggcaacgcgcugcucaaggccaucaucgacuacaucaaguacaugaaggggcugacggagaugaacaacuucaagcacgacgagaugugggacgacuucaucuucgaggucccgcccaccaagucccccagcgugcgccggcuggaguccagcuacgacuucaagaccaacgugaacuccaaccccagccacaucugcaagaacaucaagaccgucgugugccucucccccaagagcggcguguccuacgacagcaucaucgccugcggggagccgucccagcccagcaucuaccgcaagcccgacucccaggucuuccagagcaacgccgaccagacgcacuucugccuguccgacacccacugccuggagaacuacgagaccgugggcgaggagaucaucgacgccaucaagaaguccaagugcugggagaccgaguucacggaguacacccagcucaagcagagcgacggcgugcggagcugccgcaugaaggacagcggggagugcaccgucaccacgaaccgguggccgaucauccugugcgacaacgacaaguucuacuacuccgagcugcagaaggacuacgacaaggaccaggacaucggccacuucugccucagcccccgcugcaacaccauccggcaccccaucaaccgcaagcacaucuccaacugcaccuggcaggucaaccacaacaacaucgacaagaucgaggugcacgagcuggaggaccuggagcaguacaagaaggcgaucacccagaagcuccagacgagccugacccuguucaaguacuccaagaccaagaaccucccccacaucaagccgauguacaaguacaucaccaucgaggggacggagaccgccgagggcaucgagagcgccuacaucgaguccgagauccccgcccuggcgggcaccagcaucggguucaagaucaccuccaagagcggcaagcaccuccuggacgugaucggguacgugaaguccgccagcuacuccgccguguacacgaagcuguacaccaccggccccaccaucggggucaacacgaagcacgacgagcugugcaccggcccgugccccgugaacgugccccacggcaccggguggcucaccuucgccaaggagcggacgagcuccuggggcugcgaggaguucgggugccuggccaucagcgacggcugcgucuucggguccugccaggacaucaucaaggacgagaucaccguguaccgcaaggagaccgaggagaccaccgacguggagcugugccucacguucgcggacaagaccuacugcaccaaccugaacgccaucacccccaucaucacggaccaguucgagguccaguucaagaccguggaggccuacagccugccgcggaucaucgccgugcgcaaccacgagaucauggucggccagaucaacgacaucggcguguacagcaaggggugcggcaacgugcagaaggucaacaacaccaacuacgggaacggcgcccccaaguucgacuaccucugccaccuggcgucccggaaggaggugaucgugcgcaagugcuucgacaacgacuaccaggccugcaaguuccugcagacccccgccagcuaccggcucgaggaggagggcggguccgucacggugaucgacuacaagaagauccugggcaccaucaagaugaaggccauccugggggacgugaaguacaagaccuucgccgacaacgucgaccucaccguggagggcgugugcacggggugcgucaacugcuucgagaacauccacugcgagagcaccauccacuccaccguggaggcgagcugccccgugaucuccagcugcaccgucuuccacgaccgcauccugaucacgccgaacgagcacaaguacgccaucaaggugaucugcaacgagaagcccggccccacccugcccuucaagaucugcuccgccaagaccgacgccgcgaugacccucgccgacgccaagccgauccuggagcuggcccccguggaccagacgaccuacaucaaggagaaggucgagcggugcaagaccuggaugugccgcgugcgcgacgagggguuccaggucaucuucgagcccuucaagaaccucuucggcagcuacaucggcaucuucuacaccuucaucaucucccugauggccaucuucaucgugaucuacaucgugcugcccaucugcuucaagcuccgggacacgcugcgccagcacgaggacgcguacaagcgggagaugaagauccgcuga

SEQ ID NO: 12615 - RNA, 4323 nt, Artificial Sequence
  derived and/or modified CDS sequence (opt1) from TAHV(22595-6)__HM036218.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgugaaguccggcugguucaaguccaccacguacaucacccucgaccagaccugcgagcaccugaaggugagcugcgggcccaaguccauccaguuccacgccugcuucaaccagcacaugagcugcguccgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucacgaacaagugccggcagugcacgugcgggcaguacgaggacgccgccggccugcugacccaccgcaagaccuacaacugccucgugcaguacaaguccaaguggcugaccaacuuccugaucguguacaucauccucaugcugaucaaggacagcguccugaucgugcacgcggacgggaccgacuucgagaagugcuccggcgaggccgacaucaccuggaacugcaccgggcccuuccucaaccugggcaacugcgagaagaagcagaagaaggagagcuacaacaacaucgccacgcagcugaagggccucgacgccaucuccgugcuggacaucccgaugaucagcaagauccccgaggacaucgcgggggcccugcgguucaucgaggagcagcgcuccuaccacguccagcugaccgccgaguacgccaugcucacccgguacugcgacuacuacacccaguucaccgacaacagcggcuacucccagacgacccugcgcguguaccugcggagccacgacuucaaggccugcauccucuaccccaaccagcacuucugccgcugcgugaagcacggggacaagugcuccagcuccaacugggacuucgcgaacgagaugaagaacuacuacagcggcaagcaguccaaguucgacaaggaccugaaccuggcccucaugagccugcaccacgccuuccgcgggaccagcuccuucuacaucgccaagcugcucaaggagaagaagaacgaggaccuggucaccuacgccgagaagaucaagggcaaguaccccggcaacgcgcugcucaaggccaucaucgacuacaucaaguacauggaggaccugacggagaugaacaacuucaagcacgacgagaugugggacgacuucaucuucgaggugccgcccaccaagagccccuccauccggcgccuggagagcuccuacgacuucaagaccaacgugaacagcaaccccucccacaucugcaagaacaucaagaccgucgugugccucagcccgaaguccggggugagcuacgacuccaucaucgccugcggcgagcccagccagcccuccaucuaccggaagcccgacagccaggucuuccaguccaacgccgaccagacgcacuucugccugagcgacacccacugccuggagaacuacgagaccgugggggaggagaucaucgacgccaucaagaaguccgagugcugggagaccgaguucacggaguacauccaguucaagcagagcgacggcgugcgcagcugccggaugaaggacuccggggagugcaccgucaccaccaaccgcuggccgaucauccucugcgacaacgacaaguucuacuacagcgagcugcagaaggacuacgacaaggaccaggacaucggccacuucugccugagcccccggugcaacacgauccgccaccccaucaaccggaagcacaucagcaacugcaccuggcaggucucccacaacaacaucgacaagaucgaggugcacgagcucgaggaccuggagcaguacaagaaggcgaucacccagaagcugcagaccagccucacgcuguucaaguacuccaagaccaagaaccugccccacaucaagccgauguacaaguacaucaccaucgagggcaccgagacggccgaggggaucgagagcgccuacaucgaguccgagauccccgcccucgcgggcaccagcaucggguucaagaucaccuccaagagcggcaagcaccuccuggacgugaucggcuacgugaaguccgccagcuacuccgccguguacaccaagcuguacacgaccgggcccaccaucggcgucaacaccaagcacgacgagcugugcacggggccgugccccgugaacgugccccacggcaccggguggcugaccuucgccaaggagcgcaccagcuccuggggcugcgaggaguucggcugccucgccaucagcgacgggugcgucuucggcuccugccaggacaucaucaaggacgagaucacgguguaccggaaggagaccgaggagaccaccgacguggagcugugccugaccuucgcggacaagacguacugcaccaaccucaacgccaucacccccaucaucaccgaccaguucgagguccaguucaagacgguggaggccuacagccugccgcgcaucaucgccgugcggaaccacgagaucauggucgggcagaucaacgacaucggcguguacagcaaggggugcggcaacgugcagaaggucaacaacaccaacuacggcaacggggugcccaaguucgacuaccugugccaccucgccucccgcaaggaggugaucguccggaagugcuucgacaacgacuaccaggcgugcaaguuccugcagacccccgccagcuaccgccuggaggaggagggcggguccgugaccgugaucgacuacaagaagauccucggcacgaucaagaugaaggccauccugggggacgucaaguacaagaccuucgccgacaacguggaccugaccguggagggcgucugcaccggcugcaucaacugcuucgagaacauccacugcgagcucacgauccacagcaccguggaggccuccugccccguggucagcuccugcaccguguuccacgaccggauccugaucaccccgaacgagcacaaguacgcgaucaaggugaucugcaacgagaagcccgggcccacgcugcccuucaagaucugcagcgccaagaccgacgccgccaugacccucgcggacgccaagccgauccuggagcuggcccccgucgaccagaccacguacaucaaggagaaggacgagcgcugcaagaccuggaugugccgggugcgcgacgagggcuuccaggucaucuucgagcccuucaagaaccucuucggguccuacaucggcaucuucuacaccuucaucaucagccugauggccaucuucaucgugaucuacaucgugcugcccaucugcuucaagcuccgcgacacccugcggcagcacgaggacgccuacaagcgcgagaugaagauccgguga

SEQ ID NO: 12616 - RNA, 4323 nt, Artificial Sequence
  derived and/or modified CDS sequence (opt1) from TAHV(92' Bardos)__HM036209.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgucaagagcggcugguucaaguccaccacguacaucacccucgaccagaccugcgagcaccugaaggugagcugcgggcccaaguccauccaguuccacgccugcuucaaccagcacaugagcugcgugcgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacaacaugcugagcauggccaugaaggugaacauguacuacaucaugugcaugaucaacuacgccgucaccugguccuucauccucugcgcgcugcugaucgcccuccuguucaagaaguaccagcaccgguuccugaacuucuacgccauguacugccacgagugcgacauguaccacgaccgcagcggccucaaguacaacgaggacuucacgaacaagugccggcagugcacgugcggccaguacgaggacgccgccgggcugcugacccaccgcaagaccuacaacugccucgugcaguacaaguccaaguggcugacgaacuuccugaucguguacaucauccucaugcugaucaaggacagcguccugaucgugcacgcggacggcaccgacuucgagaagugcuccggggaggccgacaucaccuggaacugcaccggccccuuccucaaccuggggaacugcgagaagaagcagaagaaggagagcuacaacaacaucgccacgcagcugaagggccucgacgccaucuccgugcuggacaucagcaugaucuccaagaucccggaggacaucgcgggcgcccugcgguucaucgaggagcagcgcagcuaccacguccagcugaccgccgaguacgccaugcucacccgguacugcgacuacuacacccaguucaccgacaacuccggguacagccagacgaccuggcgcguguaccugcggucccacgacuucgaggccugcauccuguaccccaaccagcacuucugccgcugcgugaagcacggcgacaagugcagcuccagcaacugggacuucgcgaacgagaugaagaacuucuacuccgggaagcagagcaaguucgacaaggaccucaaccuggcccugaugagccuccaccacgccuuccgcggcaccuccagcuucuacaucgccaagcugcugaaggagaagaagaacgaggaccucgucaccuacgccgagaagaucaaggggaaguaccccggcaacgcgcugcugaaggccaucaucgacuacaucaaguacauggaggaccucacggagaugaacaacuucaaguacgacgagaugugggacgacuucaucuucgaggugcccccgaccaagucccccagcauccggcgccuggaguccagcuacgacuucaagaccaacgugaacuccaaccccagccacaucugcaagaacaucaagaccgucgugugccugucccccaagagcggcguguccuacgacagcaucaucgccugcggggagccgucccagcccagcaucuaccggaagcccgacucccaggucuuccagagcaacgccgaccagacgcacuucugccucuccgacacccacugccuggagaacuacgagaccgugggcgaggagaucaucgacgccaucaagaaguccaagugcugggagaccgaguucacggaguacauccaguucaagcagagcgacggggugcgcagcugccggaugaaggacagcggcgagugcaccgucaccaccaaccgcuggcccaucauccugugcgacaacgacaaguucuacuacuccgagcuccagaaggacuacgacaaggaccaggacaucgggcacuucugccugagcccgcggugcaacacgauccgccaccccaucaaccggaagcacaucuccaacugcaccuggcaggucagccacaacaacaucgacaagaucgaggugcacgagcuggaggaccucgagcaguacaagaaggcgaucacccagaagcugcagaccucccugacccucuucaaguacagcaagaccaagaaccugccccacaucaagcccauguacaaguacaucaccaucgagggcaccgagacggccgagggcaucgaguccgccuacaucgagagcgagaucccggcccuggcggggaccuccaucggcuucaagaucaccagcaaguccgggaagcaccuccuggacgugaucggcuacgucaagagcgccuccuacagcgccguguacaccaagcuguacacgaccggccccaccaucggggugaacaccaagcacgacgagcucugcacgggccccugcccggugaacgugccccacgggaccggcuggcugaccuucgccaaggagcgcaccuccagcugggggugcgaggaguucggcugccuggccaucuccgacggcugcgucuucgggagcugccaggacaucaucaaggacgagaucacgguguaccggaaggagaccgaggagaccaccgacguggagcucugccugaccuucgcggacaagacguacugcaccaaccugaacgccaucacccccaucaucaccgaccaguucgagguccaguucaagacgguggaggccuacagccucccccgcaucaucgccgugcggaaccacgagaucauggucggccagaucaacgacaucgggguguacuccaagggcugcgggaacgugcagaaggucaacaacaccaacuacggcaacggcgugccgaaguucgacuaccugugccaccuggccagccgcaaggaggugaucguccggaagugcuucgacaacgacuaccaggcgugcaaguuccuccagacccccgccuccuaccgccuggaggaggagggcgggagcgugaccgugaucgacuacaagaagauccuggggacgaucaagaugaaggccauccucggcgacgucaaguacaagaccuucgccgacaacguggaccugaccguggagggggucugcaccggcugcaucaacugcuucgagaacauccacugcgagcugacgauccacuccaccguggaggccagcugccccguggucuccagcugcaccguguuccacgaccggauccucaucacccccaacgagcacaaguacgcgaucaaggugaucugcaacgagaagccgggccccacgcugcccuucaagaucugcuccgccaagaccgacgccgccaugacccuggcggacgccaagcccauccucgagcuggccccggucgaccagaccacguacaucaaggagaaggacgagcgcugcaagaccuggaugugccgggugcgcgacgagggguuccaggucaucuucgagcccuucaagaaccuguucggcagcuacaucgggaucuucuacaccuucaucaucucccucauggccaucuucaucgugaucuacaucgugcugcccaucugcuucaagcugcgcgacacccuccggcagcacgaggacgccuacaagcgcgagaugaagauccgguga

SEQ ID NO: 12617 - RNA, 4323 nt, Artificial Sequence
  derived and/or modified CDS sequence (opt1) from TAHV(92' Bardos)__HM036212.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgucaagagcggcugguucaaguccaccacguacaucacccucgaccagaccugcgagcaccugaaggugagcugcgggcccaaguccauccaguuccacgccugcuucaaccagcacaugagcugcgugcgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccaucaagcucgaggaccugcccgacgacaugcugagcaccgccaugaaggugaacauguacuacaucaugugcaugaucaacuacgccgucacgugguccuucauccucugcgcgcugcugaucgcccuccuguucaagaaguaccagcaccgguuccugaacuucuacgccauguacugccacgagugcgacauguaccacgaccgcagcggccucaaguacaacgaggacuucaccaacaagugccggcagugcacgugcggccaguacgaggacgccgccgggcugcugacccaccgcaagaccuacaacugccucgugcaguacaaguccaaguggcugaccaacuuccugaucguguacaucauccucaugcugaucaaggacagcguccugaucgugcacgcggacggcaccgacuucgagaagugcuccggggaggccgacaucaccuggaacugcacgggccccuuccucaaccuggggaacugcgagaagaagcagaagaaggagagcuacaacaacaucgccacccagcugaagggccucgacgccaucuccgugcuggacaucagcaugaucuccaagaucccggaggacaucgcgggcgcccugcgguucaucgaggagcagcgcagcuaccacguccagcugaccgccgaguacgccaugcucacccgguacugcgacuacuacacccaguucacggacaacuccggguacagccagaccaccuggcgcguguaccugcggucccacgacuucaaggccugcauccuguaccccaaccagcacuucugccgcugcgugaagcacggcgacaagugcagcuccagcaacugggacuccgcgaacgagaugaagaacuucuacagcgggaaccagagcaaguucgacaaggaccucaaccuggcccugaugucccuccaccacgccuuccgcggcaccagcuccuucuacaucgccaagcugcugaaggagaagaagaacgaggaccucgucacguacgccgagaagaucaaggggaaguaccccggcaacgcgcugcugaaggccaucaucgacuacaucaaguacauggaggaccucaccgagaugaacaacuucaaguacgacgagaugugggacgacuucaucuucgaggugcccccgaccaagagccccuccauccggcgccuggagagcuccuacgacuucaagaccaacgugaacagcaaccccucccacaucugcaagaacaucaagacggucgugugccugagccccaaguccggcgugagcuacgacuccaucaucgccugcggggagccgagccagcccuccaucuaccggaagcccgacagccaggucuuccaguccaacgccgaccagacccacuucugccucagcgacacccacugccuggagaacuacgagaccgugggcgaggagaucaucgacgccaucaagaaguccaagugcugggagacggaguucaccgaguacauccaguucaagcagagcgacggggugcgcagcugccggaugaaggacuccggcgagugcaccgucaccacgaaccgcuggcccaucauccugugcgacaacgacaaguucuacuacagcgagcuccagaaggacuacgacaaggaccaggacaucgggcacuucugccuguccccgcggugcaacaccauccgccaccccaucaaccggaagcacaucagcaacugcaccuggcaggucucccacaacaacaucgacaagaucgaggugcacgagcuggaggaccucgagcaguacaagaaggcgaucacccagaagcugcagacgagccugacccucuucaaguacuccaagaccaagaaccugccccacaucaagcccauguacaaguacaucaccaucgagggcacggagaccgccgagggcaucgagagcgccuacaucgaguccgagaucccggcccuggcggggaccagcaucggcuucaagaucaccuccaagagcgggaagcaccuccuggacgugaucggcuacgugaaguccgccagcuacuccgccguguacacgaagcuguacaccaccggccccaccaucggggucaacacgaagcacgacgagcucugcaccggccccugcccggugaacgugccccacgggaccggcuggcugaccuucgccaaggagcgcacgagcuccugggggugcgaggaguucggcugccuggccaucagcgacggcugcgucuucgggagcugccaggacaucaucaaggacgagaucaccguguaccggaaggagaccgaggagaccaccgacguggagcucugccugacguucgcggacaagaccuacugcaccaaccugaacgccaucacccccaucaucacggaccaguucgagguccaguucaagaccguggaggccuacucccucccccgcaucaucgccgugcggaaccacgagaucauggucggccagaucaacgacaucgggguguacagcaagggcugcgggaacgugcagaaggucaacaacaccaacuacggcaacggcgugccgaaguucgacuaccugugccaccuggccucccgcaaggaggugaucguccggaagugcuucgacaacgacuaccaggcgugcaaguuccuccagacccccgccagcuaccgccuggaggaggagggcggguccgugacggugaucgacuacaagaagauccuggggaccaucaagaugaaggccauccucggcgacgucaaguacaagaccuucgccgacaacguggaccugaccguggagggggucugcacgggcugcaucaacugcuucgagaacauccacugcgagcugaccauccacagcaccguggaggccuccugccccguggucagcuccugcaccguguuccacgaccggauccucaucacgcccaacgagcacaaguacgcgaucaaggugaucugcaacgagaagccgggccccacccugcccuucaagaucugcagcgccaagaccgacgccgccaugacccuggcggacgccaagcccauccucgagcuggccccggucgaccagacgaccuacaucaaggagaaggacgagcgcugcaagaccuggaugugccgggugcgcgacgagggguuccaggucaucuucgagcccuucaagaaccuguucggcuccuacaucgggaucuucuacaccuucaucaucagccucauggccaucuucaucgugaucuacaucgugcugcccaucugcuucaagcugcgcgacacgcuccggcagcacgaggacgccuacaagcgcgagaugaagauccgguga

SEQ ID NO: 12618 - RNA, 4323 nt, Artificial Sequence
  derived and/or modified CDS sequence (opt1) from TAHV(Souche D C14019-29)__HM036215.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuucaagaacgccacggggaccuacgcgaacaacguggccauccgcaaguggcuggucagcgacuggcacgacugccggcccaagaagguguccggcgggcacaucaacgugaucgaggucggcgacgaccucacccugcacaccgaggccuacgugugcaacgccgacugcacgaucgggguggacaaggagaccgcgcagguccgccugcagaccgacaccacgaaccacuucgagaucgccggcaccaccgugaaguccggcugguucaaguccaccacguacaucacccucgaccagaccugcgagcaccugaaggugagcugcgggcccaaguccauccaguuccacgccugcuucaaccagcacaugagcugcguccgguuccugcaccgcaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgguacgagaccuccgaccgcaugaagcuccaccgggccagcggccugugccccggguacaagucccugcgcgccgcccgggucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccugguccuucauccucugcgcgcugcugaucgcccuccuguucaagaaguaccagcaccgcuuccugaacuucuacgccauguacugccacgagugcgacauguaccacgaccggagcggccucaaguacaacggcgacuucacgaacaagugccgccagugcacgugcgggcaguacgaggacgccgccggccugcugacccaccggaagaccuacaacugccucgugcaguacaaguccaaguggcugaccaacuuccugaucguguacaucauccucaugcugaucgaggacagcguccugaucgugcacgcggacgggaccgacuucgagaagugcuccggcgaggccgacaucaccuggaacugcaccgggcccuuccucaaccugggcaacugcgagaagaagcagaagaaggagagcuacaacaacaucgccacgcagcugaagggccucgacgccaucuccgugcuggacaucccgaugaucagcaagauccccgaggacaucgcgggggcccugcgcuucaucgaggagcagcgguccuaccacguccagcugaccgccgaguacgccaugcucacccgcuacugcgacuacuacacccaguucaccgacaacagcggcuacucccagacgaccuggcggguguaccugcgcagccacgacuucgaggccugcauccuguaccccaaccggcacuucugccgcugcgugaagcacggggacaagugcuccagcuccaacugggacuucgcgaacgagaugaagaacuacuacagcggcaagcaguccaaguucaacaaggaccucaaccuggcccugaugagccuccaccacgccuuccgcgggaccagcuccuucuacaucgccaagcugcugaaggagaagaagaacgaggaccucgucaccuacgccgagaagaucaagggcaaguaccccggcaacgcgcugcugaaggccaucaucgacuacaucaaguacaugaaggaccucacggagaugaacaacuucaagcacgacgagaugugggaggacuucaucuucgaggugccgcccaccaagagccccuccgugcggcgccuggagagcuccuacgacuucaagaccaacgucaacagcaaccccucccacaucugcaagaacaucaagaccguggugugccugagcccgaaguccggggucagcuacgacuccaucaucgccugcggcgagcccagccagcccuccaucuaccggaagcccgacagccagguguuccaguccaacgccgaccagacgcacuucugccucagcgacacccacugccuggagaacuacgagaccgugggggaggagaucaucgacgccaucaagaaguccaagugcugggagaccgaguucacggaguacauccaguucaagcagagcgacggcguccgcagcugccggaugaaggacuccggggagugcaccguggcgaccaaccgcuggccgaucauccugugcgacaacaacaaguucuacuacagcgagcuccaggaggacuacgacaaggaccaggacaucggccacuucugccugagcccccggugcaacaccauccgccaccccaucaaccggaagcacaucagcaacugcacguggcaggucucccacaacaacaucgacaagaucgaggugcacgagcuggaggaccucgagcaguacaagaaggccaucacccagaagcugcagaccagccugacccucuucaaguacuccaagacgaagaaccugccccacaucaagccgauguacaaguacaucaccaucgagggcaccgagaccgccgaggggaucgagagcgccuacaucgaguccgagauccccgcgcuggccggcacgagcaucggguucaagaucaccuccaagagcggcaagcaccuccuggacgugaucggcuacgugaaguccgccagcuacuccgccgucuacaccaagcuguacaccacggggcccaccaucggcgugaacaccaagcacgacgagcucugcaccgggccgugccccgugaacgucccccacggcacgggguggcugaccuucgccaaggagcgcaccagcuccuggggcugcgaggaguucggcugccuggcgaucagcgacgggugcguguucggcuccugccaggacaucaucaaggacgagaucaccguguaccggaaggagacggaggagaccaccgacgucgagcucugccugaccuucgccgacaagaccuacugcacgaaccugaacgccaucacccccaucaucaccgaccaguucgaggugcaguucaagaccguggaggccuacagccucccgcgcaucaucgccguccggaaccacgagaucaugguggggcagaucaacgacaucggcguguacagcaaggggugcggcaacguccagaaggugaacaacacgaacuacggcaacggggugcccaaguucgacuaccugugccaccuggcgucccgcaaggaggucaucgugcggaagugcuucgacaacgacuaccaggccugcaaguuccuccagacccccgccagcuaccgccuggaggaggagggcggguccgugaccgucaucgacuacaagaagauccugggcaccaucaagaugaaggccauccucggggacgugaaguacaagacguucgccgacaacguggaccugaccgucgagggcgugugcaccggcugcaucaacugcuucgagaacauccacugcgagcugaccauccacagcacgguggaggcguccugccccgucgugagcuccugcaccguguuccacgaccggauccucaucaccccgaacgagcacaaguacgccaucaaggucaucugcaacgagaagcccgggcccauccugcccuucaagaucugcagcgccaagaccgacgccgcgaugacgcuggccgacgccaagccgauccucgagcuggcccccguggaccagaccaccuacaucaaggagaaggacgagcgcugcaagaccuggaugugccggguccgcgacgagggcuuccaggugaucuucgagcccuucaagaaccuguucggguccuacaucggcaucuucuacacguucaucaucagccucauggccaucuucaucgugaucuacaucguccugcccaucugcuucaagauccgcgacacccugcggcagcacgaggacgcguacaagcgcgagaugaagauccgguga

SEQ ID NO: 12619 - RNA, 4323 nt, Artificial Sequence
  derived and/or modified CDS sequence (opt1) from TAHV(1014)__GQ386833.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgucaagagcggcugguucaaguccaccacguacaucacccucgaccagaccugcgagcaccugaaggugagcugcgggcccaaguccauccaguuccacgccugcuucaaccagcacaugagcugcgugcgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucacgaacaagugccggcagugcacgugcgggaaguacgaggacgccgccggccugcugacccaccgcaagaccuacaacugccucgugcaguacaaguccaaguggcugacgaacuuccugaucguguacaucauccucaugcugaucaaggacagcguccugaucgugcacgcggacgggaccgacuucgagaagugcuccggcgaggccgacaucaccuggaacugcaccgggcccuuccucaaccugggcaacugcgagaagaagcagaagaaggagagcuacaacaacaucgccacgcagcugaagggccucgacgccaucuccgugcuggacaucccgaugaucagcaagauccccgaggacaucgcgggggcccugcgguucaucgaggagcagcgcuccuaccacguccagcugaccgccgaguacgccaugcucacccgguacugcgacuacuacacccaguucaccgacaacagcggcuacucccagacgaccuggcgcguguaccugcggagccacgacuucgaggccugcauccuguaccccaaccagcacuucugccgcugcgugaagcacggggacaagugcuccagcuccaacugggacuucgcgaacgagaugaagaacuacuacagcggcaagcaguccaaguucgacaaggaccucaaccuggcccugaugagccuccaccacgccuuccgcgggaccagcuccuucuacaucgccaagcugcugcgggagaagaagaacgaggaccucgucaccuacguggagaagaucaagggcaaguaccccggcaacgcccugcugaaggcgaucaucgacuacaucaaguacaugaaggggcucacggagaugaacaacagcaagcacgacgagaugugggacgacuucaucuucgaggugccgcccaccaagucccccagcguccgccggcuggaguccagcuacgacuucaagaccaacgugaacuccaaccccagccacaucugcaagaacaucaagaccguggucugccugucccccaagagcggcguguccuacgacagcaucaucgccugcggggagccgucccagcccagcaucuaccgcaagcccgacucccagguguuccagagcaacgccgaccagacgcacuucugccucuccgacacccacugccuggagaacuucgagaccgucggcgaggagaucaucgacgccaucaagaaguccaagugcugggagaccgaguucacggaguacauccaguucaagcagagcgacggggugcggagcugccgcaugaaggacagcggcgagugcaccgugaccaccaaccgguggccgaucauccugugcgacaacgacaaguucuacuacuccgagcuccagaaggacuacgacaagggccaggacaucgggcacuucugccugagcccccgcugcaacacgauccggcaccccaucaaccgcaagcacaucuccaacugcaccuggcaggucaaccacaacaacaucgacaagaucgaggugcacgagcuggaggaccucgagcaguacaagaaggccaucacccagaagcugcagaccagccugacccucuucaaguacuccaagaccaagaaccugccccacaucaagccgauguacaaguacaucaccaucgagggcaccgagacggcggaggggaucgagagcgccuacaucgaguccgagauccccgcccuggccggcaccagcaucggcuucaagaucaccuccaagagcgggaagcaccuccuggacgugaucggcuacgucaaguccgcgagcuacuccgccguguacaccaagcuguacacgaccgggcccaccaucggcgugaacaccaagcacgacgagcucugcacggggccgugccccgucaacgugccccacggcaccggcuggcugaccuucgccaaggagcggaccagcuccugggggugcgaggaguucggcugccuggccaucagcgacgggugcguguucggcuccugccaggacaucaucaaggacgagaucacggucuaccgcaaggagaccgaggagaccaccgacguggagcucugccugaccuucgccgacaagacguacugcaccaaccugaacgcgaucacccccaucaucaccgaccaguucgaggugcaguucaagacggucgaggccuacagccucccgcggaucaucgccgugcgcaaccacgagaucaugguggggcagaucaacgacaucggcgucuacagcaagggcugcgggaacgugcagaaggugaacaacaccaacuacggcaacgggguccccaaguucgacuaccugugccaccuggccucccggaaggaggugaucgugcgcaagugcaucgacaacgacuaccaggccugcaaguuccuccagacccccgcgagcuaccggcuggaggaggagggcggguccgucaccgugaucgacuacaagaagauccugggcacgaucaagaugaaggccauccucggcgacgugaaguacaagaccuucgccgacaacgucgaccugaccguggagggggugugcaccggcugcaucaacugcuucgagaacauccacugcgagcugacgauccacagcaccgucgaggccuccugccccguggugagcuccugcaccgucuuccacgaccgcauccucaucaccccgaacgagcacaaguacgccaucaaggugaucugcaacgagaagcccgggcccacgcugcccuucaagaucugcagcgcgaagaccgacgccgccaugacccuggccgacgcgaagccgauccucgagcuggcccccgucgaccagaccacguacaucaaggagaaggacgagcggugcaagaccuggaugugccgcgugcgcgacgagggcuuccaggugaucuucgagcccuucaagaaccuguucggguccuacaucggcaucuucuacaccuucaucaucagccucauggccaucuucaucgucaucuacaucgugcugcccaucugcuucaagcugcgggacacccuccgccagcacgaggacgccuacaagcgggagaugaagauccgcuga

SEQ ID NO: 12620 - RNA, 4323 nt, Artificial Sequence
  derived and/or modified CDS sequence (opt1) from TAHV(105)__GQ386829.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgugaaguccggcugguucaaguccaccacguacaucacccucgaccagaccugcgagcaccugaaggugagcugcgggcccaaguccauccaguuccacgccugcuucaaccagcacaugagcugcguccgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucacgaacaagugccggcagugcacgugcgggcaguacgaggacgccgccggccugcugacccaccgcaagaccuacaacugccucgugcaguacaaguccaaguggcugacgaacuuccugaucguguacaucauccucaugcugaucaaggacagcguccugaucgugcacgcggacgggaccgacuucgagaagugcuccggcgaggccgacaucaccuggaacugcaccgggcccuuccucaaccugggcaacugcgagaagaagcagaagaaggagagcuacaacaacaucgccacgcagcugaagggccucgacgccaucuccgugcuggacaucccgaugaucagcaagauccccgaggacaucgcgggggcccugcgguucaucgaggagcagcgcuccuaccacguccagcugaccgccgaguacgccaugcucacccgguacugcgacuacuacacccaguucaccgacaacagcggcuacucccagacgaccuggcgcguguaccugcggagccacgacuucgaggccugcauccuguaccccaaccagcacuucugccgcugcgugaagcacggggacaagugcuccagcuccaacugggacuucgcgaacgagaugaagaacuacuacagcggcaagcaguccaaguucgacaaggaccucaaccuggcccugaugagccuccaccacgccuuccgcgggaccagcuccuucuacaucgccaagcugcugaaggagaagaagaacgaggaccucgucaccuacgccgagaagaucaagggcaaguaccccggcaacgcgcugcugaaggccaucaucgacuacaucaaguacaugaaggaccucacggagaugaacaacuucaagcacgacgagaugugggacgacuucaucuucgaggugccgcccaccaagagccccuccgugcggcgccuggagagcuccuacgacuucaagaccaacgucaacagcaaccccucccacaucugcaagaacaucaagaccguggugugccugagcccgaaguccggggucagcuacgacuccaucaucgccugcggcgagcccagccagcccuccaucuaccggaagcccgacagccagguguuccaguccaacgccgaccagacgcacuucugccucagcgacacccacugccuggagaacuacgagaccgugggggaggagaucaucgacgccaucaagaaguccaagugcugggagaccgaguucacggaguacauccaguucaagcagagcgacggcguccgcagcugccggaugaaggacuccggggagugcaccgugaccaccaaccgcuggccgaucauccugugcgacaacgacaaguucuacuacagcgagcuccagaaggacuacgacaaggaccaggacaucggccacuucugccugagcccccggugcaacacgauccgccaccccaucaaccggaagcacaucagcaacugcaccuggcaggucucccacaacaacaucgacaagaucgaggugcacgagcuggaggaccucgagcaguacaagaaggcgaucacccagaagcugcagaccagccugacccucuucaaguacuccaagaccaagaaccugccccacaucaagccgauguacaaguacaucaccaucgagggcaccgagacggccgaggggaucgagagcgccuacaucgaguccgagauccccgcccuggcgggcaccagcaucggguucaagaucaccuccaagagcggcaagcaccuccuggacgugaucggcuacgugaaguccgccagcuacuccgccgucuacaccaagcuguacacgaccgggcccaccaucggcgugaacaccaagcacgacgagcucugcacggggccgugccccgugaacgucccccacggcaccggguggcugaccuucgccaaggagcgcaccagcuccuggggcugcgaggaguucggcugccuggccaucagcgacgggugcguguucggcuccugccaggacaucaucaaggacgagaucacgguguaccggaaggagaccgaggagaccaccgacgucgagcucugccugaccuucgcggacaagacguacugcaccaaccugaacgccaucacccccaucaucaccgaccaguucgaggugcaguucaagacgguggaggccuacagccucccgcgcaucaucgccguccggaaccacgagaucaugguggggcagaucaacgacaucggcguguacagcaaggggugcggcaacguccagaaggugaacaacaccaacuacggcaacggggugcccaaguucgacuaccugugccaccuggccucccgcaaggaggucaucgugcggaagugcuucgacaacgacuaccaggcgugcaaguuccuccagacccccgccagcuaccgccuggaggaggagggcggguccgugaccgucaucgacuacaagaagauccugggcacgaucaagaugaaggccauccucggggacgugaaguacaagaccuucgccgacaacguggaccugaccgucgagggcgugugcaccggcugcaucaacugcuucgagaacauccacugcgagcugacgauccacagcaccguggaggccuccugccccgucgugagcuccugcaccguguuccacgaccggauccucaucaccccgaacgagcacaaguacgcgaucaaggucaucugcaacgagaagcccgggcccacgcugcccuucaagaucugcagcgccaagaccgacgccgccaugacccuggcggacgccaagccgauccucgagcuggcccccguggaccagaccacguacaucaaggagaaggacgagcgcugcaagaccuggaugugccggguccgcgacgagggcuuccaggugaucuucgagcccuucaagaaccuguucggguccuacaucggcaucuucuacaccuucaucaucagccucauggccaucuucaucgugaucuacaucguccugcccaucugcuucaagcugcgcgacacccuccggcagcacgaggacgccuacaagcgcgagaugaagauccgguga

SEQ ID NO: 12621 - RNA, 4323 nt, Artificial Sequence
  derived and/or modified CDS sequence (opt1) from TAHV(106)__GQ386830.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgucaagagcggcugguucaaguccaccacguacaucacccucgaccagaccugcgagcaccugaaggugagcugcgggcccaaguccauccaguuccacgccugcuucaaccagcacaugagcugcgugcgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucacgaacaagugccggcagugcacgugcgggcaguacgaggacgccgccggccugcugacccaccgcaagaccuacaacugccucgugcaguacaaguccaaguggcugacgaacuuccugaucguguacaucauccucaugcugaucaaggacagcguccugaucgugcacgcggacgggaccgacuucgagaagugcuccggcgaggccgacaucaccuggaacugcaccgggcccuuccucaaccugggcaacugcgagaagaagcagaagaaggagagcuacaacaacaucgccacgcagcugaagggccucgacgccaucuccgugcuggacaucccgaugaucagcaagauccccgaggacaucgcgggggcccugcgguucaucgaggagcagcgcuccuaccacguccagcugaccgccgaguacgccaugcucacccgguacugcgacuacuacacccaguucaccgacaacagcggcuacucccagacgaccuggcgcguguaccugcggagccacgacuucgaggccugcauccuguaccccaaccagcacuucugccgcugcgugaagcacggggacaagugcuccagcuccaacugggacuucgcgaacgagaugaagaacuacuacagcggcaagcaguccaaguucgacaaggaccucaaccuggcccugaugagccuccaccacgccuuccgcgggaccagcuccuucuacaucgccaagcugcugaaggagaagaagaacgaggaccucgucaccuacgccgagaagaucaagggcaaguaccccggcaacgcgcugcugaaggccaucaucgacuacaucaaguacaugaaggggcucacggagaugaacaacuucaagcacgacgagaugugggacgacuucaucagcgaggugccgcccaccaagucccccagcgugcggcgccuggaguccagcuacgacuucaagaccaacgucaacuccaaccccagccacaucugcaagaacaucaagaccguggugugccugucccccaagagcggcgucuccuacgacagcaucaucgccugcggggagccgucccagcccagcaucuaccggaagcccgacucccagguguuccagagcaacgccgaccagacgcacuucugccucuccgacacccacugccuggagaacuacgagaccgugggcgaggagaucaucgacgccaucaagaaguccaagugcugggagaccgaguucacggaguacauccaguucaagcagagcgacgggguccgcagcugccggaugaaggacagcggcgagugcaccgugaccaccaaccgcuggccgaucauccugugcgacaacgacaaguucuacuacuccgagcuccagaaggacuacgacaaggaccaggacaucggccacuucugccugagcccccggugcaacacgauccgccaccccaucaaccggaagcacaucuccaacugcaccuggcaggucagccacaacaacaucgacaagaucgaggugcacgagcuggaggaccucgagcaguacaagaaggcgaucacccagaagcugcagaccucccugacccucuucaaguacagcaagaccaagaaccugccccacaucaagccgauguacaaguacaucaccaucgaggggaccgagacggccgagggcaucgaguccgccuacaucgagagcgagauccccgcccuggcggggaccuccaucggcuucaagaucaccagcaaguccggcaagcaccuccuggacgugaucggguacgucaagagcgccuccuacagcgccguguacaccaagcuguacacgaccggccccaccaucgacgugaacaccaagcacgacgagcucugcacggggccgugccccgugaacgucccccacggcaccggguggcugaccuucgccaaggagcgcaccuccagcuggggcugcgaggaguucggcugccuggccaucuccgacgggugcguguucggcagcugccaggacaucaucaaggacgagaucacgguguaccggaaggagaccgaggagaccaccgacgucgagcucugccugaccuucgcggacaagacguacugcaccaaccugaacgccaucacccccaucaucaccgaccaguucgaggugcaguucaagacgguggaggccuacagccucccgcgcaucaucgccguccggaaccacgagaucaugguggggcagaucaacgacaucggcguguacuccaaggggugcggcaacguccagaaggugaacaacaccaacuacggcaacggggugcccaaguucgacuaccugugccaccuggccagccgcaaggaggucaucgugcggaagugcuucgacaacgacuaccaggcgugcaaguuccuccagacccccgccuccuaccgccuggaggaggagggcgggagcgugaccgucaucgacuacaagaagauccugggcacgaucaagaugaaggccauccucggggacgugaaguacaagaccuucgccgacaacguggaccugaccgucgagggcgugugcaccggcugcaucaacugcuucgagaacauccacugcgagcugacgauccacuccaccguggaggccagcugccccgucguguccagcugcaccguguuccacgaccggauccucaucaccccgaacgagcacaaguacgcgaucaaggucaucugcaacgagaagcccgggcccacgcugcccuucaagaucugcuccgccaagaccgacgccgccaugacccuggcggacgccaagccgauccucgagcuggcccccguggaccagaccacguacaucaaggagaaggacgagcgcugcaagaccuggaugugccggguccgcgacgagggcuuccaggugaucuucgagcccuucaagaaccuguucgggagcuacaucggcaucuucuacaccuucaucaucucccucauggccaucuucaucgugaucuacaucguccugcccaucugcuucaagcugcgcgacacccuccggcagcacgaggacgccuacaagcgcgagaugaagauccgguga

SEQ ID NO: 12622 - RNA, 4323 nt, Artificial Sequence
  derived and/or modified CDS sequence (opt1) from TAHV(181)__GQ386831.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgugaaguccggcugguucaaguccaccacguacaucacccucgaccagaccugcgagcaccugaaggugagcugcgggcccaaguccauccaguuccacgccugcuucaaccagcacaugagcugcguccgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucacgaacaagugccggcagugcacgugcgggcaguacggcgacgccgccgggcugcugacccaccgcaagaccuacaacugccucgugcaguacaaguccaaguggcugacgaacuuccugaucggcuacaucauccucaugcugaucaaggacagcgugcugaucguccacgcggacgggaccgacuucgagaagugcuccggcgaggccgacaucaccuggaacugcaccggccccuuccucaaccuggggaacugcgagaagaagcagaagaaggagagcuacaacaacaucgccacgcagcugaagggccucgacgccaucuccgugcuggacaucccgaugaucagcaagauccccgaggacaucgcgggggcccugcgguucaucgaggagcagcgcuccuaccacgugcagcugaccgccgaguacgccaugcucacccgguacugcgacuacuacacccaguucaccgacaacagcggcuacucccagacgaccuggcgcgucuaccugcggagccacgacuucgaggccugcauccuguaccccaaccgccacuucugccgcugcgugaagcacggggacaagugcuccagcuccaacugggacuucgcgaacgagaugaagaacuacuacagcggcaagcaguccaaguucgacaaggaccucaaccuggcccugaugagccuccaccacgccuuccggggcaccagcuccuucuacaucgccaagcugcugaaggagaagaagaacgaggaccucgugaccuacgccgagaagaucaaggggaaguaccccggcaacgcgcugcugaaggccaucaucgacuacaucaaguacaugaaggggcucacggagaugaacaacuucaagcacgacgagaugugggacgacuucaucuucgaggucccgcccaccaagagccccuccgugcgccggcuggagagcuccuacgacuucaagaccaacgugaacagcaaccccucccacaucugcaagaacaucaagaccgucgugugccugagcccgaaguccggcgugagcuacgacuccaucaucgccugcggggagcccagccagcccuccaucuaccgcaagcccgacagccaggucuuccaguccaacgccgaccagacgcacuucugccucagcgacacccacugccuggagaacuacgagaccgugggcgaggagaucaucgacgccaucaagaaguccaagugcugggagaccgaguucacggaguacauccaguucaagcagagcgacggcgugcggagcugccgcaugaaggacuccggggagugcaccgucaccaccaaccgguggccgaucauccugugcgacaacgacaaguucuacuacagcgagcuccagaaggacuacgacaaggaccaggacaucggccacuucugccugagcccccgcugcaacacgauccggcaccccaucaaccgcaagcacaucagcaacugcaccuggcaggucaaccacaacaacaucgacaagaucgaggugcacgagcuggaggaccucgagcaguacaagaaggcgaucacccagaagcugcagaccucccugacccucuucaaguacagcaagaccaagaaccugccccacaucaagccgauguacaaguacaucaccaucgaggggaccgagacggccgagggcaucgaguccgccuacaucgagagcgagauccccgcccuggcgggcaccuccaucggguucaagaucaccagcaaguccggcaagcaccuccuggacgugaucggguacgucaagagcgccuccuacagcgccguguacaccaagcuguacacgaccggccccaccaucggggugaacaccaagcacgacgagcucugcacgggcccgugccccgugaacgugccccacggcaccggguggcugaccuucgccaaggagcggaccuccagcuggggcugcgaggaguucgggugccuggccaucuccgacggcugcgucuucgggagcugccaggacaucaucaaggacgagaucacgguguaccgcaaggagaccgaggagaccaccgacguggagcucugccugaccuucgcggacaagacguacugcaccaaccugaacgccaucacccccaucaucaccgaccaguucgagguccaguucaagacgguggaggccuacucccucccgcggaucaucgccgugcgcaaccacgagaucauggucggccagaucaacgacaucggcguguacagcaaggggugcggcaacgugcagaaggucaacaacaccaacuacgggaacggcgugcccaaguucgacuaccugugccaccuggccagccggaaggaggugaucguccgcaagugcuucgacaacgacuaccaggcgugcaaguuccuccagacccccgccuccuaccggcuggaggaggagggcgggagcgugaccgugaucgacuacaagaagauccugggcacgaucaagaugaaggccauccucggggacgucaaguacaagaccuucgccgacaacguggaccugaccguggagggcgucugcaccgggugcaucaacugcuucgagaacauccacugcgagcugacgauccacuccaccguggaggccagcugccccguggucuccagcugcaccguguuccacgaccgcauccucaucaccccgaacgagcacaaguacgcgaucaaggugaucugcaacgagaagcccggccccacgcugcccuucaagaucugcuccgccaagaccgacgccgccaugacccuggcggacgccaagccgauccucgagcuggcccccgucgaccagaccacguacaucaaggagaaggacgagcggugcaagaccuggaugugccgcgugcgcgacgagggguuccaggucaucuucgagcccuucaagaaccuguucggcagcuacaucggcaucuucuacaccuucaucaucucccucauggccaucuucaucgugaucuacaucgugcugcccaucugcuucaagcugcgggacacccuccgccagcacgaggacgccuacaagcgggagaugaagauccgcuga

SEQ ID NO: 12623 - RNA, 4323 nt, Artificial Sequence
  derived and/or modified CDS sequence (opt1) from TAHV(236)__GQ386832.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgugaaguccggcugguucaaguccaccacguacaucacccucgaccagaccugcgagcaccugaaggugagcugcgggcccaaguccauccaguuccacgccugcuucaaccagcacaugagcugcguccgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccaucaccugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucacgaacaagugccggcagugcacgugcgggcaguacgaggacgccgccggccugcugacccaccgcaagaccuacaacugccucguccaguacaaguccaaguggcugaccaacuuccugaucguguacaucauccucaugcugaucaaggacagcgugcugaucguccacgcggacgggaccgacuucgagaagugcuccggcgaggccgacaucaccuggaacugcaccgggcccuuccucaaccugggcaacugcgagaagaagcagaagaaggagagcuacaacaacaucgccacgcagcugaagggccucgacgccaucuccgugcuggacaugccgaugaucagcaagauccccgaggacaucgcgggggcccugcgguucaucgaggagcagcgcuccuaccacgugcagcugaccgccgaguacgccaugcucacccgguacugcgacuacuacacccaguucaccgacaacagcggcuacucccagacgaccuggcgcgucuaccugcggagccacgacuucgaggccugcauccuguaccccaaccagcacuucugccgcugcgugaagcacggggacaagugcuccagcuccaacugggacuucgcgaacgagaugaagaacuacuacagcggcaagcaguccaaguucgacaaggaccucaaccuggcccugaugagccuccaccacgccuuccgcgggaccagcuccuucuacaucgccaagcugcugaaggagaagaagaacgaggaccucgugaccuacgccgagaagaucaagggcaaguaccccggcaacgcgcugcugaaggccaucaucgacuacaucaaguacaugaaggaccucacggagaugaacaacuucaagcacgacgagaugugggacgacuucaucuucgaggucccgcccaccaagagccccuccgugcggcgccuggagagcuccuacgacuucaagaccaacgugaacagcaaccccucccacaucugcaagaacaucaagaccgucaucugccugagcccgaaguccggggugagcuacgacuccaucaucgccugcggcgagcccagccagcccuccaucuaccggaagcccgacagccagguguuccaguccaacgccgaccagacgcacuucugccucagcgacacccacugccuggagaacuacgagaccgucggggaggagaucaucgacgccaucaagaaguccaagugcugggagaccgagcugacggaguacauccaguucaagcagagcgacggcgugcgcagcugccggaugaaggacuccggggagugcaccgugaccaccaaccgcuggccgaucauccucugcgacaacgacaaguucuacuacagcgagcugcagaaggacuacgacaaggaccaggacaucggccacuucugccugagcccccggugcaacacgauccgccaccccaucaaccggaagcacaucagcaacugcaccuggcaggucucccacaacaacaucgacaagaucgaggugcacgagcucgaggaccuggagcaguacaagaaggcgaucacccagaagcugcagaccagccucacgcuguucaaguacuccaagaccaagaaccugccccacaucaagccgauguacaaguacaucaccaucgagggcaccgagacggccgaggggaucgagagcgccuacaucgaguccgagauccccgcccucgcgggcaccagcaucggguucaagaucaccuccaagagcggcaagcaccuccuggacgugaucggcuacgucaaguccgccagcuacuccgccguguacaccaagcuguacacgaccgggcccaccaucggcgugaacaccaagcacgacgagcugugcacggggccgugccccgucaacgugccccacggcaccggguggcugaccuucgccaaggagcgcaccagcuccuggggcugcgaggaguucggcugccucgccaucagcgacgggugcguguucggcuccugccaggacaucaucaaggacgagaucacggucuaccggaaggagaccgaggagaccaccgacguggagcugugccugaccuucgcggacaagacguacugcaccaaccucaacgccaucacccccaucaucaccgaccaguucgaggugcaguucaagacggucgaggccuacagccugccgcgcaucaucgccgugcggaaccacgagaucaugguggggcagaucaacgacaucggcgucuacagcaaggggugcggcaacgugcagaaggugaacaacaccaacuacggcaacgggguccccaaguucgacuaccugugccaccucgccucccgcaaggaggugaucgugcggaagugcuucgacaacgacuaccaggcgugcaaguuccugcagacccccgccagcuaccgccuggaggaggagggcuccagcgucaccgugaucgacuacaagaagauccucgggacgaucaagaugaaggccauccugggcgacgugaaguacaagaccuucgccgacaacgucgaccugaccguggagggggugugcaccggcugcaucaacugcuucgagaacauccacugcgagcucacgauccacuccaccgucgaggccagcugccccgugguguccagcugcaccgucuuccacgaccggauccugaucaccccgaacgagcacaaguacgcgaucaaggugaucugcaacgagaagcccggccccacgcugcccuucaagaucugcuccgccaagaccgacgccgccaugacccucgcggacgccaagccgauccuggagcuggcccccguggaccagaccacguacaucaaggagaaggacgagcgcugcaagaccuggaugugccggguccgcgacgagggguuccaggugaucuucgagcccuucaagaaccucuucggcagcuacaucgggaucuucuacaccuucaucaucucccugauggccaucuucaucgucaucuacaucgugcugcccaucugcuucaagcuccgcgacgcccugcggcagcacgaggacgcguacaagcgcgagaugaagauccgguga

SEQ ID NO: 12624 - RNA, 4323 nt, Artificial Sequence
  derived and/or modified CDS sequence (opt1) from TAHV(29)__GQ386823.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgugaaguccggcugguucaaguccaccacguacaucacccucgaccagaccugcgagcaccugaaggugagcugcgggcccaaguccauccaguuccacgccugcuucaaccagcacaugagcugcguccgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucacgaacaagugccggcagugcacgugcgggcaguacgaggacgccgccggccugcugacccaccgcaagaccuacaacugccucgugcaguacaaguccaaguggcugacgaacuuccugaucguguacaucauccucaugcugaucaaggacagcguccugaucgugcacgcggacgggaccgacuucgagaagugcuccggcgaggccgacaucaccuggaacugcaccgggcccuuccucaaccugggcaacugcgagaagaagcagaagaaggagagcuacgacaacaucgccacgcagcugaagggccucgacgccaucuccgugcuggacaucccgaugaucagcaagauccccgaggacaucgcgggggcccugcgguucaucgaggagcagcgcuccuaccacguccagcugaccgccgaguacgccaugcucacccgguacugcgacuacuacacccaguucaccgacaacagcggcuacucccagacgaccuggcgcguguaccugcggagccacgacuucgaggccugcauccuguaccccaaccagcacuucugccgcugcgugaagcacggggacaagugcuccagcuccaacugggacuucgcgaacgagaugaagaacuacuacagcggcaagcaguccaaguucgacaaggaccucaaccuggcccugaugagccuccaccacgccuuccgcgggaccagcuccuucuacaucgccaagcugcugaaggagaagaagaacgaggaccucgucaccuacgccgagaagaucaagggcaaguaccccggcaacgcgcugcugaaggccaucaucgacuacaucaaguacaugaaggaccucacggagaugaacaacuucaagcacgacgagaugugggacgacuucaucuucgaggugccgcccaccaagagccccuccgugcggcgccuggagagcuccuacgacuucaagaccaacgucaacagcaaccccucccacaucugcaagaacaucaagaccguggugugccugagcccgaaguccggggucagcuacgacuccaucaucgccugcggcgagcccagccagcccuccaucuaccggaagcccgacagccagguguuccaguccaacgccgaccagacgcacuucugccucagcgacacccacugccuggagaacuacgagaccgugggggaggagaucaucgacgccaucaagaaguccaagugcugggagaccgaguucacggaguacauccaguucaagcagagcgacggcguccgcagcugccggaugaaggacuccggggagugcaccgugaccaccaaccgcuggccgaucauccugugcgacaacgacaaguucuacuacagcgagcuccagaaggacuacgacaaggaccaggacaucggccacuucugccugagcccccggugcaacacgauccgccaccccaucaaccggaagcacaucagcaacugcaccuggcaggucucccacaacaacaucgacaagaucgaggugcacgagcuggaggaccucgagcaguacaagaaggcgaucacccagaagcugcagaccagccugacccucuucaaguacuccaagaccaagaaccugccccacaucaagccgauguacaaguacaucaccaucgagggcaccgagacggccgaggggaucgagagcgccuacaucgaguccgagauccccgcccuggcgggcaccagcaucggguucaagaucaccuccaagagcggcaagcaccuccuggacgugaucggcuacgugaaguccgccagcuacuccgccgucuacaccaagcuguacacgaccgggcccaccaucggcgugaacaccaagcacgacgagcucugcacggggccgugccccgugaacaugccccacggcaccggguggcugaccuucgccaaggagcgcaccagcuccuggggcugcgaggaguucggcugccuggccaucagcgacgggugcgucuucggcuccugccaggacaucaucaaggacgagaucacgguguaccggaaggagaccgaggagaccaccgacguggagcucugccugaccuucgcggacaagacguacugcaccaaccugaacgccaucacccccaucaucaccgaccaguucgagguccaguucaagacgguggaggccuacagccucccgcgcaucaucgccgugcggaaccacgagaucauggucgggcagaucaacgacaucggcguguacagcaaggggugcggcaacgugcagaaggucaacaacaccaacuacggcaacggggugcccaaguucgacuaccugugccaccuggccucccgcaaggaggugaucguccggaagugcuucgacaacgacuaccaggcgugcaaguuccuccagacccccgccagcuaccgccuggaggaggagggcggguccgugaccgugaucgacuacaagaagauccugggcacgaucaagaugaaggccauccucggggacgucaaguacaagaccuucgccgacaacguggaccugaccguggagggcgucugcaccggcugcaucaacugcuucgagaacauccacugcgagcugacgauccacagcaccguggaggccuccugccccguggucagcuccugcaccguguuccacgaccggauccucaucaccccgaacgagcacaaguacgcgaucaaggugaucugcaacgagaagcccgggcccacgcugcccuucaagaucugcagcgccaagaccgacgucgccaugacccuggccgacgcgaagccgauccucgagcuggcccccguggaccagaccacguacaucaaggagaaggacgagcgcugcaagaccuggaugugccgggucaaggacgagggcuuccaggugaucuucgagcccuucaagaaccuguucggguccuacaucggcaucuucuacaccuucaucaucagccucauggccaucuucaucgugaucuacaucguccugcccaucugcuucaagcugcgcgacacccuccgccagcacgaggacgccuacaagcgggagaugaagauccgcuga

SEQ ID NO: 12625 - RNA, 4323 nt, Artificial Sequence
  derived and/or modified CDS sequence (opt1) from TAHV(4019)__GQ386834.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgucaagagcggcugguucaaguccaccacguacaucacccucgaccagaccugcgagcaccugaaggugagcugcgggcccaaguccauccaguuccacgccugcuucaaccagcacaugagcugcgugcgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucacgaacaagugccggcagugcacgugcgggcaguacgaggacgccgccggccugcugacccaccgcaagaccuacaacugccucgugcaguacaaguccaaguggcugaccaacuuccugaucguguacaucauccucaugcugaucaaggacagcguccugaucgugcacgcggacgggaccgacuucgagaagugcuccggcgaggccgacaucaccuggaacugcaccgggcccuuccucaaccugggcaacugcgagaagaagcagaagaaggagagcuacaacaacaucgccacgcagcugaagggccucgacgccaucuccgugcuggacaucccgaugaucagcaagauccccgaggacaucgcgggggcccugcgguucaucgaggagcagcgcuccuaccacguccagcugaccgccgaguacgccaugcucacccgguacugcgacuacuacacccaguucaccgacaacagcggcuacucccagacgaccuggcgcguguaccugcggagccacgacuucgaggccugcauccuguaccccaaccgccacuucugccgcugcgugaagcacggggacaagugcuccagcuccaacugggacuucgcgaacgagaugaagaacuacuacagcggcaagcaguccaaguucgacaaggaccucaaccuggcccugaugagccuccaccacgccuuccgggggaccagcuccuucuacaucgccaagcugcugaaggagaagaagaacgaggaccucgucaccuacgccgagaagaucaagggcaaguaccccggcaacgcgcugcugaaggccaucaucgacuacaucaaguacaugaaggaccucacggagaugaacaacuucaagcacgacgagaugugggacgacagcaucuucgaggugccgcccaccaagucccccagcgugcgccggcuggaguccagcuacgacuucaagaccaacgucaacuccaaccccagccacaucugcaagaacaucaagaccguggugugccugucccccaagagcggggucuccuacgacagcaucaucgccugcggcgagccgucccagcccagcaucuaccgcaagcccgacucccagguguuccagagcaacgccgaccagacgcacuucugccucuccgacacccacugccuggagaacuacgaggccgugggggaggagaucaucgacgcgaucaagaaguccaagugcugggagaccgaguucaccgaguacauccaguucaagcagagcgacggcguccggagcugccgcaugaaggacagcggggagugcacggugaccaccaaccgguggccgaucauccugugcgacaacgacaaguucuacuacuccgagcuccagaaggacuacgacaaggaccaggacaucggccacuucugccugagcccccgcugcaacaccauccggcaccccaucaaccgcaagcacaucuccaacugcacguggcaggucagccacaacaacaucgacaagaucgaggugcacgagcuggaggaccucgagcaguacaagaaggccaucacccagaagcugcagaccucccugacccucuucaaguacagcaagacgaagaaccugccccacaucaagccgauguacaaguacaucaccaucgagggcaccgagaccgccgaggggaucgaguccgccuacaucgagagcgagauccccgcgcuggccggcacguccaucggguucaagaucaccagcaaguccggcaagcaccuccuggacgugaucagcuacgugaaguccgccagcuacuccgccgucuacaccaagcuguacaccacgggccccaccaucggggugaacaccaagcacgacgagcucugcaccggcccgugccccgugaacgucccccacgggacgggcuggaucaccuucgccaaggagcggaccagcuccugggggugcgaggaguucggcugccuggcgaucagcgacggcugcguguucgggagcugccaggacaucaucaaggacgagaucaccguguaccgcaaggagacggaggagaccaccgacgucgagcugugccucaccuucgccgacaagaccuacugcacgaaccugaacgccaucacccccaucaucaccgaccaguucgaggugcaguucaagaccguggaggccuacucccugccgcggaucaucgccguccgcaaccacgagaucauggugggccagaucaacgacaucgggguguacagcaagggcugcgggaacguccagaaggugaacaacacgaacuacggcaacggcgugcccaaguucgacuaccucugccaccuggcgucccggaaggaggucaucgugcgcaagugcuucgacaacgacuaccaggccugcaaguuccugcagacccccgccagcuaccggcucgaggaggagggcggguccgugaccgucaucgacuacaagaagauccuggggaccaucaagaugaaggccauccugggcgacgugaaguacaagacguucgccgacaacguggaccucaccgucgagggggugugcaccggcugcaucaacugcuucgagaacauccacugcgagcugaccauccacagcacgguggaggcguccugccccgucgugagcuccugcaccguguuccacgaccgcauccugaucaccccgaacgagcacaaguacgccaucaaggucaucugcaacgagaagcccggccccacccuccccuucaagaucugcagcgccaagacggacgccgcgaugacccuggccgacgccaagccgauccuggagcucgcccccguggaccagaccaccuacaucaaggagaaggacgagcggugcaagacguggaugugccgcguccgcgacgagggguuccaggugaucuucgagcccuucaagaaccuguucggcuccuacaucgggaucuucuacaccuucaucaucagccugauggccaucuucaucgugaucuacaucguccuccccaucugcuucaagcugcgggacacccugcgccagcacgaggacgcguacaagcgggagaugaagauccgcuga

SEQ ID NO: 12626 - RNA, 4323 nt, Artificial Sequence
  derived and/or modified CDS sequence (opt1) from TAHV(4020)__GQ386835.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgucaagagcggcugguucaaguccaccacguacaucacccucgaccagaccugcgagcaccugaaggugagcugcgggcccaaguccauccaguuccacgccugcuucaaccagcacaugagcugcgugcgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucacgaacaagugccggcagugcacgugcgggcaguacgaggacgccgccggccugcugacccaccgcaagaccuacaacugccucgugcaguacaaguccaaguggcugaccaacuuccugaucguguacaucauccucaugcugaucaaggacagcguccugaucgugcacgcggacgggaccgacuucgagaagugcuccggcgaggccgacaucaccuggaacugcaccgggcccuuccucaaccugggcaacugcgagaagaagcagaagaaggagagcuacaacaacaucgccacgcagcugaagggccucgacgccaucuccgugcuggacaucccgaugaucagcaagauccccgaggacaucgcgggggcccugcgguucaucgaggagcagcgcuccuaccacguccagcugaccgccgaguacgccaugcucacccgguacugcgacuacuacacccaguucaccgacaacagcggcuacucccagacgaccuggcgcguguaccugcggagccacgacuucgaggccugcauccuguaccccaaccagcacuucugccgcugcgugaagcacggggacaagugcuccagcuccaacugggacuucgcgaacgagaugaagaacuacuacagcggcaagcaguccaaguucgacaaggaccucaaccuggcccugaugagccuccaccacgccuuccgcgggaccagcuccuucuacaucgccaagcugcugaaggagaagaagaacgaggaccucgucaccuacgccgagaagaucaagggcaaguacagcggcaacgcgcugcugaaggccaucaucgacuacaucaaguacaugaaggggcucacggagaugaacaacuucaagcacgacgagaugugggacgacuucaucuucgaggugcccccgcccaagucccccagcgugcggcgccuggaguccagcuacgacuucaagaccaacgucaacuccaaccccagccacaucugcaagaacaucaagaccguggugugccugucccccaagagcggcgucuccuacgacagcaucaucgccugcggggagccgucccagcccagcaucuaccggaagcccgacucccagguguuccagagcaacgccgaccagacccacuucugccucuccgacacgcacugccuggagaacuacgagaccgugggcgaggagaucaucgacgccaucaagaaguccaagugcugggagaccgaguucaccgaguacauccaguucaagcagagcgacgggguccgcagcugccggaugaaggacagcggcgagugcacggugaccaccaaccgcuggccgaucauccugugcgacaacgacaaguucuacuacuccgagcuccagaaggacuacgacaaggaccaggacaucggccacuucugccugagcccccggugcaacaccauccgccaccccaucaaccggaagcacaucuccaacugcacguggcaggucagccacaacaacaucgacaagaucgaggugcacgagcuggaggaccucgagcaguacaagaaggcgaucacccagaagcugcagaccucccugacccucuucaaguacagcaagacgaagaaccugccccacaucaagccgauguacaaguacaucaccaucgaggggaccgagaccgccgagggcaucgaguccgccuacaucgagagcgagauccccgcccuggcggggacguccaucggcuucaagaucaccagcaaguccggcaagcaccuccuggacgugaucggguacgucaagagcgccuccuacagcgccguguacaccaagcuguacaccacgggccccaccaucggggugaacaccaagcacgacgagcucugcaccggcccgugccccgugaacgucccccacgggacgggcuggcugaccuucgccaaggagcgcaccuccagcuggggcugcgaggaguucgggugccuggccaucuccgacggcugcguguucgggagcugccaggacaucaucaaggacgagaucaccguguaccggaaggagacggaggagaccaccgacgucgagcucugccugaccuucgcggacaagaccuacugcacgaaccugaacgccaucacccccaucaucaccgaccaguucgaggugcaguucaagaccguggaggccuacagccucccgcgcaucaucgccguccggaaccacgagaucauggugggccagaucaacgacaucgggguguacuccaagggcugcggcaacguccagaaggugaacaacacgaacuacgggaacggcgugcccaaguucgacuaccugugccaccuggccagccgcaaggaggucaucgugcggaagugcuucgacaacgacuaccaggcgugcaaguuccuccagacccccgccuccuaccgccuggaggaggagggcgggagcgugaccgucaucgacuacaagaagauccuggggaccaucaagaugaaggccauccucggcgacgugaaguacaagacguucgccgacaacguggaccugaccgucgagggcgugugcaccgggugcaucaacugcuucgagaacauccacugcgagcugaccauccacuccacgguggaggccagcugccccgucguguccagcugcaccguguuccacgaccggauccucaucaccccgaacgagcacaaguacgcgaucaaggucaucugcaacgagaagcccggccccacccugcccuucaagaucugcuccgccaagacggacgccgccaugacccuggcggacgccaagccgauccucgagcuggcccccguggaccagaccaccuacaucaaggagaaggacgagcgcugcaagacguggaugugccggguccgcgacgagggguuccaggugaucuucgagcccuucaagaaccuguucggcagcuacaucgggaucuucuacaccuucaucaucucccucauggccaucuucaucgugaucuacaucguccugcccaucugcuucaagcugcgcgacacccuccggcagcacgaggacgccuacaagcgcgagaugaagauccgguga

SEQ ID NO: 12627 - RNA, 4323 nt, Artificial Sequence
  derived and/or modified CDS sequence (opt1) from TAHV(4030)__GQ386836.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgugaaguccggcugguucaaguccaccacguacaucacccucgaccagaccugcgagcaccugaaggugagcugcgggcccaaguccauccaguuccacgccugcuucaaccagcacaugagcugcguccgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccugguccuucauccucugcgcgcugcugaucgcccuccuguucaagaaguaccagcaccgguuccugaacuucuacgccauguacugcaacgagugcgacauguaccacgaccgcagcggccucaaguacaacggcgacuucacgaacaagugccggcagugcacgugcgggcaguacgaggacgccgccggccugcugacccaccgcaagaccuacaacugccucgugcaguacaaguccaaguggcugacgaacuuccugaucguguacaucauccucaugcugaucaaggacagcguccugaucgugcacgcggacgggaccgacuucgagaagugcuccggcgaggccgacaucaccuggaacugcaccgggcccuuccucaaccugggcaacugcgagaagaagcagaagaaggagagcuacaacaacaucgccacgcagcugaagggccucgacgccaucuccgugcuggacaucccgaugaucagcaagauccccgaggacaucgcgggggcccugcgguucaucgaggagcagcgcuccuaccacguccagcugaccgccgaguacgccaugcucacccgguacugcgacuacuacacccaguucaccgacaacagcggcuacucccagacgaccuggcgcguguaccugcggagccacgacuucgaggccugcauccuguaccccaaccagcacuucugccgcugcgugaagcacggggacaagugcuccagcuccaacugggacuucgcgaacgagaugaagaacuacuacagcggcaagcaguccaaguucgacaaggaccucaaccuggcccugaugagccuccaccacgccuuccgcgggaccagcuccuucuacaucgccaagcugcugaaggagaagaagaacgaggaccucaucaccuacgccgagaagaucaagggcaaguaccccggcaacgcgcugcugaaggccaucaucgacuacaucaaguacaugaaggaccucacggagaugaacaacuucaagcacgacgagaugugggacgacuucaucuucgaggucccgcccaccaagagccccuccgugcggcgccuggagagcuccuacgacuucaagaccaacgugaacagcaaccccucccacaucugcaagaacaucaagaccgucgugugccugagcccgaaguccggggugagcuacgacuccaucaucgccugcggcgagcccagccagcccuccaucuaccggaagcccgacagccaggucuuccaguccaacgccgaccagacgcacuucugccucagcgacacccacugccuggagaacuacgagaccgugggggaggagaucaucgacgccaucaagaaguccaagugcugggagaccgaguucacggaguacauccaguucaagcagagcgacggcgugcgcagcugccggaugaaggacuccggggagugcaccgucaccaccaaccgcuggccgaucauccugugcgacaacgacaaguucuacuacagcgagcuccagaaggacuacgacaaggaccaggacaucggccacuucugccugagcccccggugcaacacgauccgccaccccaucaaccggaagcacaucagcaacugcaccuggcaggucucccacaacaacaucgacaagaucgaggugcacgagcuggaggaccucgagcaguacaagaaggcgaucacccagaagcugcagaccagccugacccucuucaaguacuccaagaccaagaaccugccccacaucaagccgauguacaaguacaucaccaucgagggcaccgagacggccgaggggaucgagagcgccuacaucgaguccgagauccccgcccuggcgggcaccagcaucggguucaagaucaccuccaagagcggcaagcaccuccuggacgugaucggcuacgugaaguccgccagcuacuccgccguguacaccaagcuguacacgaccgggcccaccaucggcgucaacaccaagcacgacgagcucugcacggggccgugccccgugaacgugccccacggcaccggguggcugaccuucgccaaggagcgcaccagcuccuggggcugcgaggaguucggcugccuggccaucagcgacgggugcgucuucggcuccugccaggacaucaucaaggacgagaucaucguguaccggaaggagacggaggagaccaccgacguggagcucugccugaccuucgcggacaagaccuacugcacgaaccugaacgccaucacccccaucaucaccgaccaguucgagguccaguucaagaccguggaggccuacagccucccgcgcaucaucgccgugcggaaccacgagaucauggucgggcagaucaacgacaucggcguguacagcaaggggugcggcaacgugcagaaggucaacaacacgaacuacggcaacggggugcccaaguucgacuaccugugccaccuggccucccgcaaggaggugaucguccggaagugcuucgacaacgacuaccaggcgugcaaguuccuccagacccccgccagcuaccgccuggaggaggagggcggguccgugaccgugaucgacuacaagaagauccugggcaccaucaagaugaaggccauccucggggacgucaaguacaagacguucgccgacaacguggaccugaccguggagggcgucugcaccggcugcgugaacugcuucgagaacauccacugcgagcugaccauccacagcacgguggaggccuccugcagcgucguguccagcugcaccguguuccacgaccggauccucaucacccccaacgagcacaaguacgcgaucaaggucaucugcaacgagaagccggggcccacccugcccuucaagaucugcuccgccaagacggacgccgccaugacccuggcggacgccaagcccauccucgagcuggccccgguggaccagaccaccuacaucaaggagaaggacgagcgcugcaagacguggaugugccggguccgcgacgagggcuuccaggugaucuucgagcccuucaagaaccuguucgggagcuacaucggcaucuucuacaccuucaucaucucccucauggccaucuucaucgugaucuacaucguccugcccaucugcuucaagcugcgcgacacccuccggcagcacgaggacgccuacaagcgcgagaugaagauccgguga

SEQ ID NO: 12628 - RNA, 4323 nt, Artificial Sequence
  derived and/or modified CDS sequence (opt1) from TAHV(4033)__GQ386837.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgucaagagcggcugguucaaguccaccacguacaucacccucgaccagaccugcgagcaccugaaggugagcugcgggcccaaguccauccaguuccacgccugcuucaaccagcacaugagcugcgugcgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccugguccuucauccucugcgcgcugcugaucgcccuccuguucaagaaguaccagcacggcuuccugaacuucuacgccauguacugccacgagugcgacauguaccacgaccggagcggccucaaguacaacggggacuucacgaacaagugccgccagugcacgugcggccaguacgaggacgccgccgggcugcugacccaccggaagaccuacaacugccucgugcaguacaaguccaaguggcugacgaacuuccugaucguguacaucauccucaugcugaucaaggacagcguccugaucgugcacgcggacggcaccgacuucgagaagugcuccggggaggccgacaucaccuggaacugcaccggccccuuccucagccugggcaacugcgagaagaagcagaagaaggaguccuacaacaacaucgccacgcagcugaaggggcucgacgccaucagcgugcuggacaucccgaugaucuccaagauccccgaggacaucgcgggcgcccugcgcuucaucgaggagcagcggagcuaccacguccagcugaccgccgaguacgccaugcucacccgcuacugcgacuacuacacccaguucaccgacaacuccggguacagccagacgaccuggcggguguaccugcgcucccacgacuucgaggccugcauccuguaccccaaccagcacuucugccggugcgugaagcacggcgacaagugcagcuccagcaacugggacuucgcgaacgagaugaagaacuacuacuccgggaagcagagcaaguucgacaaggaccucaaccuggcccugaugagccuccaccacgccuuccgcggcaccuccagcuucuacaucgccaagcugcugaaggagaagaagaacgaggaccucgucaccuacgccgagaagaucaagggcaaguaccccgggaacgcgcugcugaaggccaucaucgacuacaucaaguacaugaaggaccucacggagaugaacaacuucaagcacgacgagaugugggacgacuucaucuucgaggugccgcccaccaagucccccagcgugcgccggcuggaguccagcuacgacuucaagaccaacgucaacuccaaccccagccacaucugcaagaacaucaagaccguggugugccugucccccaagagcggcgucuccuacgacagcaucaucgccugcggggagccgucccagcccagcaucuaccgcaagcccgacucccagguguuccagagcaacgccgaccagacgcacuucugccucuccgacacccacugccuggagaacuacgagaccgugggcgaggagaucaucgacgccaucaagaaguccaagugcugggagaccgaguucacggaguacauccaguucaagcagagcgacgggguccggagcugccgcaugaaggacagcggcgagugcaccgugaccaccaaccgguggccgaucauccugugcgacaacgacaaguucuacuacuccgagcuccagaaggacuacgacaaggaccaggacaucggccacuucugccugagcccccgcugcaacacgauccggcaccccaucaaccgcaagcacaucuccaacugcaccuggcaggucagccacaacaacaucgacaagaucgaggugcacgagcuggaggaccucgagcaguacaagaaggcgaucacccagaagcugcagaccucccugacccucuucaaguacagcaagaccaagaaccugccccacaucaagccgauguacaaguacaucaccaucgaggggaccgagacggccgagggcaucgaguccgccuacaucgagagcgagauccccgcccuggcggggaccuccaucggcuucaagaucaccagcaaguccggcaagcaccuccuggacgugaucggguacgucaagagcgccuccuacagcgccguguacaccaagcuguacacgaccggccccaccaucggggugaacaccaagcacgacgagcucugcacgggcccgugccccgugaacgucccccacgggaccggcuggcugaccuucgccaaggagcggaccuccagcuggggcugcgaggaguucgggugccuggccaucuccgacggcugcguguucgggagcugccaggacaucaucaaggacgagaucacgguguaccgcaaggagaccgaggagaccaccgacgucgagcucugccugaccuucgcggacaagacguacugcaccaaccugaacgccaucacccccaucaucaccgaccaguucgaggugcaguucaagacgguggaggccuacagccucccgcggaucaucgccguccgcaaccacgagaucauggugggccagaucaacgacaucgggguguacuccaagggcugcggcaacguccagaaggugaacaacaccaacuacgggaacggcgugcccaaguucgacuaccugugccaccuggccagccggaaggaggucaucgugcgcaagugcuucgacaacgacuaccaggcgugcaaguuccuccagacccccgccuccuaccggcuggaggaggagggcgggagcgugaccgucaucgacuacaagaagauccuggggacgaucaagaugaaggccauccucggcgacgugaaguacaagaccuucgccgacaacguggaccugaccgucgagggcgugugcaccgggugcaucaacugcuucgagaacauccacugcgagcugacgauccacuccaccguggaggccagcugccccgucguguccagcugcaccguguuccacgaccgcauccucaucaccccgaacgagcacaaguacgcgaucaaggucaucugcaacgagaagcccggccccacgcugcccuucaagaucugcuccgccaagaccgacgccgccaugacccuggcggacgccaagccgauccucgagcuggcccccguggaccagaccacguacaucaaggagaaggacgagcggugcaagaccuggaugugccgcguccgggacgagggguuccaggugaucuucgagcccuucaagaaccuguucggcagcuacaucgggaucuucuacaccuucaucaucucccucauggccaucuucaucgugaucuacaucguccugcccaucugcuucaagcugcgcgacacccuccgccagcacgaggacgccuacaagcgggagaugaagauccgcuga

SEQ ID NO: 12629 - RNA, 4323 nt, Artificial Sequence
  derived and/or modified CDS sequence (opt1) from TAHV(4034)__GQ386838.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgugaaguccggcugguucaaguccaccacguacaucacccucgaccagaccugcgagcaccugaaggugagcugcgggcccaaguccauccaguuccacgccugcuucaaccagcacaugagcugcguccgcuuccugcaccggaccauccuccccggcuccaucgccagcuccaucugccagaacguggagaucaucauccugacggugcugacccuccugaucuucauccugcucagcauccuguccaagaccuacaucugcuacacccugaugccgaucuucaucccccucgccuacaucuacggggucaucuacaacaagagcugcaagaagugcaagcugugcggccugguguaccaccccuucacggagugcgggacccacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugacguucgugacccccaucaacgccauggucgccggggacacccaggagaccuucaagcucgaggaccugcccgacgacaugcugagcauggccaugaaggugaacauguacuacaucaugugcaugaucaacuacgccgucacgugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucaccaacaagugccggcagugcacgugcgggcaguacgaggacgccgccggccugcugacccaccgcaagaccuacaacugccucgugcaguacaaguccaaguggcugaccaacuuccugaucguguacaucauccucaugcugaucaaggacagcauccugaucguccacgcggacgggaccgacuucgagaagugcuccggcgaggccgacaucaccuggaacugcacggggcccuuccucaaccugggcaacugcgagaagaagcagaagaaggagagcuacaacaacaucgccacccagcugaagggccucgacgccaucuccgugcuggacaucccgaugaucagcaagauccccgaggacaucgcgggggcccugcgguucaucgaggagcagcgcuccuaccacgugcagcugaccgccgaguacgccaugcucacccggugcugcgacuacuacacccaguucacggacaacagcggcuacucccagaccaccuggcgcgucuaccugcggagccacgacuucgaggccugcauccuguaccccaaccagcacuucugccgcugcgugaagcacgggaacaagugcuccagcuccaacugggacuucgcgaacgagaugaagaacuacuacagcggcaagcaguccaaguucgacaaggaccucaaccuggcccugaugagccuccaccacgccuuccgcgggaccagcuccuucuacaucgccaagcugcugaaggagaagaagaacgaggaccucgugacguacgccgagaagaucaagggcaaguaccccggcaacgcgcugcugaaggccaucaucgacuacaucaaguacaugaaggaccucaccgagaugaacaacuucaagcacgacgagaugugggacgacuucaucuucgaggucccgcccaccaagagccccuccgugcggcgccuggagagcuccuacgacuucaagaccaacgugaacagcaaccccucccacaucugcaagaacaucaagacggucgugugccugagcccgaaguccggggugagcuacgacuccaucaucgccugcggcgagcccagccagcccuccaucuaccggaagcccgacagccaggucuuccaguccaacaccgaccagacccacuucugccucagcgacacccacugccuggagaacuacgaggccgugggggaggagaucaucgacgccaucaagaaguccaagugcugggagacggaguucaccgaguacauccaguucaagcagagcgacggcgugcgcagcugccggaugaaggacuccggggagugcaccgucaccacgaaccgcuggccgaucauccugugcgacaacgacaaguucuacuacagcgagcuccagaaggacuacgacaaggaccaggacaucggccacuucugccugagcccccggugcaacaccauccgccaccccaucaaccggaagcacaucagcaacugcaccuggcaggucaaccacaacaacaucgacaagaucgaggugcacgagcuggaggaccucgagcaguacaagaaggcgaucacccagaagcugcagacgucccugacccucuucaaguacagcaagaccaagaaccugccccacaucaagccgauguacaaguacaucaccaucgagggcacggagaccgccgaggggaucgaguccgccuacaucgagagcgagauccccgcccuggcgggcaccuccaucggguucaagaucaccagcaaguccggcaagcaccuccuggacgugaucggcuacgucaagagcgccuccuacagcgccguguacacgaagcuguacaccaccgggcccaccaucggcgugaacacgaagcacgacgagcucugcaccgggccgugccccgugaacgugccccacggcaccggguggcugaccuucgccaaggagcgcacguccagcuggggcugcgaggaguucggcugccuggccaucuccgacgggugcgucuucggcagcugccaggacaucaucaaggacgagaucaccguguaccggaaggagaccgaggagaccaccgacguggagcucugccugacguucgcggacaagaccuacugcaccaaccugaacgccaucacccccaucaucacggaccaguucgagguccaguucaagaccguggaggccuacucccucccgcgcaucaucgccgugcggaaccacgagaucauggucgggcagaucaacgacaucggcguguacagcaaggggugcggcaacgugcagaaggucaacaacaccaacuacggcaacggggugcccaaguucgacuaccugugccaccuggccagccgcaaggaggugaucguccggaagugcuucgacaacgacuaccaggcgugcaaguuccuccagauccccgccuccuaccgccuggaggaggagggcgggagcgugaccgugaucgacuacaagaagauccugggcacgaucaagaugaaggccauccucggggacgucaaguacaagaccuucgccgacaacguggaccugaccguggagggcgucugcaccggcugcaucaacugcuucgagaacauccacugcgagcugacgauccacuccaccguggaggccagcugccccguggucuccagcugcaccguguuccacgaccggauccucaucaccccgaacgagcacaaguacgcgaucaaggugaucugcaacgagaagcccgggcccacgcugcccuucaagaucugcuccgccaagaccgacgccgccaugacccuggcggacgccaagccgauccucgagcuggcccccgucgaccagaccacguacaucaaggagaaggacgagcgcugcaagaccuggaugugccgggugcgcgacgagggcuuccaggucaucuucgagcccuucaagaaccuguucgggagcuacaucggcaucuucuacaccuucaucaucucccucauggccaucuucaucgugaucuacaucgugcugcccaucugcuucaagcugcgcgacacccuccggcagcacgaggacgccuacaagcgcgagaugaagauccgguga

SEQ ID NO: 12630 - RNA, 4323 nt, Artificial Sequence
  derived and/or modified CDS sequence (opt1) from TAHV(4057)__GQ386839.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgugaaguccggcugguucaaguccaccacguacaucacccucgaccagaccugcgagcaccugaaggggagcugcggccccaaguccauccaguuccacgccugcuucaaccagcacaugagcugcgugcgcuuccugcaccggaccauccuccccggguccaucgccagcuccaucugccagaacgucgagaucaucauccugacggugcugacccuccugaucuucauccugcucagcauccuguccaagaccuacaucugcuacauccugaugccgaucuucaucccccucgccuacaucuacggcgugaucuacaacaagagcugcaagaagugcaagcugugcgggcuggucuaccaccccuucaccgagugcggcacgcacugcgugugcggcgcgcgcuacgagaccuccgaccggaugaagcuccaccgcgccagcgggcugugccccggcuacaagucccugcgggccgcccgcgugaugugcaagagcaaggggccggccagcauccucuccaucaucaccgcgguccugauccugaccuucgugacgcccaucaacgccaugguggccggcgacacccaggagaccuucaagcucgaggaccugcccgacgacaugcugagcauggccaugaaggucaacauguacuacaucaugugcaucaucaacuacgccgugaccugguccuucauccucugcgcgcugcugaucgcccuccuguucaagaaguaccagcaccgguuccugaacuucuacgccauguacugccacgagugcgacauguaccacgaccgcagcggccucaaguacaacggggacuucacgaacaagugccggcagugcacgugcggccaguacgaggacgccgccgggcugcugacccaccgcaagaccuacaacugccucguccaguacaaguccaaguggcugacgaacuuccugaucguguacaucauccucaugcugaucaaggacagcgugcugaucguccacgcggacggcaccgacuucgagaagugcuccggggaggccgacaucaccuggaacugcaccggccccuuccucaaccugggcaacugcgagaagaagcagaagaaggagagcuacaacaacaucgccacgcagcugaaggggcucgacgccaucuccgugcuggacaucccgaugaucagcaagauccccgaggacaucgcgggcgcccugcgguucaucgaggagcagcgcuccuaccacgugcagcugaccgccgaguacgccaugcucacccgguacugcgacuacuacacccaguucaccgacaacagcggguacucccagacgaccuggcgcgucuaccugcggagccacgacuucgaggccugcauccuguaccccaaccagcacuucugccgcugcgugaagcacggcgacaagugcuccagcuccaacugggacuucgcgaacgagaugaagaacuacuacagcgggaagcaguccaaguucgacaaggaccucaaccuggcccugaugagccuccaccacgccuuccgcggcaccagcuccuucuacaucgccaagcugcugaaggagaagaagaacggcgaccucgugaccuacgccgagaagaucaaggggaaguaccccggcaacgcgcugcugaaggccaucaucgacuacaucaaguacaugaaggaccucacggagaugaacaacuucaagcacgacgagaugugggacgacuucaucuucgaggucccgcccaccaagagccccuccgugcggcgccuggagagcuccuacgacuucaagaccaacgugaacagcaaccccucccacaucugcaagaacaucaagaccgucgugugccugagcccgaaguccggggugagcuacgacuccaucaucgccugcggcgagcccagccagcccuccaucuaccggaagcccgacagccaggucuuccaguccaacgccgaccagacgcacuucugccucagcgacacccacugccuggagaacuacgagaccgugggggaggagaucaucgacgccaucaagaaguccaagugcugggagaccgaguucacggaguacauccaguucaagcagagcgacggcgugcgcagcugccggaugaaggacuccggcgagugcaccgucaccaccaacaaguggccgaucauccugugcgacaacgacaaguucuacuacagcgagcuccagaaggacuacgacaaggaccaggacaucgggcacuucugccugagcccccgcugcaacacgauccggcaccccaucaaccgcaagcacaucagcaacugcaccuggcaggucucccacaacaacaucgacaagaucgaggugcacgagcuggaggaccucgagcaguacaagaaggcgaucacccagaagcugcagaccagccugacccucuucaaguacuccaagaccaagaaccugccccacaucaagccgauguacaaguacaucaccaucgagggcaccgagacggccgaggggaucgagagcgccuacaucgaguccgagauccccgcccuggcgggcaccagcaucggcuucaagaucaccuccaagagcgggcggcaccuccuggacgugaucggcuacgugaaguccgccagcuacuccgccguguacaccaagcuguacacgaccgggcccaccaucggcgucaacaccaagcacgacgagcucugcacggggccgugccccgugaacgugccccacggcaccggcuggcugaccuucgccaaggagcgcaccagcuccugggggugcgaggaguucggcugccuggccaucagcgacgggugcgucuucggcuccugccaggacaucaucaaggacgagaucacgguguaccggaaggagaccgaggagaccaccgacguggagcucugccugaccuucgcggacaagacguacugcaccaaccugaacgccaucacccccaucaucaccgaccaguucgagguccaguucaagacgguggaggccuacagccucccgcgcaucaucgccgugcggaaccacgagaucauggucgggcagaucaacgacaucggcguguacagcaagggcugcgggaacgugcagaaggucaacaacaccaacuacggcaacggggugcccaaguucgacuaccugugccaccuggccucccgcaaggaggugaucguccggaagugcuucgacaacgacuaccaggcgugcaaguuccuccagacccccgccagcuaccgccuggaggaggagggcggguccgugaccgugaucgacuacaagaagauccugggcacgaucaagaugaaggccauccucggcgacgucaaguacaagaccuucgccgacaacguggaccugaccguggagggggucugcaccggcugcgugaacugcuucgagaacauccacugcgagagcacgauccacuccaccguggaggccagcugccccgucguguccagcugcaccguguuccacgaccggauccugaucaccccgaacgagcacaaguacgcgaucaaggucaucugcaacgagaagcccgggcccacgcuccccuucaagaucugcuccgccaagaccgacgccgccaugacccuggcggacgccaagccgauccuggagcucgcccccguggaccagaccacguacaucaaggagaaggacgagcgcugcaagaccuggaugugccggguccgcgacgagggcuuccaggugaucuucgagcccuucaagaaccuguucgggagcuacaucggcaucuucuacaccuucaucaucucccugauggccaucuucaucgugaucuacaucguccuccccaucugcuucaagcugcgcgacacccugcggcagcacgaggacgccuacaagcgcgagaugaagauccgguga

SEQ ID NO: 12631 - RNA, 4323 nt, Artificial Sequence
  derived and/or modified CDS sequence (opt1) from TAHV(4060)__GQ386840.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgugaaguccggcugguucaaguccaccacguacaucacccucgaccagaccugcgagcaccugaaggugagcugcgggcccaaguccauccaguuccacgccugcuucaaccagcacaugagcugcguccgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcgauccugauccugaccuucgugacgcccaucaacgccaugguggccggggacacccaggagaccuucaagcucgaggaccugcccgacgacaugcugagcauggccaugaaggucaacauguacuacaucaugugcaugaucaacuacgccgugaccugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucacgaacaagugccggcagugcacgugcgggcaguacgaggacgccgccggccugcagacccaccgcaagaccuacaacugccugguccaguacaaguccaaguggcucaccaacuuccugaucguguacaucauccugaugcucaucaaggacagcgugcugaucguccacgcggacgggaccgacuucgagaagugcuccggcgaggccgacaucaccuggaacugcaccgggcccuuccugaaccucggcaacugcgagaagaagcagaagaaggagagcuacaacaacaucgccacgcagcugaagggccuggacgccaucuccgugcucgacaucccgaugaucagcaagauccccgaggacaucgcgggggcccugcgguucaucgaggagcagcgcuccuaccacgugcagcugaccgccgaguacgccaugcugacccgguacugcgacuacuacacccaguucaccgacaacagcggcuacucccagacgaccuggcgcgucuaccuccggagccacgacuucgaggccugcauccuguaccccaaccagcacuucugccgcugcgugaagcacggggacaagugcuccagcuccaacugggacuucgcgaacgagaugaagaacuacuacagcggcaagcaguccaaguucgacaaggaccugaaccucgcccugaugagccugcaccacgccuuccgcgggaccagcuccuucuacaucgccaagcuccugaaggagaagaagaacgaggaccuggugaccuacgccgagaagaucaagggcaaguaccccggcaacgcgcuccugaaggccaucaucgacuacaucaaguacaugaaggaccugacggagaugaacaacuucaagcacgacgagaugugggacgacuucaucuucgaggucccgcccaccaagagccccuccgugcggcgccucgagagcuccuacgacuucaagaccaacgugaacagcaaccccucccacaucugcaagaacaucaagaccgucgugugccugagcccgaaguccggggugagcuacgacuccaucaucgccugcggcgagcccagccagcccuccaucuaccggaagcccgacagccaggucuuccaguccaacgccgaccagacgcacuucugccugagcgacacccacugccucgagaacuacgagaccgugggggaggagaucaucgacgccaucaagaaguccaagugcugggagaccgaguucacggaguacacccaguucaagcagagcgacggcgugcgcagcugccggaugaaggacuccggggagugcaccgucaccacgaaccgcuggccgaucauccugugcgacaacgacaaguucuacuacagcgagcugcagaaggacuacgacaaggaccaggacaucggccacuucugccucagcccccggugcaacaccauccgccaccccaucaaccggaagcacaucagcaacugcaccuggcaggucucccacaacaacaucgacaagaucgaggugcacgagcuggaggaccuggagcaguacaagaaggcgaucacccagaagcuccagacgagccugacccuguucaaguacuccaagaccaagaaccucccccacaucaagccgauguacaaguacaucaccaucgagggcacggagaccgccgaggggaucgagagcgccuacaucgaguccgagauccccgcccuggcgggcaccagcaucggguucaagaucaccuccaagagcggcaagcaccuccuggacgugaucggcuacgugaaguccgccagcuacuccgccguguacacgaagcuguacaccaccgggcccaccaucggcgucaacacgaagcacgacgagcugugcaccgggccgugccccgugaacgugccccacggcaccggguggcucaccuucgccaaggagcgcacgagcuccuggggcugcgaggaguucggcugccuggccaucagcgacgggugcgucuucggcuccugccaggacaucaucaaggacgagaucaccguguaccggaaggagaccgaggagaccaccgacguggagcugugccucacguucgcggacaagaccuacugcaccaaccugaacgccaucacccccaucaucacggaccaguucgagguccaguucaagaccguggaggccuacagccugccgcgcaucaucgccgugcggaaccacgagaucauggucgggcagaucaacgacaucggcguguacagcaaggggugcggcaacgugcagaaggucaacaacaccaacuacggcaacggggugcccaaguucgacuaccucugccaccuggccucccgcaaggaggugaucguccggaagugcuucgacaacgacuaccaggcgugcaaguuccugcagacccccgccagcuaccgccucgaggaggagggcggguccgugacggugaucgacuacaagaagauccugggcaccaucaagaugaaggccauccugggggacgucaaguacaagaccuucgccgacaacguggaccucaccguggagggcgucugcacgggcugcaucaacugcuucgagaacauccacugcgagcugaccauccacagcaccguggaggccuccugccccguggucagcuccugcaccguguuccacgaccggauccugaucacgccgaacgagcacaaguacgcgaucaaggugaucugcaacgagaagcccgggcccacccuccccuucaagaucugcagcgccaagaccgacgccgccaugacccuggcggacgccaagccgauccuggagcucgcccccgucgaccagacgaccuacaucaaggagaaggacgagcgcugcaagaccuggaugugccgggugcgcgacgagggcuuccaggucaucuucgagcccuucaagaaccuguucggguccuacaucggcaucuucuacaccuucaucaucagccugaucgccaucuucaucgugaucuacaucgugcuccccaucugcuucaagcugcgcgacacgcugcggcagcacgaggacgccuacaagcgcgagaugaagauccgguga

SEQ ID NO: 12632 - RNA, 4323 nt, Artificial Sequence
  derived and/or modified CDS sequence (opt1) from TAHV(5060)__GQ386841.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgucaagagcggcugguucaaguccaccacguacaucacccucgaccagaccugcgagcaccugaaggugagcugcgggcccaaguccauccaguuccacgccugcuucaaccagcacaugagcugcgugcgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaucaucaacuacgccgucaccugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucacgaacaagugccggcagugcacgugcgggcaguacgaggacgccgccggccugcugacccaccgcaagaccuacaacugccucgugcaguacaaguccaaguggcugacgaacuuccugaucguguacaucauccucaugcugaucaaggacagcguccugaucgugcacgcggacgggaccgacuucgagaagugcuccggcgaggccgacaucaccuggaacugcaccgggcccuuccucaaccugggcaacugcgagaagaagcagaagaaggagagcuacaacaacaucgccacgcagcugaagggccucgacgccaucuccgugcuggacaucccgaugaucagcaagauccccgaggacaucgcgggggcccugcgguucaucgaggagcagcgcuccuaccacguccagcugaccgccgaguacgccaugcucacccgguacugcgacuacuacacccaguucaccgacaacagcggcuacucccagacgaccuggcgcguguaccugcggagccacgacuucgaggccugcauccuguaccccaaccagcacuucugccgcugcgugaagcacggggacaagugcuccagcuccaacugggacuucgcgaacgagaugaagaacuacuacagcggcaagcaguccaaguucgacaaggaccucaaccuggcccugaugagccuccaccacgccuuccgcgggaccagcuccuucuacaucgccaagcugcugaaggagaagaagaacggcgaccucgucaccuacgccgagaagaucaagggcaaguaccccgggaacgcgcugcugaaggccaucaucgacuacaucaaguacaugaaggaccucacggagaugaacaacuucaagcacgacgagaugugggacgacuucaucuucgaggugagcccgaccaagucccccagcgugcggcgccuggaguccagcuacgacuucaagaccaacgucaacuccaaccccagccacaucugcaagaacaucaagaccguggugugccugucccccaagagcggcgucuccuacgacagcaucaucgccugcggggagccgucccagcccagcaucuaccggaagcccgacucccagguguuccagagcaacgccgaccagacgcacuucugccucuccgacacccacugccuggagaacuacgagaccgugggcgaggagaucaucgacgccaucaagaaguccaagugcugggagaccgaguucacggaguacauccaguucaagcagagcgacgggguccgcagcugccggaugaaggacagcggcgagugcaccgugaccaccaacaaguggcccaucauccugugcgacaacgacaaguucuacuacuccgagcuccagaaggacuacgacaaggaccaggacaucggccacuucugccugagcccgcgcugcaacacgauccggcaccccaucaaccgcaagcacaucuccaacugcaccuggcaggucagccacuccaacaucgacaagaucgaggugcacgagcuggaggaccucgagcaguacaagaaggcgaucacccagaagcugcagaccagccugacccucuucaaguacuccaagaccaagaaccugccccacaucaagcccaucuacaaguacaucaccaucgaggggaccgagacggccgagggcaucgagagcgccuacaucgaguccgagaucccggcccuggcggggaccagcaucggcuucaagaucaccuccaagagcggcaagcaccuccuggacgugaucggguacgugaaguccgccagcuacuccgccgucuacaccaagcuguacacgaccggccccaccaucggggugaacaccaagcacgacgagcucugcacgggccccugcccggugaacgucccccacgggaccggcuggcugaccuucgccaaggagcggaccagcuccuggggcugcgaggaguucgggugccuggccaucagcgacggcugcguguucgggagcugccaggacaucaucaaggacgagaucacgguguaccgcaaggagaccgaggagaccaccgacgucgagcucugccugaccuucgcggacaagacguacugcaccaaccugaacgccaucacccccaucaucaccgaccaguucgaggugcaguucaagacgguggaggccuacucccucccccggaucaucgccguccgcaaccacgagaucauggugggccagaucaacgacaucgggguguacagcaagggcugcggcaacguccagaaggugaacaacaccaacuacgggaacggcgugccgaaguucgacuaccugugccaccuggccucccggaaggaggucaucgugcgcaagugcuucgacaacgacuaccaggcgugcaaguuccuccagacccccgccagcuaccggcuggaggaggagggcggguccgugaccgucaucgacuacaagaagauccuggggacgaucaagaugaaggccauccucggcgacgugaaguacaagaccuucgccgacaacguggaccugaccgucgagggcgugugcaccgggugcaucaacugcuucgagaacauccacugcgagcugacgauccacagcaccguggaggccuccugccccgucgugagcuccugcaccguguuccacgaccgcauccucaucacccccaacgagcacaaguacgcgaucaaggucaucugcaacgagaagccgggccccacgcugcccuucaagaucugcagcgccaagaccgacgccgccaugacccuggcggacgccaagcccauccucgagcuggccccgguggaccagaccacguacaucaaggagaaggacgagcggugcaagaccuggaugugccgcguccgggacgagggguuccaggugaucuucgagcccuucaagaaccuguucggcuccuacaucgggaucuucuacaccuucaucaucagccucauggccaucuucaucgugaucuacaucguccugcccaucugcuucaagcugcgcgacacccuccgccagcacgaggacgccuacaagcgggagaugaagauccgcuga

SEQ ID NO: 12633 - RNA, 4323 nt, Artificial Sequence
  derived and/or modified CDS sequence (opt1) from TAHV(76)__GQ386824.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgugaaguccggcugguucaaguccaccacguacaucacccucgaccagaccugcgagcaccugaaggugagcugcgggcccaaguccauccaguuccacgccugcuucaaccagcacaugagcugcguccgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucacgaacaagugccggcagugcacgugcgggcaguacggcgacgccgccgggcugcugacccaccgcaagaccuacaacugccucgugcaguacaaguccaaguggcugaccaacuuccugaucguguacaucauccucaugcugaucaaggacagcguccugaucgugcacgcggacggcaccgacuucgagaagugcuccggggaggccgacaucaccuggaacugcaccggccccuuccucaaccugggcaacugcgagaagaagcagaagaaggagagcuacaacaacaucgccacgcagcugaaggggcucgacgccaucuccgugcuggacaucccgaugaucagcaagauccccgaggacaucgcgggcgcccugcgguucaucgaggagcagcgcuccuaccacguccagcugaccgccgaguacgccaugcucacccgguacugcgacuacuacacccaguucaccgacaacagcggguacucccagacgaccuggcgcguguaccugcggagccacgacuucgaggccugcauccuguaccccaaccagcacuucugccgcugcgugaagcacggcgacaagugcuccagcuccaacugggacuucgcgaacgagaugaagaacuacuacagcgggaagcaguccaaguucgacaaggaccucaaccuggcccugaugagccuccaccacgccuuccgcggcaccagcuccuucuacaucgccaagcugcugaaggagaagaagaacgaggaccucgucaccuacgccgagaagaucaagggcaaguaccccgggaacgcgcugcugaaggccaucaucgacuacaucaaguacaugaaggaccucacggagaugaacaacuucaagcacgacgagaugugggacgacuucaucuucgaggugccgcccaccaagagccccuccgugcggcgccuggagagcuccuacgacuucaagaccaacgucaacagcaaccccucccacaucugcaagaacaucaagaccguggugugccugagcccgaaguccggcgucagcuacgacuccaucaucgccugcggggagcccagccagcccuccaucuaccggaagcccgacagccagguguuccaguccaacgccgaccagacgcacuucugccucagcgacacccacugccuggagaacuacgaggccgugggcgaggagaucaucgacgcgaucaagaaguccaagugcugggagaccgaguucaccgaguacauccaguucaagcagagcgacgggguccgcagcugccggaugaaggacuccggcgagugcacggugaccaccaaccgcuggccgaucauccugugcgacaacgacaaguucuacuacagcgagcuccagaaggacuacgacaaggaccaggacaucggccacuucugccugagcccccggugcaacaccauccgccaccccaucaaccggaagcacaucagcaacugcacguggcaggucucccacaacaacaucgacaagaucgaggugcacgagcuggaggaccucgagcaguacaagaaggccaucacccagaagcugcagaccagccugacccucuucaaguacuccaagacgaagaaccugccccacaucaagccgauguacaaguacaucaccaucgaggggaccgagaccgccgagggcaucgagagcgccuacaucgaguccgagauccccgcgcuggccgggacgagcaucggcuucaagaucaccuccaagagcggcaagcaccuccuggacgugaucuccuacgucaagagcgccuccuacagcgccguguacaccaagcuguacaccacggggcccaccaucggcgugaacaccaagcacgacgagcucugcaccgggccgugccccgugaacgucccccacggcacgggguggaucaccuucgccaaggagcgcaccuccagcuggggcugcgaggaguucggcugccuggcgaucuccgacgggugcguguucggcagcugccaggacaucaucaaggacgagaucaccguguaccggaaggagacggaggagaccaccgacgucgagcugugccucaccuucgccgacaagaccuacugcacgaaccugaacgccaucacccccaucaucaccgaccaguucgaggugcaguucaagaccguggaggccuacagccugccgcgcaucaucgccguccggaaccacgagaucaugguggggcagaucaacgacaucggcguguacuccaaggggugcggcaacguccagaaggugaacaacacgaacuacggcaacggggugcccaaguucgacuaccucugccaccuggcgagccgcaaggaggucaucgugcggaagugcuucgacaacgacuaccaggccugcaaguuccugcagacccccgccuccuaccgccucgaggaggagggcgggagcgugaccgucaucgacuacaagaagauccugggcaccaucaagaugaaggccauccugggggacgugaaguacaagacguucgccgacaacguggaccucaccgucgagggcgugugcaccggcugcaucaacugcuucgagaacauccacugcgagcugaccauccacuccacgguggaggcgagcugccccgucguguccagcugcaccguguuccacgaccggauccugaucaccccgaacgagcacaaguacgccaucaaggucaucugcaacgagaagcccgggcccacccuccccuucaagaucugcuccgccaagacggacgccgcgaugacccuggccgacgccaagccgauccuggagcucgcccccguggaccagaccaccuacaucaaggagaaggacgagcgcugcaagacguggaugugccggguccgcgacgagggcuuccaggugaucuucgagcccuucaagaaccuguucgggagcuacaucggcaucuucuacaccuucaucaucucccugauggccaucuucaucgugaucuacaucguccuccccaucugcuucaagcugcgcgacacccugcggcagcacgaggacgcguacaagcgcgagaugaagauccgguga

SEQ ID NO: 12634 - RNA, 4323 nt, Artificial Sequence
  derived and/or modified CDS sequence (opt1) from TAHV(83)__GQ386825.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgugaaguccggcugguucaaguccaccacguacaucacccucgaccagaccugcgagcaccugaaggugagcugcgggcccaaguccauccaguuccacgccugcuucaaccagcacaugagcugcguccgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucacgaacaagugccggcagugcacgugcgggcaguacgaggacgccgccggccugcugacccaccgcaagaccuacaacugccucgugcaguacaaguccaaguggcugacgaacuuccugaucguguacaucauccucaugcugaucaaggacagcguccugaucgugcacgcggacgggaccgacuucgagaagugcuccggcgaggccgacaucaccuggaacugcaccgggcccuuccucaaccugggcaacugcgagaagaagcagaagaaggagagcuacaacaacaucgccacgcagcugaagggccucgacgccaucuccgugcuggacaucccgaugaucagcaagauccccgaggacaucgcgggggcccugcgguucaucgaggagcagcgcuccuaccacguccagcugaccgccgaguacgccaugcucacccgguacugcgacuacuacacccaguucaccgacaacagcggcuacucccagacgaccuggcgcguguaccugcggagccacgacuucgaggugugcauccuguaccccaaccagcacuucugccgcugcgucaagcacggggacaagugcuccagcuccaacugggacuucgccaacgagaugaagaacuacuacagcggcaagcaguccaaguucgacaaggaccucaaccuggcgcugaugagccuccaccacgccuuccgcgggaccagcuccuucuacaucgccaagcugcugaaggagaagaagaacgaggaccucgugaccuacgccgagaagaucaagggcaaguaccccggcaacgcccugcugaaggcgaucaucgacuacaucaaguacaugaaggggcucacggagaugaacaacuucaagcacgacgaggugugggacgacuucaucuucgaggucccgcccaccaagagccccuccgugcggcgccuggagagcuccuacgacuucaagaccaacgugaacagcaaccccucccacaucugcaagaacaucaagaccgucgugugccugagcccgaaguccggcgugagcuacgacuccaucaucgccugcggggagcccagccagcccuccaucuaccggaagcccgacagccaggucuuccaguccaacgccgaccagacgcacuucugccucagcgacacccacugccuggagaacuacgagaccgugggcgaggagaucaucgacgccaucaagaaguccaagugcugggagaccgaguucacggaguacauccaguucaagcagagcgacggggugcgcagcugccggaugaaggacuccggcgagugcaccgucaccaccaaccgcuggccgaucauccugugcgacaacgacaaguucuacuacagcgagcuccagaaggacuacgacaaggaccaggacaucggccacuucugccugagcccccggugcaacacgauccgccaccccaucaaccggaagcacaucagcaacugcaccuggcaggucucccacaacaacaucgacaagaucgaggugcacgagcuggaggaccucgagcaguacaagaaggccaucacccagaagcugcagaccagccugacccucuucaaguacuccaagaccaagaaccugccccacaucaagccgauguacaaguacaucaccaucgaggggaccgagacggcggagggcaucgagagcgccuacaucgaguccgagauccccgcccuggccgggaccagcaucggcuucaagaucaccuccaagagcggcaagcaccuccuggacgugaucggguacgugaaguccgcgagcuacuccgccguguacaccaagcuguacacgaccggccccaccaucggggucaacaccaagcacgacgagcucugcacgggcccgugccccgugaacgugccccacgggaccggcuggcugaccuucgccaaggagcgcaccagcuccuggggcugcgaggaguucgggugccuggccaucagcgacggcugcgucuucggguccugccaggacaucaucaaggacgagaucacgguguaccggaaggagaccgaggagaccaccgacguggagcucugccugaccuucgccgacaagacguacugcaccaaccugaacgcgaucacccccaucaucaccgaccaguucgagguccaguucaagacgguggaggccuacagccucccgcgcaucaucgccgugcggaaccacgagaucauggucggccagaucaacgacaucgggguguacagcaagggcugcggcaacgugcagaaggucaacaacaccaacuacgggaacggcgugcccaaguucgacuaccugugccaccuggccucccgcaaggaggugaucguccggaagugcuucgacaacgacuaccaggccugcaaguuccuccagacccccgcgagcuaccgccuggaggaggagggcggguccgugaccgugaucgacuacaagaagauccuggggacgaucaagaugaaggccauccucggcgacgucaaguacaagaccuucgccgacaacguggaccugaccguggagggcgucugcaccgggugcaucaacugcuucgagaacauccacugcgagcugacgauccacagcaccguggaggccuccugccccguggucagcuccugcaccguguuccacgaccggauccucaucaccccgaacgagcacaaguacgccaucaaggucaucugcaacgagaagcccggccccacgcugcccuucaagaucugcagcgcgaagaccgacgccgccaugacccuggccgacgcgaagccgauccucgagcuggcccccguggaccagaccacguacaucaaggagaaggacgagcgcugcaagaccuggaugugccgggugcgcgacgagggguuccaggucaucuucgagcccuucaagaaccuguucggcuccuacaucgggaucuucuacaccuucaucaucagccucauggccaucuucaucgugaucuacaucgugcugcccaucugcuucaagcugcgcgacacccuccggcagcacgaggacgccuacaagcgcgagaugaagauccgguga

SEQ ID NO: 12635 - RNA, 4323 nt, Artificial Sequence
  derived and/or modified CDS sequence (opt1) from TAHV(89)__GQ386826.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgugaaguccggcugguucaaguccaccacguacaucacccucgaccagaccugcgagcaccugaaggugagcugcgggcccaaguccauccaguuccacgccugcuucaaccagcacaugagcugcguccgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucacgaacaagugccggcagugcacgugcgggcaguacgaggacgccgccggccugcugacccaccgcaagaccuacaacugccucgugcaguacaaguccaaguggcugacgaacuuccugaucggguacaucauccucaugcugaucaaggacagcgugcugaucguccacgcggacggcaccgacuucgagaagugcuccggggaggccgacaucaccuggaacugcaccggccccuuccucaaccugggcaacugcgagaagaagcagaagaaggagagcuacaacaacaucgccacgcagcugaaggggcucgacgccaucuccgugcuggacaucccgaugaucagcaagauccccgaggacaucgcgggcgcccugcgguucaucgaggagcagcgcuccuaccacgugcagcugaccgccgaguacgccaugcucacccgguacugcgacuacuacacccaguucaccgacaacagcggguacucccagacgaccuggcgcgucuaccugcggagccacgacuucgaggccugcauccuguaccccaaccagcacuucugccgcugcgugaagcacggcgacaagugcuccagcuccaacugggacuucgcgaacgagaugaagaacuacuacagcgggaagcaguccaaguucgacaaggaccucaaccuggcccugaugagccuccaccacgccuuccgcggcaccagcuccuucuacaucgccaagcugcugaaggagaagaagaacgaggaccucgugaccuacgccgagaagaucaagggcaaguaccccgggaacgcgcugcugaaggccaucaucgacuacaucaaguacaugaagggccucacggagaugaacaacuucaagcacgacgagaugugggacgacuucaucuucggggucccgcccaccaagagccccuccgugcggcgccuggagagcuccuacgacuucaagaccaacgugaacagcaaccccucccacaucugcaagaacaucaagaccgucgugugccugagcccgaaguccggcgugagcuacgacuccaucaucgccugcggggagcccagccagcccuccaucuaccggaagcccgacagccaggucuuccaguccaacgccgaccagacgcacuucugccucagcgacacccacugccuggagaacuacgagaccgugggcgaggagaucaucgacgccaucaagaaguccaagugcugggagaccgaguucacggaguacauccaguucaagcagagcgacggcgugcgcagcugccggaugaaggacuccggggagugcaccgucaccaccaaccgcuggccgaucauccugugcgacaacgacaaguucuacuacagcgagcuccagaaggacuacgacaaggaccaggacaucggccacuucugccugagcccccggugcaacacgauccgccaccccaucaaccggaagcacaucagcaacugcaccuggcaggucaaccacaacaacaucgacaagaucgaggugcacgagcuggaggaccucgagcaguacaagaaggcgaucacccagaagcugcagaccucccugacccucuucaaguacagcaagaccaagaaccugccccacaucaagccgauguacaaguacaucaccaucgaggggaccgagacggccgagggcaucgaguccgccuacaucgagagcgagauccccgcccuggcgggcaccuccaucggguucaagaucaccagcaaguccggcaagcaccuccuggacgugaucggguacgucaagagcgccuccuacagcgccguguacaccaagcuguacacgaccggccccaccaucggggugaacaccaagcacgacgagcucugcacgggcccgugccccgugaacgugccccacuccaccggcuggcugaccuucgccaaggagcgcaccagcuccugggggugcgaggaguucggcugccuggccaucagcgacgggugcgucuucggcuccugccaggacaucaucaaggacgagaucacgguguaccggaaggagaccgaggagaccaccgacguggagcucugccugaccuucgcggacaagacguacugcaccaaccugaacgccgucacccccaucaucaccgaccaguucgaggugcaguucaagacgguggaggccuacagccucccgcgcaucaucgccguccggaaccacgagaucaugguggggcagaucaacgacaucggcguguacagcaagggcugcgggaacguccagaaggugaacaacaccaacuacggcaacggggugcccaaguucgacuaccugugccaccuggccucccgcaaggaggucaucgugcggaagugcuucgacaacgacuaccaggcgugcaaguuccuccagacccccgccagcuaccgccuggaggaggagggcggguccgugaccgucaucgacuacaagaagauccugggcacgaucaagaugaaggccauccucggcgacgugaaguacaagaccuucgccgacaacgccgaccugaccguggagggggucugcaccggcugcaucaacugcuucgagaacauccacugcgagcugacgauccacagcaccguggaggcguccugccccguggucagcuccugcaccguguuccacgaccggauccucaucaccccgaacgagcacaaguacgccaucaaggugaucugcaacgagaagcccgggcccacgcugcccuucaagaucugcagcgccaagaccgacgccgcgaugacccuggccgacgccaagccgauccucgagcuggcccccgucgaccagaccacguacaucaaggagaagggcgagcgcugcaagaccuggaugugccgggugcgcgacgagggguuccaggucaucuucgagcccuucaagaaccuguucggcuccuacaucggcaucuucuacaccuucaucaucagccucauggccaucuucaucgugaucuacaucgugcugcccaucugcuucaagcugcgcgacacccuccggcagcacgaggacgcguacaagcgcgagaugaagauccgguga

SEQ ID NO: 12636 - RNA, 4323 nt, Artificial Sequence
  derived and/or modified CDS sequence (opt1) from TAHV(90)__GQ386827.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguggccggcgggcacaucaacgugaucgaggucggcgacgaccucacccugcacaccgaggccuacgugugcaacgcggacugcacgaucgggguggacaaggagaccgcccagguccggcugcagaccgacaccacgaaccacuucgagaucgccggcaccaccgugaaguccggcugguucaagagcaccacguacaucacccucgaccagaccugcgagcaccugaagguguccugcgggcccaagagcauccaguuccacgccugcuucaaccagcacauguccugcguccgcuuccugcaccggaccauccuccccggcagcaucgccuccagcaucugccagaacguggagaucaucauccugacggugcugacccuccugaucuucauccugcucuccauccugagcaagaccuacaucugcuacauccugaugccgaucuucaucccccucgcguacaucuacggggucaucuacaacaaguccugcaagaagugcaagcugugcggccugguguaccaccccuucaccgagugcgggacgcacugcgugugcggcgcccgcuacgagaccagcgaccggaugaagcuccaccgcgccuccggccugugccccggguacaagagccugcgggccgcccgcgucaugugcaaguccaagggcccggcgagcauccucagcaucaucaccgccgugcugauccugaccuucgugacgcccaucaacgccauggucgccggggacacccaggagaccuucaagcucgaggaccugcccgacgacaugcuguccauggccaugaaggugaacauguacuacaucaugugcaugaucaacuacgcggucaccuggagcuucauccucugcgcccugcugaucgcccuccuguucaagaaguaccagcaccgguuccugaacuucuacgccauguacugccacgagugcgacauguaccacgaccgcuccggccucaaguacaacggcgacuucacgaacaagugccggcagugcacgugcgggcaguacgaggacgccgcgggccugcugacccaccgcaagaccuacaacugccucgugcaguacaagagcaaguggcugacgaacuuccugaucggguacaucauccucaugcugaucaaggacuccgugcugaucguccacgccgacggcaccgacuucgagaagugcagcggggaggccgacaucaccuggaacugcaccggccccuuccucaaccugggcaacugcgagaagaagcagaagaaggaguccuacaacaacaucgccacgcagcugaaggggcucgacgcgaucagcgugcuggacaucccgaugaucuccaagauccccgaggacaucgccggcgcccugcgguucaucgaggagcagcgcagcuaccacgugcagcugaccgccgaguacgccaugcucacccgguacugcgacuacuacacccaguucaccgacaacuccggguacagccagacgaccuggcgcgucuaccugcggucccacgacuucgaggcgugcauccuguaccccaaccagcacuucugccgcugcgugaagcacggcgacaagugcagcuccagcaacugggacuucgccaacgagaugaagaacuacuacuccgggaagcagagcaaguucgacaaggaccucaaccuggcccugaugucccuccaccacgccuuccgcggcaccagcagcuucuacaucgccaagcugcugaaggagaagaagaacgaggaccucgugaccuacgcggagaagaucaagggcaaguaccccgggaacgcccugcugaaggccaucaucgacuacaucaaguacaugaagggccucacggagaugaacaacuucaagcacgacgagaugugggacgacuucaucuucgaggucccgcccaccaagucccccagcgugcggcgccuggaguccagcuacgacuucaagaccgacgugaacuccaaccccagccacaucugcaagaacaucaagaccgucgugugccugucccccaagagcgggguguccuacgacagcaucaucgccugcggcgagccgucccagcccagcaucuaccggaagcccgacucccaggucuuccagagcaacgccgaccagacgcacuucugccucuccgacacccacugccuggagaacuacgagaccgugggggaggagaucaucgacgcgaucaagaaguccaagugcugggagaccgaguucacggaguacauccaguucaagcagagcgacggcgugcgcagcugccggaugaaggacagcggcgagugcaccgucaccaccaaccgcuggccgaucauccugugcgacaacaacaaguucuacuacuccgagcuccagaaggacuacgacaaggaccaggacaucgggcacuucugccugagcccccggugcaacacgauccgccaccccaucaaccggaagcacaucuccaacugcaccuggcaggucaaccacaacaacaucgacaagaucgaggugcacgagcuggaggaccucgagcaguacaagaaggccaucacccagaagcugcagaccagccugacccucuucaaguacuccaagaccaagaaccugccccacaucaagccgauguacaaguacaucaccaucgagggcaccgagacggccgaggggaucgagagcgccuacaucgaguccgagauccccgcgcuggccggcaccagcaucggcuucaagaucaccuccaagagcgggaagcaccuccuggacgugaucggcuacgugaaguccgccagcuacuccgccguguacaccaagcuguacacgaccgggcccaccaucggcgucaacaccaagcacgacgagcucugcacggggccgugccccgugaacgugccccacggcaccggcuggcugaccuucgccaaggagcgcaccagcuccugggggugcgaggaguucggcugccuggcgaucagcgacgggugcgucuucggcuccugccaggacaucaucaaggacgagaucacgguguaccggaaggagaccgaggagaccaccgacguggagcucugccugaccuucgccgacaagacguacugcaccaaccugaacgccgucacccccaucaucaccgaccaguucgaggugcaguucaagacgguggaggccuacagccucccgcgcaucaucgccguccggaaccacgagaucaugguggggcagaucaacgacaucggcguguacuccaagggcugcgggaacguccagaaggugaacaacaccaacuacggcaacggggugcccaaguucgacuaccugugccaccuggcgagccgcaaggaggucaucgugcggaagugcuucgacaacgacuaccaggccugcaaguuccuccagacccccgccagcuaccgccuggaggaggagggcggguccgugaccgucaucgacuacaagaagauccugggcacgaucaagaugaaggccauccucggcgacgugaaguacaagaccuucgccgacaacguggaccugaccgucgagggggugugcaccggcugcaucaacugcuucgagaacauccacugcgagcugacgauccacagcaccguggaggcguccugccccgucgugagcuccugcaccgccuuccacgaccggauccucaucaccccgaacgagcacaaguacgccaucaaggugaucugcaacgagaagcccgggcccacgcugcccuucaagaucugcagcgccaagaccgacgcggccaugacccuggccgacgccaagccgauccucgagcuggcccccgucgaccagaccacguacaucaaggagaaggacgagcgcugcaagaccuggaugugccgggugcgcgacgagggcuuccaggucaucuucgagcccuucaagaaccuguucggguccuacaucggcaucuucuacaccuucaucaucagccucauggcgaucuucaucgugaucuacaucgugcugcccaucugcuucaagcugcgcgacacccuccggcagcacgaggacgccuacaagcgcgagaugaagauccgguga

SEQ ID NO: 12637 - RNA, 4323 nt, Artificial Sequence
  derived and/or modified CDS sequence (opt1) from TAHV(94)__GQ386828.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuuccgcaacgccacggggaccuacgcgaacaacguggccauccggaaguggcuggucagcgacuggcacgacugccgccccaagaagguguccggcgggcacaucaacgugaucgaggucggcgacgaccucacccugcacaccgaggccuacgugugcaacgccgacugcacgaucgggguggacaaggagaccgcgcagguccggcugcagaccgacaccacgaaccacuucgagaucgccggcaccaccgugaaguccggcugguucaaguccaccacguacaucacccucgaccagaccugcgagcaccugaaggugagcugcgggcccaaguccauccaguuccacgccugcuucaaccagcacaugagcugcguccgcuuccugcaccggaccauccuccccggcuccaucgccagcuccaucugccagaacguggagaucaucauccugacggugcugacccuccugaucuucauccugcucagcauccuguccaagaccuacaucugcuacauccugaugccgaucuucaucccccucgccuacaucuacggggucaucuacaacaagagcugcaagaagugcaagcugugcggccugguguaccaccccuucaccgagugcgggacgcacugcgugugcggcgcgcgcuacgagaccuccgaccggaugaagcuccaccgcgccagcggccugugccccggguacaagucccugcgggccgcccgcgucaugugcaagagcaagggcccggccagcauccucuccaucaucaccgcggugcugauccugaccuucgugacgcccaucaacgccauggucgccggggacacccaggagaccuucaagcucgaggaccugcccgacgacaugcugagcauggccaugaaggugaacauguacuacaucaugugcaugaucaacuacgccgucaccugguccuucauccucugcgcgcugcugaucgcccuccuguucaagaaguaccagcaccgguuccugaacuucuacgccauguacugccacgagugcgacauguaccacgaccgcagcggccucaaguacaacggcgacuucacgaacaagugccggcagugcacgugcgggcaguacgaggacgccgccgcgcugcugacccaccgcaagaccuacaacugccucgugcaguacaaguccaaguggcugacgaacuuccugaucguguacaucauccucaugcugaucaaggacagcguccugaucgugcacgccgacggcaccgacuucgagaagugcuccggggaggccgacaucaccuggaacugcaccggccccuuccucaaccuggggaacugcgagaagaagcagaagaaggagagcuacaacaacaucgccacgcagcugaagggccucgacgcgaucuccgugcuggacaucccgaugaucagcaagauccccgaggacaucgccggcgcccugcgguucaucgaggagcagcgcuccuaccacguccagcugaccgccgaguacgccaugcucacccgguacugcgacuacuacacccaguucaccgacaacagcggguacucccagacgaccuggcgcguguaccugcggagccacgacuucgaggugugcauccuguaccccaaccagcacuucugccgcugcgucaagcacggcgacaagugcuccagcuccaacugggacuucgcgaacgagaugaagaacuacuacagcgggaagcaguccaaguucgacaaggaccucaaccuggcccugaugagccuccaccacgccuuccgcggcaccagcuccuucuacaucgccaagcugcugaaggagaagaagaacgaggaccucgugaccuacgccgagaagaucaaggggaaguaccccggcaacgcgcugcugaaggccaucaucgacuacgugaaguacaugaaggaccucacggagaugaacaacuucaagcacgacgagaugugggacgacuucaucuucgaggucccgcccaccaagagccccuccgugcggcgccuggagagcuccuacgacuucaagaccaacgugaacagcaaccccucccacaucugcaagaacaucaagaccgucgugugccugagcccgaaguccggcgugagcuacgacuccaucaucgccugcggggagcccagccagcccuccaucuaccggaagcccgacagccaggucuuccaguccaacgccgaccagacgcacuucugccucagcgacacccacugccuggagaacuacgagaccgugggcgaggagaucaucgacgccaucaagaaguccaagugcugggagaccgaguucacggaguacauccaguucaagcagagcgacggggugcgcagcugccggaugaaggacuccggcgagugcaccgucaccaccaaccgcuggccgaucauccugugcgacaacgacaaguucuacuacagcgagcuccagaaggacuacgacaaggaccaggacaucgggcacuucugccugagcccccggugcaacacgauccgccaccccaucaaccggaagcacaucagcaacugcaccuggcaggucucccacaacaacaucgacaagaucgaggugcacgagcuggaggaccucgagcaguacaagaaggcgaucacccagaagcugcagaccagccugacccucuucaaguacuccaagaccaagaaccugccccacaucaagccgauguacaaguacaucaccaucgagggcaccgagacggccgagggcaucgagagcgccuacaucgaguccgagauccccgcccuggcggggaccagcaucggcuucaagaucaccuccaagagcgggaagcaccuccuggacgugaucggcuacgugaaguccgccagcuacuccgccguguacaccaagcuguacacgaccggccccaccaucggggucaacaccaagcacgacgagcucugcacgggcccgugccccgugaacgugccccacgggaccggcuggcugaccuucgccaaggagcgcaccagcuccugggggugcgaggaguucggcugccuggccaucagcgacggcugcgucuucggguccugccaggacaucaucaaggacgagaucacgguguaccggaaggagaccgaggagaccaccgacguggagcucugccugaccuucgcggacaagacguacugcaccaaccugaacgccaucacccccaucaucaccgaccaguucgagguccaguucaagacgguggaggccuacagccucccgcgcaucaucgccgugcggaaccacgagaucauggucggccagaucaacgacaucgggguguacagcaagggcugcgggaacgugcagaaggucaacaacaccaacuacggcaacggcgugcccaaguucgacuaccugugccaccuggccucccgcaaggaggugaucguccggaagugcuucgacaacgacuaccaggcgugcaaguuccuccagacccccgccagcuaccgccuggaggaggagggcggguccgugaccgugaucgacuacaagaagauccuggggacgaucaagaugaaggccauccucggcgacgucaaguacaagaccuucgccgacaacguggaccugaccguggagggggucugcaccggcugcgugaacugcuucgagaacauccacugcgagagcacgauccacuccaccguggaggccagcugccccgucaucuccagcugcaccguguuccacgaccggauccugaucaccccgaacgagcacaaguacgcgaucaaggucaucugcaacgagaagcccggccccacgcuccccuucaagaucugcuccgccaagaccgacgccgccaugacccuggcggacgccaagccgauccuggagcucgcccccguggaccagaccacguacaucaaggagaaggacgagcgcugcaagaccuggaugugccgggugcgcgacgagggguuccaggucaucuucgagcccuucaagaaccuguucggcagcuacaucgggaucuucuacaccuucaucaucucccugauggccaucuucaucgugaucuacaucgugcuccccaucugcuucaagcugcgcgacacccugcggcagcacgaggacgccuacaagcgcgagaugaagauccgguga

SEQ ID NO: 12638 - RNA, 4323 nt, Artificial Sequence
  derived and/or modified CDS sequence (opt1) from TAHV(XJ0625)__EU622819.2__GP
augauguucgugcuguucuucaucgcccucagcaccgccucccccgucuaccagcgcugcuuccaggacggcgcgaucgugaagcagaacccgagcaagcaggccgugaccgaggucugccugaaggacgacguguccaugaucaagacggaggcccgguacuucaagaacgccaccgggaccuacgccaacaacguggcgauccgcaaguggcuggucagcgacuggcacgacugccggcccaagaagguggccggcgggcacaucaacgugaucgaggucggcgacgaccucacccugcacacggaggccuacgugugcaacgccgacugcaccaucgggguggacaaggagaccgcgcagguccgccugcagaccgacacgaccaaccacuucgagaucgccggcaccaccgugaaguccggcugguucaagagcacgaccuacaucacccucgaccagaccugcgagcaccugaagguguccugcgggcccaagagcguccaguuccacgccugcuucaaccagcacauguccugcgugcgguuccugcaccgcacgauccuccccggcagcaucgccuccagcaucugccagaacguggagaucaucauccugaccguccugacccuccugaucuucauccugcucuccauccugagcaagaccuacaucugcuaccugcucaugccgaucuucaucccccuggccuacguguacggggugaucuacaacaaguccugcaagaagugcaagcugugcggccucgucuaccaccccuucacggagugcgggacccacugcgugugcggcgcgcgguacgagaccagcgaccgcaugaagcugcaccgggccuccggccugugccccggguacaagagccuccgcgccgcccgggugaugugcaaguccaagggcccggccagcauccugagcgucaucaccgcggugcugauccucacguucgucacccccaucaacgccaugguggccggggacacccaggagaccuucaagcuggaggaccugcccgacgacaugcucuccauggccaugaagauccagauguacuacaucaugugcaucgugaacuacaucgucacguggagcuucaucgugugcgcccugaucaucgcgcugaucuucaagaaguaccagcaccgcuuccucaacuucuacgccauguacugccacgagugcgacauguaccacgaccgguccggccugaaguacaacggcgacuucaccaacaagugccgccagugcacgugcgggcaguacgaggacgccgccggccugcucacccaccggaagaccuacaacugccuggugcaguacaagagcaaguggcuggucaacuuccucaucaucuacauccugcugaugcucgugaaggacuccgugcugaucguccaggccgaggggaccgacuucgagaagugcagcggcgagaucaacaucaccuggaacugcaccgggcccuuccugaaccucggcaacugcgagaagaagcagaagaaggagccguacuccaacaucgcgacgcagcugaagggccuggacgccaucagcauccucgacauccccaugaucucccgcauccccgaggacaucgccggggcccugcgguucaucgaggagcagaacagcuaccacgugcagcugaccgcggaguacgccaugcugacccgcuacugcgacuacuacacccaguucuccgacaacagcggcuacucccagaagaccuggcggguguaccuccgcagccacgacuucgaggccugcauccuguaccccaaccagcacuucugccggugcgucaagcacggggacaagugcuccagcuccaacugggacuucgccagcgagaugaagaacuacuacacgggcaagcagcugaaguucaacaaggaccucaaccuggcccugauguccuuccaccacgcguuccgcgggaccagcagcuucuacguggccaagcuccugcgcgagaagaacaacgaggagcuggugaacuacaccgagaagaucaaggacaaguacccgggcaacgcccuccugaaggccaucaucgacuacaucaaguacaugaagaaccuguccgagaugaccaacuucaagcacgacgagaugugggacgacuucgucuucaacagcccgcccacgaagucccccagcgugcggcgcuccgacagcgccuacgacuucaagaacaacaucaacuccaaccccagccacaucugccagaacaucaagaccgugaucugccucucccccaagagcggcgucuccuacgacagcaucaucgcgugcggggagcccucccagcccaccaucuacaagaagccggagagccggguguuccaguccaacgccgaccagacccacuucugccuggccgacacgcacugccuggagaacuacgagaccgugggcgaggagauccucgacgccaucaagaaguccaagugcugggagaccgacuucaccgaguacauccaguucaagcagagcgacgggguccgcagcugccggaugaaggacagcggcgagugcacggugaccacccaccgcuggcccaucauccugugcgacaacaacaaguucuacuacuccgagcugcagaaggacuacgacaaggaccaggacaucgggcacuucugccucagcccccggugcaacaccauccgccaccccaucaaccagaagcacaucuccaacugcacguggcaggucagccacaacaacaucgagaagaucgaggugcacgagcuggagaaccuggagcaguacaagaaggccaucacccagaagcuccagaccucccugacccuguucaaguacagcaagacgaagaaccucccgcacaucaagcccauguacaaguacaucaccaucgagggcaccgagaccgcggagggcaucgaguccgccuacaucgagagcgagauccccgcccuggccgggacguccaucggcuucaagaucaccagcaaguccgggaagcaccuccuggacgugaucggcuacgucaagagcgcguccuacagcgccguguacaccaagcuguacaccacgggcccgaccaucggggugaacaccaagcacgacgagcugugcaccggccccugccccgugaacgucccccacgggacgggcuggcucaccuucgccaaggagcggaccuccagcugggggugcgaggaguucggcugccuggccaucuccgacggcugcguguucgggagcugccaggacaucaucaaggaggagcuggccguguaccgcaaggagaccgaggagacgaccgacgucgagcucugccugaccuucgcggacaagaccuacugcaccaaccugaacgccaucacgccgaucaucaccgaccaguucgaggugcaguucaagaccguggaguccuacagccucccccggaucaucgccguccgcaaccacgagaucauggugggccagaucaacgacaucgggguguacagcaagggcugcgggaacguccagaaggugaacaacaccaacuacggcaacggcgugcccaaguucgacuaccugugccaccuggccucccggaaggaggucaucgugcgcaagugcuucgacaacgacuaccaggccugcaaguuccuccagacgcccgcgagcuaccggcuggaggaggagggcggguccgugaccgucaucgacuacaagaagauccuggggaccaucaagaugaaggccauccucggcgacgugaaguacaagaccuucgccgacaacguggaccugacggucgagggggugugcaccggcugcaucaacugcuucgagaacauccacugcgagcugaccauccacagcaccguggaggccuccugcccggucacgagcuccugcaccguguuccacgaccgcauccucaucacccccaacgagcacaaguacgccaucaaggucaucugcgcggagaagcccggccccagccugcaguucaagaucugcaacgccaagaccgacgccgccaugacgcuggcggacgccaagccgauccucgagcuggcccccguggaccagaccaccuacaucaaggagaaggacgugcggugcaagaccuggaugugccgcguccgggacgaggggcuccaggugaucuucgagcccuucaagaaccuguucggcuccuacaucgggaucuucuacacguuccugaucacccugaucgccguguucgucgugaucuacaucgugcuccccaucugcuucaagcugcgcgacacccugcgccagcacgaggacgccuacaagcgggagaugaagauccgcuga

SEQ ID NO: 12639 - RNA, 4323 nt, Artificial Sequence
  derived and/or modified CDS sequence (opt1) from TAHV(XJ0708)__HM243138.1__GP
augauccuggugcucgucuucguggcccugagcgccgcgucccccguguaccagcgcugcuuccaggacggcgccaucgucaagcagagcccguccaagcaggccgugaccgaggugugccugaaggacgacgucagcaugaucaagaccgaggcccgguacuucaagaacgccacggggaccuacgcgaacaacguggccauccgcaaguggcucguguccgacuggcacgacugccggcccaagaagaucagcggcgggcacaucaacgucaucgaggugggcgacgaccugacccugcacaccgaggccuacgugugcaacgccgacugcaucaucggggucgacaaggagacggcccaggugcgccuccagaccgacaccaccaaccacuucgagaucgcgggcacgaccgugaaguccggcugguucaagagcaccaccuacaucacgcuggaccagaccugcgagcaccugaaggucuccugcgggcccaagagcauccaguuccacgccugcuucaaccagcacauguccugcgugcgguuccuccaccgcaccauccugcccggcagcaucgccuccagcaucugccagaacguggagaucaucauccugaccguccucacgcugcugaucuucauccuccuguccauccugagcaagaccuacaucugcuacauccucaugccgaucuucaucccccuggccuacguguacggggugaucuacaacaaguccugcaagaagugcaagcugugcggccucgucuaccaccccuucaccgagugcgggacccacugcgugugcggcgcgcgguacgagacgagcgaccgcaugaagcugcaccgggccuccggccugugccccggguacaagagccuccgcgccgcccgggugaugugcaagagcaagggcccggccuccauccugagcaucaucaccgcgguccugauccucaccuucgugacccccaucaacgccaugaucgccggggagacgcaggagaccuucaagcuggaggaccugcccgacgacaugcucuccauggccaugaagcugaacauguacuaccugaugugcaucgucaacuacaucgugaccuggagcuucaucaucugcgcccucaucaucgcgcugaucuucaagaaguaccagcaccgcuuccugaacuucuacgccauguacugccacgagugcgacauguaccacgaccgguccggccucaaguacaacggcgacuucaccaacaagugccgccagugcacgugcgggcaguacgaggacgccgccggccugcugacccaccggaagaccuacaacugccucgugcaguacaagagcaaguggcuggucaacuuccugaucguguacauccuccugaugcuggugaaggacuccauccucaucguccaggccgaggggaccgacuucgacaagugcagcggcgaggcggggaucaucuggaacugcacgggccccuuccugaaccugggcaacugcgagaagaagcagaagaaggaguccuacaacaacaucgccacccagcucaaggggcugaacgccaucagcgugcuggacaucccgaugaucucccgcauccccgaggacaucgccggcgcgcugcgguucaucgaggaccagaacagcuaccacgugcagcucaccgccgaguacgccaugcugacccgcuacugcgacuacuacacgcaguucuccgacaacagcggguacucccagaccaccuggcgggucuaccugcgcagccacaacuucgaggccugcauccucuacuccaaccagcacuucugccggugcgugaagcacggcgacaagugcagcuccagcaacugggacuucgccaacgagaugaagaacuacuacagcgggaagcaguccaaguucaacaaggaccugaaccuggcgcucaugagccugcaccacgccuuccgcggcaccuccagcuucuacaucgccaagcugcuccgcgagaagaagaacgaggagcugaucaacuacguggaggagaucaagaagaaguaccccggcaacgcccugcucaaggccgucaucgacuacaucaaguacaugaagaaccugaccgagauggcguccuucaagcacgacgagaugugggacgaguucguguacgagagcccgcccacgcggucccccagcgcccgccgguccgagagcgaguacgacuucaagaccaacgugaacuccaagcccacccacgucugcaagaacaucaagaccguggugugccugagccccaaguccggggucagcuacgacuccaucaucgccugcggcgagccggggcagcccagcguguaccgcaagcccgagcagcaggucuuccaguccaacgccgaccagacgcacuucugccuccuggacacccacugccuggagaacuacaccaccgugaacgacgagauccucgacgccaucaagaagucccggugcugggagacggaguucaccgaguacauccaguucaagcagggcgacggggugcgcagcugccggaugaaggacagcggcgagugcgcgguggccgccaaccgcuggcccaucauccugugcgacaacaacaaguucuacuacagcgagcugcagaaggacuacgacaaggaccaggacaucggccacuucugccucuccccgcggugcaacaccauccgccaccccaucaaccagaagcacaucagcaacugcaccuggcaggucucccacaacaacaucgagaagaucgaggugcacgagcuggagaaccuggagcaguacaagaaggccaucacgcagaagcuccagaccagccugacccuguucaaguacuccaagaccaagaaccucccccacaucaagcccauguacaaguacaucacgaucgaggggaccgagaccgcggagggcaucgagagcgccuacaucgaguccgagaucccggcccuggccgggaccagcaucggcuucaagaucacguccaagagcggcaagcaccuccuggacgugaucggguacgucaaguccgccagcuacuccagcguguacacccggcuguacaccaccggccccacgaucgggaucaacacccgccacgacgagcugugcaccggccccugcccggugaacgucccccacaacaccggguggcucacguucgcgaaggagcggaccuccagcuggggcugcgaggaguucggcugccuggccaucuccgacgggugcguguucggcagcugccaggacaucaucaaggaggagcugaccguguaccgcaaggagaccgaggagacgaccgacgucgagcucugccugaccuucgccgacaagaccuacugcacgaaccugaacgccaucacccccaucaucaccgaccaguucgaggugcaguucaagaccguggaggccuacagccucccccggaucaucgcgguccgcaaccacgagauccugguggggcagaucaacgaccugggcguguacuccaaggggugcggcaacguccagaaggugaacaagaccaacuacggcaacggggugccgaaguucgacuaccucugccaccuggccagccggaaggaggucaucgugcgcaagugcuucgacaacgacuaccaggccugcaaguuccugcagacgcccgccuccuaccggcucgaggaggagggcgggaccgugaccgucaucgacuacaagaagauccugggcaccaucaagaugaaggccauccugggggacgugaaguacaagacguucgcggacaacguggaccucaccaucgagggcgucugcaccggcugcaucaacugcuucgagaacauccacugcgagcugaccauccacagcacgguggaggccuccugccccaucaucagcuccugcaccguguuccacgaccgcauccugaucacccccaacgagcacaaguacgccaucaaggucaucugcaacgagaagccggggagcucccucagcuuccgcgugugcaacaccaagacggacgccgcgaugacccugaccgacgccaagcccauccuggagcucgcccccgucgaccagaccgccuacaucaaggagaaggacgagcggugcaagacguggaugugccgcgugcgggacgagggccuccaggugaucuucgagcccuucaagaaccuguucggguccuacaucggcaucuucuacaccuucauccugagccugaucgccaucuucaucaucaucuacaucguccugccgaucugcuucaagcuccgcgacacccugcggcagcacgaggacgcguacaagcgcgagaugaagauccgguga

SEQ ID NO: 12640 - RNA, 4323 nt, Artificial Sequence
  derived and/or modified CDS sequence (opt1) from TAHV(XJ0710)__HM243141.1__GP
augauguucgugcuguucuucaucgcccucagcgccgcgucccccgucuaccagcgcugcuuccaggacggcgccaucgugaagcagaacccgagcaagcaggccgugaccgaggucugccugaaggacgacguguccaugaucaagaccgaggcccgguacuucaagaacgccacggggaccuacgcgaacaacguggccauccgcaaguggcuggucagcgacuggcacgacugccggcccaagaagguggccggcgggcacaucaacgugaucgaggucggcgacgaccucacccugcacaccgaggccuacgugugcaacgcggacugcacgaucgggguggacaaggagaccgcccagguccgccugcagaccgacaccacgaaccacuucgagaucgccggcaccaccgugaaguccggcugguucaagagcaccacguacaucacccucgaccagaccugcgagcaccugaagguguccugcgggcccaagagcguccaguuccacgccugcuucaaccagcacauguccugcgugcgguuccugcaccgcaccauccuccccggcagcaucgccuccagcaucugccagaacguggagaucaucauccugacgguccugacccuccugaucuucauccugcucuccauccugagcaagaccuacaucugcuaccugcucaugccgaucuucaucccccuggcguacguguacggggugaucuacaacaaguccugcaagaagugcaagcugugcggccucgucuaccaccccuucaccgagugcgggacgcacugcgugugcggcgcccgguacgagaccagcgaccgcaugaagcugcaccgggccuccggccugugccccggguacaagagccuccgcgccgcccgggugaugugcaaguccaagggcccggcgagcauccugagcaucaucaccgccguccugauccucaccuucgugacgcccaucaacgccauggucgccggggacacccaggagaccuucaagcuggaggaccugcccgacgacaugcucuccauggccaugaagauccagauguacuacaucaugugcaucgugaacuacaucgugaccuggagcuucaucgucugcgcgcugaucaucgcccugaucuucaagaaguaccagcaccgcuuccucaacuucuacgccauguacugccacgagugcgacauguaccacgaccgguccggccugaaguacaacggcgacuucacgaacaagugccgccagugcacgugcgggcaguacgaggacgccgccggccugcucacccaccggaagaccuacaacugccuggugcaguacaagagcaaguggcuggugaacuuccucaucaucuacauccugcugaugcucgucaaggacuccgugcugaucgugcaggcggaggggaucgacuucgagaagugcagcggcgagaucaacaucaccuggaacugcaccgggcccuuccugaaccucggcaacugcgagaagaagcagaagaaggagccguacuccaacaucgccacccagcugaagggccuggacgccaucagcauccucgacauccccaugaucucccgcauccccgaggacaucgccggggcgcugcgguucaucgaggagcagaacagcuaccacguccagcugaccgccgaguacgccaugcugacgcgcuacugcgacuacuacacccaguucuccgacaacagcggcuacucccagaccaccuggcggguguaccuccgcagccacgacuucgaggccugcauccuguaccccaaccagcacuucugccggugcgugaagcacggggacaagugcuccagcuccaacugggacuucgccagcaagaugaagaacuacuacaccggcaagcagcugaaguucaacaaggaccucaaccuggcgcugauguccuuccaccacgccuuccgcgggacgagcagcuucuacgucgccaagcuccugcgcgagaagaacaacgacgagcuggugaacuacaccgagaagaucaagaacaaguacccgggcaacgcccuccugaaggccaucaucgacuacaucaaguacaugaagucccugagcgagaugaccaacuucaagcacgacgagaugugggacgacuucguguucaacuccccgcccaccaagagccccuccguccggcgcagcgacuccgcguacgacuucaagaacaacaucaacagcaaccccucccacaucugcaagaacaucaagacgguggugugccucagccccaaguccggcgucagcuacgacuccaucaucgccugcggggagcccagccagcccaccaucuacaagaagccggagucccggguguuccagagcaacgccgaccagacccacuucugccuggccgacacccacugccuggagaacuacgagacggugggcgaggagauccucgacgccaucaagaaguccaagugcugggagaccgacuucaccgaguacauccaguucaagcagagcgacgggguccgcagcugccggaugaaggacuccggcgagugcaccgugacgaccaaccgcuggcccaucauccugugcgacaacaacaaguucuacuacagcgagcugcagaaggacuacgacaaggaccaggacaucgggcacuucugccucagcccccggugcaacaccauccgccaccccaucaaccagaagcacaucuccaacugcaccuggcaggucucccacaacaacaucgagaagaucgaggugcacgagcuggagaaccuggagcaguacaagaaggcgaucacgcagaagcuccagaccagccugacccuguucaaguacuccaagaccaagaaccucccgcacaucaagcccauguacaaguacaucacgaucgagggcaccgagaccgccgagggcaucgagagcgccuacaucgaguccgagauccccgcccuggcggggaccagcaucggcuucaagaucacguccaagagcgggaagcaccuccuggacgugaucggcuacgugaaguccgccagcuacuccgccgucuacaccaagcuguacaccaccggcccgacgaucggggugaacaccaagcacgacgagcugugcaccggccccugccccgugaacgucccccacgggaccggcuggcucacguucgccaaggagcggaccagcuccugggggugcgaggaguucggcugccuggccaucagcgacggcugcguguucggguccugccaggacaucaucaaggaggagcuggcgguguaccgcaaggagaccgaggaggccaccgacgucgagcucugccugacguucgccgacaagaccuacugcaccaaccugaacgccaucaccccgaucaucaccgaccaguucgaggugcaguucaagacgguggagagcuacagccucccccggaucaucgccguccgcaaccacgagaucauggugggccagaucaacgacaucgggguguacuccaagggcugcgggaacguccagaaggugaacaacaccaacuacggcaacggcgugcccaaguucgacuaccugugccaccuggcgagccggaaggaggucaucgugcgcaagugcuucgacaacgacuaccaggccugcaaguuccuccagacccccgccuccuaccggcuggaggaggagggcgggagcgugaccgucaucgacuacaagaagauccuggggacgaucaagaugaaggccauccucggcgacgugaaguacaagaccuucgccgacaacguggaccugaccgucgagggggugugcaccggcugcaucaacugcuucgagaacauccacugcgagcugacgauccacuccaccguggaggcgagcugcccggucaccuccagcugcaccguguuccacgaccgcauccucaucacgcccaacgagcacaaguacgccaucaaggucaucugcgccgagaagcccggccccucccugcaguucaagaucugcaacgccaagaccgacgcggccaugacccuggccgacgccaagccgauccucgagcuggcccccguggaccagaccacguacaucaaggagaaggacgagcggugcaagaccuggaugugccgcgugcgggacgaggggcugcaggucaucuucgagcccuucaagaaccucuucggcagcuacaucgggaucuucuacaccuuccugaucacccugaucgcgguguucaucgugaucuacaucguccuccccaucugcuucaagcugcgcgacacgcugcgccagcacgaggacgccuacaagcgggagaugaagauccgcuga

SEQ ID NO: 12641 - RNA, 4326 nt, Artificial Sequence
  derived and/or modified CDS sequence (opt1) from TVTV__AF123491.1__GP
augaucguguucgcccugcucaccaucgucgccgcgagccccguguacaagcgcugcuuccaggacggcgccaucgugcggcaggaguacuccaagaacgccgucaccgaggugugccugaaggacgacgugagcaugaucaagacggaggccgaguacuucaagaacuccaccggggucuucagcaagaacaucgccuaccgcaaguggcugguguccgacuggaacgagugccggccgcagaaguccgcgaacggccacaucaacgugaucgagguccagcccgaccucucccugcagaccaacagcuacgugugcgccgcgaccugcgugaucuccaucgacaaggagacggcccagguccgccugcagaccgacaccaccaaccacuucgagaucagcgggacgaccgugaaguccggcugguucaagagcaccaccuaccucacgcuggaccagaccugcgagcaccugaagaucuccugcgggagcaaguccgugcagcuccacgccugcuucaaccagcacaugagcugcguccgguuccugcaccgcaccauccugcccggcaagcaccggaaguccaucugccagaacaucgagaucaucauccucaccagccugucccuguucaucuuccucuuccugacgaucaucagcaagaccuacaucugcuacgugcugauccccaucuucaucccgaucgccuacguguacggcuucaucuacaacaagagcugcaagaagugcaagcucugcgggcuggucuaccaccccuucaccgagugcggcucccacugcgugugcggggccaaguacgacaccagcgaccgcaugaagaugcaccgguccagcggccugugccccggguacaagucccuccgcgccgcccggagcaugugcaaguccaagggccccgcgccgauccugagccugcucuccgccgugcugauccugacguucgucacccccaucaccgccaucagccucaaggacgaggagaaggagaccuacaagcugcccgagcugcccgacgacaaggugaaccucgagacgaagaucgaccuguacuuccagaugugccugaucaacuacgccaccaccugggcccucaucuucugcgugcugaucaccgcgugccuguucaagaagcuccagcacaaguuccuggacuacuacgccgucuacugccacgagugcgacauguaccacgagaagacgucccugaaguacaacggcgacuucagcaacaagugccgccagugcacgugcgagcaguacgaggacgccaccgggcuccugacccaccggaaguccuacaaccgccuggugcaguacaaggccaaguggacccucaacuuccugaucaccuacgccauccuggucaucaucaaggacagcgugaugaucgugggcgcguccaacaccgacgucaaggacugccucgaccaggaggagaucaccuggaacugcacggggccguuccugaacaugggccggugcacccgcccccagaagaaggagaacuacggcaacaucgccacccagcugaaggggcucgacgugcugagcgcccuggacaugcccgccgugggcaagauccccgaggacaucgccggggcgcuguccuacaucgagagcaagaagaccuaccacgagcagcucacccuggaguucgccaugcugacgcgguacugcgacuucuacaagcaguacgccgacaacuccggcuacagccagaccaccuggcgcgccuacauccggagccacgacuucggggucugcaucauguacccgaaccagcacuucugccgcugcgugaagaugggcgagaagugcaccuccagcaacugggacuucgcgaaccagauggccaacuacuacaacggcaagcagaaccgguucaacaaggaccucaaccuggcccuguacacgaugcaccacgccuuccgcggguccaccagcuaccucaucuccaaggugcugcacgagaagaaguacgaccagcugaccaaccuccugacccagcugaagacgaaguaccccggcaacgcccuccugaaggcgcugaucggguaccagaucuaccucaagagccuguccgagaugagcuccuucacccccgacgagcugugggacgaccuccaguacguccccgccccgaccuucaagcccaaccugggccgcagcggggacaacgaguacaaguucgacaagucccggaucguggacccccagaccacgugcaccagccugaagggcgugaacugccucagcccccgcagccgggccuccgucagcgacaucaucgccugcggccaggccacccagccggcgcuguucuacgugcccaacgacaagauccaccaguccaacaccgaccagaaccaguacugcaucggggacagccacugccugacgaaguucacccccaucaccgaggagcuccuggccgccgugaagaaguccaagugccaggccuucgaccuggacaacaucgucaagaccagcacgagcaccggcgugcgcuccugccucgugaagaaguucgggaacugcaacaccaccaaccaggucuggcccaucacgaucugcagcgacgaccaguacuacuacaccgacaccaagcaguccuacgacagcuaccaggacaucggccacuucugccuguccccgcggugcagcaccauccgcuaccccgugaaccccaagcaccuguccgccugcacguggaccgaggaguacaccccgguggacaagaucagcgucaccaacaucgaggagaucgagcaguacaagaaggcgcuccugcagaagcugcagacggggcucaacaucuucaaguaccggaagaccuccaaccugccccacaucaagagcauguacaaguacaucaccgugcagggcaccggcacggccgaggggguggagaacgccuacaucgaguccgagaugcccgcccuggcgggcagcuccagcggguucaagguccucuccaaggagggcaaccaccuguucgacgugguggccuacaucaagagcgccuccuacagcagcgucuacaacaagcuguacuccaccggccccacccucgggaucaacgugaagcacgacgagaagugcaccggcccgugccccgccaacaucccccacaagaccggguggcugacguucgcccgcgagcggaccagcaccuggggccgcgaggaguacgggugccuggcgaucuccgacggcugcguguucggcagcugccaggacaucaucaagcccgagaugaccgucuaccggaagcagacggacgagaucgugaccguggagcucugccugaccuucgucgacaagaccuacugcacggagcugaacgccgugaccccgaucaucuccgaccucuucgaggugcaguucaagaccgucgagagcuacucccugcccaagaucguggccaucaagaaccaccagaucuucguggggcagaucaacgucaucggcaccaacagcaaggggugcggcaacguccagguguucaacgggacgaacuacggcuccggcacgccccgcuucgacuaccugugccaccucgccagccggcgcgaggugaucaugcggaagugcuucgacaacgacuaccaggccugcaaguuccugcagcagcccuccagcuuccgccuggaggaggagggggagaccgugaccaucaucgacuacaagaagauccucggcaccaucaagaugaaggcgaucuucggggacgugaaguaccggaccuucuccgagaaggucgacaucaacgccgagggcgugugcgccgggugcaucaacugcuucgagcgcaucaacugcgaguucaccauccacagcaccguggagacguccugcccgcuggucgccgacugccagcuguuccacgaccggcuccugaucacccccaacgagcacaaguacgccaucaaggcgaucugcaaggacaagcccagcaacacccugcgcuucuccaucugcaacaccaagguggaggccacggugaccaucaucgacgccaagcccauccucgagcuggccccggucgaccagaccgcguacaucaaggagaaggacgagcgcugcaagaccuggcugugccgggugaaggacgagggcgucgccgugcuccuggagcccuucaagaaccuguucggcagcuacaucgggaucuucuacggcaucauccucgugguccuggccauccuggugugcaucuacaucgugcuccccgucugcuucaagaucaaggacacgcugaagaagcacgaggacgccuacaagcgcgagaugaagauccgguga

SEQ ID NO: 12642 - RNA, 4335 nt, Artificial Sequence
  derived and/or modified CDS sequence (opt1) from TVTV(AR42)__KX891322.1__GP
augcgcaacaugaucguguucgcccugcucaccaucgucgccgcgagccccguguacaagcggugcuuccaggacggcgccaucgugcgccaggaguacuccaagaacgccgucaccgaggugugccugaaggacgacgugagcaugaucaagacggaggccgaguacuucaagaacuccaccggggucuucagcaagaacaucgccuaccggaaguggcugguguccgacuggaacgagugccgcccgcagaaguccgcgaacggccacaucaacgugaucgagguccagcccgaccucucccugcagaccaacagcuacgugugcgccgcgaccugcgugaucuccaucgacaaggagacggcccagguccggcugcagaccgacaccaccaaccacuucgagaucagcgggacgaccgugaaguccggcugguucaagagcaccaccuaccucacgcuggaccagaccugcgagcaccugaagaucuccugcgggagcaaguccgugcagcuccacgccugcuucaaccagcacaugagcugcguccgcuuccugcaccggaccauccugcccggcaacaucgccaacuccaucugccagaacaucgagaucaucauccucaccagccugucccuguucaucuuccucuuccugacgaucaucagcaagaccuacaucugcuacgugcugauccccaucuucaucccgaucgccuacguguacggcuucaucuacaacaagagcugcaagaagugcaagcucugcgggcuggucuaccaccccuucaccgagugcggcucccacugcgugugcggggccaaguacgacaccagcgaccgcaugaagaugcaccgguccagcggccugugccccggguacaagucccuccgcgccgcgcggagcaugugcaaguccaagggccccgccagcauccugucccugcucagcgccgugcugauccugacguucgucaccccgaucaccgccaucucccucaaggacgaggagaaggagaccuacaagcugagcgagcugcccgacgacauggugaaccucgagaacaagaucgaccuguacuuccagaugugccugaucaacuacgccacgaccugggcgcucaucuucugcgcccugaucaccgccugccuguucaagaagcuccagcacaaguuccuggacuacuacgccguguacugccacgagugcgacauguaccacgagcgccggggccugaaguacaacggggacuucuccaacaagugccgccagugcacgugcggccaguacgaggacgccaccgggcuccugacccaccgcaagagcuacaacugccugguccaguacaaggcgaaguggaugcucaacuuccugaucaccuacgccauccuggugaucaucaaggacuccgucaugaucgugggcgccagcgacaccgacgugaaggacugccucgaccaggaggagaucacguggaacugcaccggccccuuccugaacaugggguccugcacccggccccagaagaaggagaacuacggcaacaucgccacccagcugaaggggcucgacguccugagcgcccuggacaugccggcggugggcaagauccccgaggacaucgccggggcccuguccuacaucgagagcaagaagacguaccacgagcagcucacccuggaguucgccaugcugacccgguacugcgacuucuacaagcaguacgcggacaacagcggcuacucccagaccaccuggcgcgccuacauccggagccacgacuucggcgugugcaucauguaccccaaccagcacuucugccgcugcgucaagaugggggagaagugcacguccagcaacugggacuucgccaaccagauggccaacuacuacaacggcaagcagaaccgguucaacaaggaccucaaccuggcccuguacaccaugcaccacgcguuccgcggguccaccagcuaccucaucuccaaggugcugcacgagaagaaguacgaccagcugaccaaccuccugacgcagcugaagaccaaguaccccggcaacgcccuccugaaggcccugaucgacuaccagaucuaccucaagagccuguccgagaugagcuccuucaccccggacgagcugugggacgaccuccaguacgugcccgcccccaccuucaagcccaaccuggggcgcagcgaggacaacgaguacaaguucgacaagucccggaucgucgacccgcagacgaccugcaccagccugaagggcgugaacugccucagcccccgcagccgggccuccgugagcgacaucaucgcgugcggccaggccacccagcccgcccuguucuacguccccaacgacaagauccaccagagcaacacggaccagaaccaguacugcaucggggacucccacugccugaccaaguucaccccgaucaccgaggagcuccuggccgccgugaagaaguccaagugccaggcguucgaccuggacgacaucgugaagacgucccccagcaccggcguccgcuccugccucgugaagaaguucgggaacugcaacaccaccaaccagguguggcccaucacgaucugcagcgacgaccaguacuacuacaccgacaccaagcaguccuacgacagcaaccaggacaucggccacuucugccugagcccccggugcagcaccauccgcuacccggucaaccccaagcaccuguccgccugcacguggaccgaggaguacacccccguggacaagaucagcgugaccaacaucgaggagaucgagcaguacaagaaggcccuccugcagaagcugcagacggggcucaacaucuucaaguacaagaagaccuccaaccugccgcacaucaagcccauguacaaguacaucaccguccagggcaccgagacggccgagggcguggagaacgcguacaucgagagcgagaugcccgcccuggccggguccagcuccggcuucaaggugcucagcaaggaggggaaccaccuguucgacgucguggccuacaucaaguccgccagcuacagcuccguguacaacaagcuguacagcaccggccccacccucggcaucaacgucaagcacgacgagaagugcaccgggccgugccccgcgaacaucccccacaagacgggcuggcugaccuucgcccgggagcgcaccuccaccugggggugcgaggaguacggcugccuggccaucagcgacgggugcguguucggcuccugccaggacaucaucaagcccgagaugaccguguaccggaagcagacggacgagaucgucaccguggagcucugccugaccuucguggacaagaccuacugcacggagcugaacgccgucaccccgaucaucagcgaccucuucgaggugcaguucaagaccguggaguccuacagccugcccaagaucgucgccaucaagaaccaccagaucuucgugggccagaucaacgacaucgggaccuacuccaagggcugcgggaacgugcaggucuucaacggcacgaacuacgggagcggcacgccccgcuucgacuaccugugccaccucgcgucccggaaggaggugaucaugcgcaagugcuucgacaacgacuaccaggccugcaaguuccugcagcagcccagcuccuuccggcuggaggaggagggcgagaccgugaccaucaucgacuacaagaagauccucgggaccaucaagaugaaggccaucuucggcgacgucaaguacaagaccuucagcgagaagguggacaucaacgccgagggggugugcgccggcugcaucaacugcuucgaguccaucaacugcgaguucaccauccacagcaccgucgagacguccugcccgcugguggcggacugccagcuguuccacgaccgccuccugaucacccccaacgagcacaaguacgccaucaaggccaucugcaaggacaagcccagcaacacccugcgguucuccaucugcaacaccaagguggaggccacggucaccaucaucgacgcgaagcccauccucgagcuggccccgguggaccagaccgccuacaucaaggagaaggacgagcgcugcaagaccuggcugugccgggugaaggacgagggggucgccgugcuccuggagcccuucaagaaccuguucggcagcuacaucggcaucuucuacgggaucauccucgucgugcuggccauccuggugugcaucuacaucguccuccccgugugcuucaagauccgcgacacgcugaagaagcacgaggacgcguacaagcgggagaugaagauccgcuga

SEQ ID NO: 12643 - RNA, 4335 nt, Artificial Sequence
  derived and/or modified CDS sequence (opt1) from TVTV(Eklund)__KR149248.1__GP
augcgcaacaugaucguguucgcccugcucaccaucgucgccgcgagccccguguacaagcggugcuuccaggacggcgccaucgugcgccaggaguacuccaagaacgccgucaccgaggugugccugaaggacgacgugagcaugaucaagacggaggccgaguacuucaagaacuccaccggggucuucagcaagaacaucgccuaccggaaguggcugguguccgacuggaacgagugccgcccgcagaaguccgcgaacggccacaucaacgugaucgagguccagcccgaccucagccugcagaccaacagcuacgugugcgccgcgaccugcgugaucuccaucgacaaggagacggcccagguccggcugcagaccgacaccaccaaccacuucgagaucagcgggacgaccgugaaguccggcugguucaagagcaccaccuaccucacgcuggaccagaccugcgagcaccugaagaucuccugcgggagcaaguccgugcagcuccacgccugcuucaaccagcacaugagcugcguccgcuuccugcaccggaccauccugcccggcaacaucgccaacuccaucugccagaacaucgagaucaucauccucaccagccugucccuguucaucuuccucuuccugacgaucaucagcaagaccuacaucugcuacgugcugauccccaucuucaucccgaucgccuacguguacggcuucaucuacaacaagagcugcaagaagugcaagcucugcgggcuggucuaccaccccuucaccgagugcggcucccacugcgugugcggggccaaguacgacaccagcgaccgcaugaagaugcaccgguccagcggccugugccccggguacaagucccuccgcgccgcgcggagcaugugcaaguccaagggccccgccagcauccugucccugcucagcgccgugcugauccugacguucgucaccccgaucaccgccaucucccucaaggacgaggagaaggagaccuacaagcugagcgagcugcccgacgacauggugaaccucgagacgaagaucgaccuguacuuccagaugugccugaucaacuacgccaccaccugggcgcucaucuucugcgcccugaucaccgccugccuguucaagaagcuccagcacaaguuccuggacuacuacgccguguacugccacgagugcgacauguaccacgagcgccggggccugaaguacaacggggacuucuccaacaagugccgccagugcacgugcggccaguacgaggacgccaccgggcuccugacccaccgcaagagcuacaacugccugguccaguacaaggcgaaguggaugcucaacuuccugaucaccuacgccauccuggugaucaucaaggacuccgucaugaucgugggcgccagcaacacggacgugaaggacugccucgaccaggaggagaucaccuggaacugcaccggccccuuccugaacauggggcggugcacccggccccagaagaaggagaacuacggcaacaucgccacgcagcugaaggggcucgacguccuguccgcccuggacaugccggcggugggcaagauccccgaggacaucgccggggcccugagcuacaucgaguccaagaagaccuaccacgagcagcucacccuggaguucgccaugcugacccgcuacugcgacuucuacaagcaguacgcggacaacagcggcuacagccagaccacguggcgggccuacauccgcucccacgacuucggcgugugcaucauguaccccaaccagcacuucugccggugcgucaagaugggggagaagugcaccagcuccaacugggacuucgccaaccagauggccaacuacuacaacggcaagcagaaccgcuucaacaaggaccucaaccuggcccuguacaccaugcaccacgcguuccgcgggagcaccuccuaccucaucagcaaggugcugcacgagaagaaguacgaccagcugacgaaccuccugacccagcugaagaccaaguaccccggcaacgcccuccugaaggcccugaucgacuaccagaucuaccucaagucccugagcgagauguccagcuucaccccggacgagcugugggacgaccuccaguacgugcccgcccccacguucaagcccaaccuggggcgguccgaggacaacgaguacaaguucgacaagagccgcaucgucgacccgcagacgaccugcaccucccugaagggcgugaacugccucagcccccggucccgcgccagcguguccgacaucaucgcgugcggccaggccacccagcccgcccuguucuacguccccaacgacaagauccaccagagcaacaccgaccagaaccaguacugcaucggggacagccacugccugaccaaguucaccccgaucacggaggagcuccuggccgccgugaagaaguccaagugccaggcguucgaccuggacaacaucgugaagaccagccccuccaccggcguccggagcugccucgugaagaaguucgggaacugcaacaccacgaaccagguguggcccaucaccaucugcuccgacgaccaguacuacuacaccgacaccaagcagagcuacgacuccuaccaggacaucggccacuucugccugagcccccgcugcuccacgauccgguacccggucaaccccaagcaccugagcgccugcaccuggaccgaggaguacacccccguggacaagaucuccgugacgaacaucgaggagaucgagcaguacaagaaggcccuccugcagaagcugcagaccgggcucaacaucuucaaguaccgcaagaccagcaaccugccgcacaucaagcccauguacaaguacaucaccguccagggcacggagaccgccgagggcguggagaacgcguacaucgaguccgagaugcccgcccuggccgggagcuccagcggcuucaaggugcucuccaaggaggggaaccaccuguucgacgucguggccuacaucaagagcgccuccuacagcagcguguacaacaagcuguacuccaccggccccacccucggcaucaacgucaagcacgacgagaagugcacggggccgugccccgcgaacaucccccacaagaccggcuggcugaccuucgcccgggagcgcaccagcaccugggggugcgaggaguacggcugccuggccaucuccgacgggugcguguucggcagcugccaggacaucaucaagcccgagaugacgguguaccggaagcagaccgacgagaucgucaccguggagcucugccugaccuucguggacaagacguacugcaccgagcugaacgccgucaccccgaucaucuccgaccucuucgaggugcaguucaagaccguggagagcuacucccugcccaagaucgucgccaucaagaaccaccagaucuucgugggccagaucaacgacaucgggacguacagcaagggcugcgggaacgugcaggucuucaacggcaccaacuacggguccggcacgccccgcuucgacuaccugugccaccucgcgagccggaaggaggugaucaugcgcaagugcuucgacaacgacuaccaggccugcaaguuccugcagcagcccuccagcuuccggcuggaggaggagggcgagaccgugaccaucaucgacuacaagaagauccucgggaccaucaagaugaaggccaucuucggcgacgucaaguacaagaccuucuccgagaagguggacaucaacgccgagggggugugcgccggcugcaucaacugcuucgagagcaucaacugcgaguucaccauccacuccacggucgagaccagcugcccgcugguggcggacugccagcuguuccacgaccgccuccugaucacccccaacgagcacaaguacgccaucaaggccaucugcaaggacaagcccuccaacacccugcgguucagcaucugcaacacgaagguggaggccaccgucaccaucaucgacgcgaagcccauccucgagcuggccccgguggaccagaccgccuacaucaaggagaaggacgagcgcugcaagacguggcugugccgggugaaggacgagggggucgccgugcuccuggagcccuucaagaaccuguucggcuccuacaucggcaucuucuacgggaucauccucgucgugcuggccauccuggugugcaucuacaucguccuccccgugugcuucaagaucaaggacacccugaagaagcacgaggacgcguacaagcgcgagaugaagauccgcuga

SEQ ID NO: 12644 - RNA, 4335 nt, Artificial Sequence
  derived and/or modified CDS sequence (opt1) from JCV(3324-04)__HM007357.1__GP
auggaggugcugaaccucaucuggcugcugacccucugccuggccagccccgucuuccagcgcugcuuccaggacggcgccaucgugaagcagaacccguccaaggaggcggugaccgaggucugccugaaggacgacgugagcaugaucaagacggaggccaaguacgugaagaacaccaccgggaccuucgccaacaacaucgccaugcggaaguggcucgucgccgacuggcacgacugccgcccccagaaguccagcggcgggcacaucaacgugaucgaggugggcgacgaccugucccugcacacggagagcuacaucugcuccgcggacugcgucaucaccguggacaaggagaccgcccagauccggcuccagaccgacaacacgaaccacuucgagguggccgggaccaccgucaagagcggcugguucaaguccaccacguacaucacccuggaccagaccugcgagcaccugaaggugagcugcggccccaaguccauccaguuccacgccugcuucaaccagcacaugagcugcgugcgcuuccuccaccggaccauccugcccggguccaucgcgaacagcaucugccagaacaucgagaucaucauccuggucacgcucucccuggugaucuucaucuuccugaccaucgugagcaagaccuacaucugcuaccuccugaugccgaucuucauccccaucgccuucaucuacggcuggaucuacaacaaguccugcaagaagugcaagcugugcgggcucgucuaccaccccuucaccgagugcggcacgcacugcgugugcggggcccgcuacgagaccagcgaccggaugaagcugcaccgcgccuccggccugugccccggcuacaagagccuccgggccgcgcgcgugaugugcaagagcaaggggccggccuccguccugagcaucaugaccgccgugcugauccucaccuucgugacgcccaucuccgccauggucaucggcgagagcuccgagaucuacacccuggaggaccugcccgacgacauggugcagauggccgagcggaucaacaucuacuaccagaucaucaucaucaacuacgggaucaccugggcguuccuccugcugggccuccugcuggccuacuucuuccgcaaguaccagcaccgguuccucgacuucuacgccauguacugcgaggagugcgacauguaccacgagaaggccggccugacccacuggggcgacuucacgaacaagugccgccagugcacgugcgggcaguacgaggacaucaccgggcugaugguccacaagaaguccuacaacugccucgugaaguacaaggccaaguggauccgggacauccugaucaccuaccuggugaucauccucgucaaggacucccugcuguucgugggcgcgaccgggaccgacuucgcgaccugcaucgacgagaagaccgugacguggaacugcaccggccccuuccucaaccugggccgcugcgacaagagccagaagaagaccaacuacgccgacaucgccaaccagcugaaggggcucggcgucaucuccgugcuggacaucccgaugaucaagaagaugcccgacgagaucagcgggucccugaaguacaucgacaaccuggagaccuaccacgagcagcucaccgccgaguacgccuuccugacgcgguacugcgacuacuacacccaguacaccgacaacagcggcuacucccagaccguguggcgcacguaccugcggagccacgacuucggggccugcgucguguaccccaaccagcacuucugccgcugcgugaaguacggcgacaagugcaacuccgccaagugggacuucgccaacgagaugaagaccuucuacaccggccagaaggcgaaguucaacaaggaccucaaccuggcccugcucguccugcacaaggccuuccgggggaccggcacggccuacaucgccgaggcgauggcccgcaaggacaacgggagcauggcccacuucgcccuggaggugcgcaagaaguuccccaccaacgcccuccuggcggcccugaucgacuacaucguguaccuccagucccuggccgagaucagcaccuucgagcuggacgaggacugggaggacuucaaguacaagccggagcccaccgaguccacgauccaggcccggagccaccgcgacgaccaguacaacuucaagaacgccgcgagcggcuccaacgucaaggugugcaagaacauccagaaggugcucugcaucagcccccggucccgcgccaaguucgagaacaucaucgccugcggggagcacgccaaccccagcgucuacaugaugccgaacguguccaucuaccagagcuccagcgagcggucccacuacugcaucgcggacagccacugccuggaggaguacgagguggucgagaccgagcugcucaacgcccugaagaaguccaagugcugggugaaggagauggacgacgugauccugcacaagcagagcgacggccuccgcuccugccggaugaaggacaccggcaacugcaacguccaggagaacgacuggaacaucgugcugugcgagaacgggaacuacuacuacagcgagauccacaaggacuacgacaaggaccaggacgugggccacuucugccugagcccccgcugcaacaccauccgguaccccaucagcaagcgccacauccgguccugcaacuggcagaucagccacagcacgaucgacaagaucgccguccaggagcucgccgacaucgagcaguacaagaaggccaucucccagaagcugcagaccagccuguccaucuucaaguacaucaagaccaagaaccucccccacaucaagccggcguacaaguacaucaccguggaggggguggagacggucgagggcaucgagaacgccuucaucgagagcgagauccccgcccuggccggcaccgccaucggguucaagaucaacucccgcgagggcaacuaccugauggacgugaucggguacgucaagagcgcguccuacagcgccaccuacaccaagcucuacacgaccggccccaccaucgggaucaacacccggcacgacgagaagugcacgggccccugcccggccgugaucgaccacaaggacggcuggcugaccuucuccaaggagcgcaccagcaccugggggugcgaggaguucggcugccuggccguguccgacgggugcguguucggcagcugccaggacaucaucaaggacgagcucgccgucuaccggaagacgaccgaggagcugaccaccguggagcugugccucacguucuccgacaagaccuacugcaccaaccugaacgcgaucacccccaucaucaccgacaaguucgaggugcaguucaagacggucgaggccuacacccugccccgcaucaucgccgugaagaaccacgagaucaagguggggcagaucaacgaccucggcgucuacagcaagggcugcgggaacgugcagaaggugaacggcaccaacuacgggaacggcgccccgcgguucgacuaccugugccaccuggcgucccgcaaggaggucauccuccggaagugcuucgacaacgacuaccaggccugcaaguuccugcagagccccuccagcuaccgccuggaggagcaccaggggaccgugacggugaucgacuacaagaagauccucggcaccaucaagaugaaggccauccugggcgacgucaaguacaagaacuuccaguccaacaucgagaucaacgccgaggggaccugcgccggcugcaucaacugcuucgagaacauccacugcgaguucaccauccacacgaccguggagaccagcugccccaucgugaccgacugcgucagcuuccacgaccgcauccugaucacgcccgacgagcacaaguacgcgcucaagguggucugccaggacaagccgaaggugucccugaaguucaagaucugcaacaccaacaucgacgccagcaugaccaucguggacuccaagcccauccuggagcucgcccccgucgaccagaccgccuacauccgggagaaggacgagcgcugcaagacguggaugugccgggugcgcgacgagggguuccaggugauccuggagcccuucaagaaccuguucggcagcuacaucgggaucuucuacaccggcauccucuccaucaucugccugcugaucgucaucuacaucauccucccgaucugcuucaagcugcgggacacccugcgccagcacgaggacgccuacaagaaggagaugaagauccgguga

SEQ ID NO: 12645 - RNA, 4335 nt, Artificial Sequence
  derived and/or modified CDS sequence (opt1) from JCV(61V2235)__U88058.1__GP
auggaggugcugaaccucaucuggcugcuggcccucugcagcgccucccccgucuuccagcgcugcuuccaggacggcgcgaucgugaagcagaacccgagcaaggaggccgugaccgaggucugccugaaggacgacguguccaugaucaagaccgaggccaaguacgugaagaacacgaccgggaccuucgccaacaacaucgccaugcggaaguggcuggucgcggacuggcacgacugccgcccccagaaguccuccggcgggcacaucaacgugaucgaggugggcgacgaccucagccugcacaccgaguccuacaucugcagcgccgacugcgucaucacgguggacaaggagaccgcccagauccggcugcagaccgacaacaccaaccacuucgagguggccgggacgaccgucaaguccggcugguucaagagcaccaccuacaucacgcucgaccagaccugcgagcaccugaagguguccugcggccccaagagcauccaguuccacgcgugcuucaaccagcacauguccugcgugcgcuuccugcaccggaccauccuccccgggagcaucgccaacuccaucugccagaacaucgagaucaucauccuggucacccugagccucgugaucuucaucuuccuguccaucgugagcaagacguacgucugcuaccugcucaugccgaucuucacccccaucgccuucaucuacggcuggguguacaacaaguccugcaagaagugcaagcugugcgggcugguguaccaccccuucaccgagugcggcacccacugcgucugcggggcccgcuacgagaacagcgaccggaugaagcuccaccgcgccagcggccugugccccggcuacaagucccugcgggcggcccgcgugaugugcaagagcaaggggccggccuccauccucagcaucaugacggccauccugauccugaccuucgugacccccaucuccgccauggucaucggcgagagcuccgagcucuacacccuggacgaccugcccaacgacauggugcagauggcggagcgggucaacaucuacuaccagaucacgaucaucaacuacggggugaccugggccuucuucugccucggccugauccuggccuacuucuucaagaaguaccagcacaaguuccucgacuucuacgccauguacugcgaggagugcgacauguaccacgagaaguccggccugacccacuggggcgacuucaccaacaagugccgccagugcacgugcgggcaguucgaggacguggccgggcugaugauccacaagaaguccuacaacugccucgucaaguacaaggcgaaguggauccgggacauccugaucaucuaccuggccaugauccucaucaaggacagccugcuguucgugggcgccagcgggaccgacuucgccgccugcaucgacgagaagguggucaccuggaacugcaccggccccuuccucaaccugggccgcugcgacaagagccagaagaaggcguccuacgccgggaucgccgaccagcugaagggccucggggugaucagcgugcuggacaucccgaugaucaagaacaugcccgacgagaucuccggcagccugaaguacaucgacucccucgagacguaccacgagcagcugaccgccgaguacgcguuccugacccgguacugcgacuacuacacccaguacacggacaagagcggguacucccagaccgucuggcgcaccuaccugcggagccacgacuucggcgccugcgugguguaccccaaccagcacuucugccgcugcgucaaguacggcgacaagugcaacagcgccaagugggacuucgccaacgagaugaagaccuucuacaccgggcagaaggugaaguucaacaaggaccucaaccuggcccugcucgugcugcacaaggcguuccggggcacggggaccgccuacgucgccgaggccauggcccgcgaggacaacggcuccauggcgcacuucgcccuggagauccggaagaaguuccccaccaacgcccuccuggccgcccugaucgacuacaucguguaccuccagagccugggggagaucgcgaccuucgagcuggacgaggacugggaggacuucaaguacaagccggagcccacggaguccacgccccaggugcgcagccaccgcaacgaccaguacaacuucaagaacgccgaguccaacagcgacaccaaggucugcaagaacgugcagaaggugcucugcaucagcccccggagcaaggccaaguucgagaacaucaucgccugcggcgagcacgcgaacccguccgucuacaugaugcccaacgugagcaucuaccaguccaacagcgagcgcucccacuacugcaucgccggcagccacugccuggagaaguacgagguggucgagaccgagcugcucaacgcccugaagaaguccaagugcugggccaaggagauggacgacaucauccugcacaagcagagcgacgggcuccgguccugccgcaucaaggacaccggcaacugcaacgugcaggagaacgacuggaccaucgugcugugcgagaacgggaacuacuacuacagcgagguccacaaggacuacgacaaggaccaggacgugggccacuucugccugagcccccggugcaccaccauccgcuaccccaucuccaagcggcacaucaagaagugcgaguggcagaucagccacuccacgaucgacaagaucagcgugcaggagcucgccgacaucgagcaguacaagaaggcgaucucccagaagcugcagaccagccuguccaucuucaaguacguccgcaccaagaaccucccgcacaucaagcccgccuacaaguacaucaccguggagggcguggagacgaucgaggggaucgagaacgccuucaucgagagcgagauccccgcccuggccggcaccgcgaucggguucaagaucaacucccgggagggcaacuaccugauggacgucaucggguacgucaagagcgccuccuacagcgccguguacaccaagcucuacaccacgggccccaccaucggcaucaacaccaagcacgacgagaagugcaccgggccgugccccgccaucaucgaccacaaggacggcuggcugacguucuccaaggagcgcaccagcaccugggggugcgaggaguucggcugccuggccguguccgacgggugcguguucggcagcugccaggacaucaucaaggacgagcucgcgguguaccggaagaccacggaggagcugaccaccgucgagcugugccucaccuucuccgacaagacguacugcaccaaccugaacgccaucacccccaucaucaccgacaaguucgaggugcaguucaagacgguggagagcuacacccugccgcgcgucaucgccaucaagaaccacgagaucaaggugggccagaucaacgaccucgggguguacuccaagggcugcgggaacguccagaaggugaacggcaccaacuacgggaacggcagcccccgguucgacuaccugugccaccuggccagccgcaaggaggugauccuccggaagugcuucgacaacgacuaccaggcgugcaaguuccugcagucccccagcuccuaccgccuggaggagcaccagggcaccgucaccgugaucgacuacaagaagauccucgggacgaucaagaugaaggccauccugggcgacgugaaguacaagaacuaccagaacaacaucgagaucagcgccgaggggaccugcgccggcugcaucgacugcuucgagaacauccacugcgaguucaccauccacaccacggucgaggccuccugccccaucaccaccgagugcgugagcuuccacgaccggauccugaucaccccggacgagcacaaguacgcgcucaagaucgucugccacgacaagcccaaggugucccugaaguucaagaucugcaacacgcacguggacgccgccaugaccaucgucgacagcaagcccauccuggagcucgcccccguggaccagaccaccuacauccgcgagaaggacgagcggugcaagacguggaugugccgcgugcgcgacgagggguuccaggucauccuggagccguucaagaaccuguucggcuccuacaucggcaucuucuacaccgggauccucagcaucaucugccugcugaucgugguguacaucauccuccccaucugcuucaagcugcgggacacccugcgccagcacgaggacgccuacaagaaggagaugaagauccgguga

SEQ ID NO: 12646 - RNA, 4335 nt, Artificial Sequence
  derived and/or modified CDS sequence (opt1) from JCV(61V2235)__HM007351.1__GP
auggaggugcugaaccucaucuggcugcuggcccucugcagcgccucccccgucuuccagcgcugcuuccaggacggcgcgaucgugaagcagaacccgagcaaggaggccgugaccgaggucugccugaaggacgacguguccaugaucaagaccgaggccaaguacgugaagaacacgaccgggaccuucgccaacaacaucgccaugcggaaguggcuggucgcggacuggcacgacugccgcccccagaaguccuccggcgggcacaucaacgugaucgaggugggcgacgaccucagccugcacaccgaguccuacaucugcagcgccgacugcgucaucacgguggacaaggagaccgcccagauccggcugcagaccgacaacaccaaccacuucgagguggccgggacgaccgucaaguccggcugguucaagagcaccaccuacaucacgcucgaccagaccugcgagcaccugaagguguccugcggccccaagagcauccaguuccacgcgugcuucaaccagcacauguccugcgugcgcuuccugcaccggaccauccuccccgggagcaucgccaacuccaucugccagaacaucgagaucaucauccuggucacccugagccucgugaucuucaucuuccuguccaucgugagcaagacguacgucugcuaccugcucaugccgaucuucauccccaucgccuucaucuacggcuggguguacaacaaguccugcaagaagugcaagcugugcgggcugguguaccaccccuucaccgagugcggcacccacugcgucugcggggcccgcuacgagaccagcgaccggaugaagcuccaccgcgccagcggccugugccccggcuacaagucccugcgggcggcccgcgugaugugcaagagcaaggggccggccuccauccucagcaucaugacggccauccugauccugaccuucgugacccccaucuccgccauggucaucggcgagagcuccgagguguacacccucgacgaccugcccaacgacaugguccagauggcggagcgggugaacaucuacuaccagaucaucaucaucaacuacggggugacgugggccuuccugcuccugggccugauccucgccuacuucuucaagaaguaccagcacaaguuccuggacuucuacgccauguacugcgaggagugcgacauguaccacgagaaguccggccugacccacuggggcgacuucaccaacaagugccgccagugcacgugcgggcaguucgaggacgucgccgggcucaugauccacaagaaguccuacaacugccuggugaaguacaaggcgaaguggauccgggacauccugaucaucuaccucgccaugauccugaucaaggacagccuccuguucgugggcgccagcgggaccgacuucgccgccugcaucgacgagaaggucgugaccuggaacugcaccggccccuuccugaaccugggccgcugcgacaagagccagaagaaggcguccuacgccgggaucgccgaccagcucaagggccugggggugaucagcguccuggacaucccgaugaucaagaacaugcccgacgagaucuccggcagccucaaguacaucgacucccuggagaccuaccacgagcagcugacggccgaguacgcguuccugacccgguacugcgacuacuacacccaguacaccgacaacagcggguacucccagacgguguggcgcaccuaccuccggagccacgacuucggcgccugcguggucuaccccaaccagcacuucugccgcugcgugaaguacggcgacaagugcaacagcgccaagugggacuucgccaacgagaugaagaccuucuacaccgggcagaaggugaaguucaacaaggaccugaaccuggcccuccugguccugcacaaggcguuccggggcaccgggacggccuacguggccgaggccauggcccgcaaggacaacggcuccauggcgcacuucgcccucgagauccggaagaaguuccccaccaacgcccugcuggccgcccucaucgacuacaucguguaccugcagagccugggggagaucgcgaccuucgagcucgacgaggacugggaggacuucaaguacaagccggagcccaccgaguccacgccccagguccgcagccaccgcaacgaccaguacaacuucaagaacgccgaguccaacagcgacaccaaggugugcaagaacgugcagaagguccugugcaucagcccccggagcaaggccaaguucgagaacaucaucgccugcggcgagcacgcgaacccguccguguacaugaugcccaacgugagcaucuaccaguccaacagcgagcgcucccacuacugcaucgccgacagccacugccuggagaaguacgaggucguggagaccgagcuccugaacgcccugaagaaguccaagugcugggccaaggagauggacgacaucauccuccacaagcagagcgacggccugcgguccugccgcaucaaggacaccgggaacugcaacgugcaggagaacgacuggacgaucguccugugcgagaacggcaacuacuacuacagcgaggugcacaaggacuacgacaaggaccaggacguggggcacuucugccucagcccccggugcaccaccauccgcuaccccaucuccaagcggcacaucaagaagugcgaguggcagaucagccacuccaccaucgacaagaucagcguccaggagcuggccgacaucgagcaguacaagaaggcgaucucccagaagcugcagacgagccucuccaucuucaaguacgugcgcaccaagaaccugccgcacaucaagcccgccuacaaguacaucaccguggagggcgucgagaccaucgagggcaucgagaacgccuucaucgagagcgagauccccgcccuggccgggacggcgaucggcuucaagaucaacucccgggaggggaacuaccucauggacgugaucggcuacgucaagagcgccuccuacagcgccguguacaccaagcuguacaccaccgggcccacgaucggcaucaacaccaagcacgacgagaagugcaccggcccgugccccgccaucaucgaccacaaggacggguggcugaccuucuccaaggagcgcacgagcaccuggggcugcgaggaguucgggugccucgccguguccgacggcugcguguucgggagcugccaggacaucaucaaggacgagcuggcggucuaccggaagaccaccgaggagcugacgaccguggagcucugccugaccuucuccgacaagaccuacugcacgaaccugaacgccaucacccccaucaucaccgacaaguucgaggugcaguucaagaccgucgagagcuacacgcucccgcgcgugaucgccaucaagaaccacgagaucaaggugggccagaucaacgaccugggcgucuacuccaaggggugcggcaacgugcagaaggugaacgggaccaacuacggcaacgggagcccccgguucgacuaccugugccaccucgccagccgcaaggaggucauccugcggaagugcuucgacaacgacuaccaggcgugcaaguuccugcagucccccagcuccuaccgccucgaggagcaccagggcaccgugaccgugaucgacuacaagaagauccugggcaccaucaagaugaaggccauccugggggacgucaaguacaagaacuaccagaacaacaucgagaucaacgccgagggcacgugcgccgggugcaucgacugcuucgagaacauccacugcgaguucaccauccacaccaccguggaggccagcugccccaucacgaccgagugcgucuccuuccacgaccggauccucaucaccccggacgagcacaaguacgcgcugaagaucgugugccacgacaagcccaaggugagccugaaguucaagaucugcaacaccaacgucgacgccgccaugacgaucguggacuccaagcccauccucgagcuggcccccguggaccagaccaccuacauccgcgagaaggacgagcggugcaagaccuggaugugccgcguccgcgacgagggcuuccaggugauccuggagccguucaagaaccucuucgggagcuacaucggcaucuucuacacgggcauccuguccaucaucugccugcucaucguggucuacaucauccugcccaucugcuucaagcugcgggacacccuccgccagcacgaggacgccuacaagaaggagaugaagauccgguga

SEQ ID NO: 12647 - RNA, 4335 nt, Artificial Sequence
  derived and/or modified CDS sequence (opt1) from JCV(61V2235)__KX817316.1__GP
auggaggugcugaaccucaucuggcugcuggcccucugcagcgccucccccgucuuccagcgcugcuuccaggacggcgcgaucgugaagcagaacccgagcaaggaggccgugaccgaggucugccugaaggacgacguguccaugaucaagaccgaggccaaguacgugaagaacacgaccgggaccuucgccaacaacaucgccaugcggaaguggcuggucgcggacuggcacgacugccgcccccagaaguccuccggcgggcacaucaacgugaucgaggugggcgacgaccucagccugcacaccgaguccuacaucugcagcgccgacugcgucaucacgguggacaaggagaccgcccagauccggcugcagaccgacaacaccaaccacuucgagguggccgggacgaccgucaaguccggcugguucaagagcaccaccuacaucacgcucgaccagaccugcgagcaccugaagguguccugcggccccaagagcauccaguuccacgcgugcuucaaccagcacauguccugcgugcgcuuccugcaccggaccauccuccccgggagcaucgccaacuccaucugccagaacaucgagaucaucauccuggucacccugagccucgugaucuucaucuuccuguccaucgugagcaagacguacgucugcuaccugcucaugccgaucuucauccccaucgccuucaucuacggcuggguguacaacaaguccugcaagaagugcaagcugugcgggcugguguaccaccccuucaccgagugcggcacccacugcgucugcggggcccgcuacgagaccagcgaccggaugaagcuccaccgcgccagcggccugugccccggcuacaagucccugcgggcggcccgcgugaugugcaagagcaaggggccggccuccauccucagcaucaugacggccauccugauccugaccuucgugacccccaucuccgccauggucaucggcgagagcuccgagguguacacccucgacgaccugcccaacgacaugguccagauggcggagcgggugaacaucuacuaccagaucaucaucaucaacuacggggugacgugggccuuccugcuccugggccugauccucgccuacuucuucaagaaguaccagcacaaguuccuggacuucuacgccauguacugcgaggagugcgacauguaccacgagaaguccggccugacccacuggggcgacuucaccaacaagugccgccagugcacgugcgggcaguucgaggacgucgccgggcucaugauccacaagaaguccuacaacugccuggugaaguacaaggcgaaguggauccgggacauccugaucaucuaccucgccaugauccugaucaaggacagccuccuguucgugggcgccagcgggaccgacuucgccgccugcaucgacgagaaggucgugaccuggaacugcaccggccccuuccugaaccugggccgcugcgacaagagccacaagaaggcguccuacgccgggaucgccgaccagcucaagggccugggggugaucagcguccuggacaucccgaugaucaagaacaugcccgacgagaucuccggcagccucaaguacaucgacucccuggagaccuaccacgagcagcugacggccgaguacgcguuccugacccgguacugcgacuacuacacccaguacaccgacaacagcggguacucccagacgguguggcgcaccuaccuccggagccacgacuucggcgccugcguggucuaccccaaccagcacuucugccgcugcgugaaguacggcgacaagugcaacagcgccaagugggacuucgccaacgagaugaagaccuucuacaccgggcagaaggugaaguucaacaaggaccugaaccuggcccuccugguccugcacaaggcguuccggggcaccgggacggccuacguggccgaggccauggcccgcaaggacaacggcuccauggcgcacuucgcccucgagauccggaagaaguuccccaccaacgcccugcuggccgcccucaucgacuacaucguguaccugcagagccugggggagaucgcgaccuucgagcucgacgaggacugggagggcuucaaguacaagccggagcccaccgaguccacgccccagguccgcagccaccgcaacgaccaguacaacuucaagaacgccgaguccaacagcgacaccaaggugugcaagaacgugcagaagguccugugcaucagcccccggagcaaggccaaguucaagaacaucaucgccugcggcgagcacgcgaacccguccguguacaugaugcccaacgugagcaucuaccaguccaacagcgagcgcucccacuacugcaucgccgacagccacugccuggagaaguacgaggucguggagaccgagcuccugaacgcccugaagaaguccaagugcugggccaaggagauggacgacaucauccuccacaagcagagcgacgggcugcgguccugccgcaucaaggacaccggcaacugcaacgugcaggagaacgacuggacgaucguccugugcgagaacgggaacuacuacuacagcgaggugcacaaggacuacgacaaggaccaggacgugggccacuucugccucagcccccggugcaccaccauccgcuaccccaucuccaagcggcacaucaagaagugcgaguggcagaucagccacuccaccaucgacaagaucagcguccaggagcuggccgacaucgagcaguacaagaaggcgaucucccagaagcugcagacgagccucuccaucuucaaguacgugcgcaccaagaaccugccgcacaucaagcccgccuacaaguacaucaccguggagggcgucgagaccaucgaggggaucgagaacgccuucaucgagagcgagauccccgcccuggccggcacggcgaucggguucaagaucaacucccgggagggcaacuaccucauggacgugaucggguacgucaagagcgccuccuacagcgccguguacaccaagcuguacaccaccggccccacgaucggcaucaacaccaagcacgacgagaagugcaccgggccgugccccgccaucaucgaccacaaggacggcuggcugaccuucuccaaggagcgcacgagcaccugggggugcgaggaguucggcugccucgccguguccgacgggugcguguucggcagcugccaggacaucaucaaggacgagcuggcggucuaccggaagaccaccgaggagcugacgaccguggagcucugccugaccuucuccgacaagaccuacugcacgaaccugaacgccaucacccccaucaucaccgacaaguucgaggugcaguucaagaccgucgagagcuacacgcucccgcgcgugaucgccaucaagaaccacgagaucaaggugggccagaucaacgaccugggggucuacuccaagggcugcgggaacgugcagaaggugaacggcaccaacuacgggaacggcagcccccgguucgacuaccugugccaccucgccagccgcaaggaggucauccugcggaagugcuucgacaacgacuaccaggcgugcaaguuccugcagucccccagcuccuaccgccucgaggagcaccagggcaccgugaccgugaucgacuacaagaagauccuggggaccaucaagaugaaggccauccugggcgacgucaaguacaagaacuaccagaacaacaucgagaucaacgccgaggggacgugcgccggcugcaucgacugcuucgagaacauccacugcgaguucaccauccacaccaccguggaggccagcugccccaucacgaccgagugcgucuccuuccacgaccggauccucaucaccccggacgagcacaaguacgcgcugaagaucgugugccacgacaagcccaaggugagccugaaguucaagaucugcaacaccaacgucgacgccgccaugacgaucguggacuccaagcccauccucgagcuggcccccguggaccagaccaccuacauccgcgagaaggacgagcggugcaagaccuggaugugccgcguccgcgacgagggguuccaggugauccuggagccguucaagaaccucuucggcagcuacaucggcaucuucuacacggggauccuguccaucaucugccugcucaucguggucuacaucauccugcccaucugcuucaagcugcgggacacccuccgccagcacgaggacgccuacaagaaggagaugaagauccgguga

SEQ ID NO: 12648 - RNA, 4335 nt, Artificial Sequence
  derived and/or modified CDS sequence (opt1) from JCV(3573-03)__HM007354.1__GP
auggaggugcugagccucaucuggcugcugacccucugcuccgccagccccgucuuccagcgcugcuuccaggacggcgccaucgugaagcagaacccguccaaggaggcggugaccgaggucugccugaaggacgacgugagcaugaucaagacggaggccaaguacgugaagaacaccaccgggaccuucgccaacaacaucgccaugcggaaguggcuggucgccgacuggcacgacugccgcccccagaaguccagcggcgggcacaucaacgugaucgaggugggcgacgaccucucccugcacacggagagcuacaucugcuccgcggacugcgucaucaccguggacaaggagaccgcccagauccggcugcagaccgacaacacgaaccacuucgagguggccgggaccaccgucaagagcggcugguucaaguccaccacguacaucacccucgaccagaccugcgagcaccugaaggugagcugcggccccaaguccauccaguuccacgccugcuucaaccagcacaugagcugcgugcgcuuccugcaccggaccauccuccccuccagcaucgcgaacuccaucugccagaacaucgagaucaucauccuggucacgcugagccucaccaucuucaucuuccugaccaucguguccaagaccuacaucugcuaccugcucaugccgguguucauccccaucgccuucgucuacggguggaucuacaacaagagcugcaagaagugcaagcugugcggccugguguaccaccccuucacggagugcgggacccacugcgugugcggcgcccgcuacgagaccagcgaccggaugaagcuccaccgcgccuccgggcugugccccggcuacaagagccugcgggccgcgcgcgucaugugcaaguccaagggcccggccagcauccucuccaucaugaccgccgugcugauccugacguucgugacccccaucagcgccaugaugaucggggaguccagcgaggucuacacccucgacgaccugcccgacgacauggugcagauggccgagcgggucaacaucuacuaccagaucaucaucaucaacuacggcgugaccugggcguuccugcuccuggggcuggugcucgccuacuucuucaagaaguaccagcacaaguuccuggacuucuacgccauguacugcaacgagugcgacauguaccacgagaaggccggccugacgcacuggggcgacuucaccaaccgcugccggcagugcacgugcgggcaguacgaggacgucaccggccucaucgugcacaagaaguccuacaacugccuggugaaguacaaggccaaguggauccgcgacauccugaucaccuaccucaucaucauccuggucaaggacagccuccuguucgugggggcgaccggcaccgacuucgccgccugcaucgacgagaagaccgugacguggaacugcaccgggcccuuccugaaccugggccggugcgacaagucccagaagaagaccagcuacaacgacaucgccaaccagcucaagggccugggggucaucuccgugcuggacaucccgaugaucaagcgcaugcccgacgagaucagcggcucccucaaguacaucgacaaccuggagaccuaccacgagcagcugaccgccgaguacgcguuccugacgcgguacugcgacuacuacacccaguacaccgacaacagcggguacucccagaccguguggcgcacguaccuccggagccacgacuucggcgccugcgucguguaccccaaccagcacuucugccgcugcgugaaguacggggacaagugcaacuccgccaagugggacuucgccaacgagaugaagaccuucuacaccggccagaagaucaaguucaacaaggaccugaaccuggcgcuccugguccugcacaaggccuuccggggcaccgggacggccuacaucgccgaggccauggcgcgcaaggacaacggcagcauggcccacuucgcccucgaggugcgcaagaaguuccccaccaacgcccugcuggccgcgcucaucgacuacaucguguaccugcagagccuggccgagaucuccaccuucgagcucgacgaggacugggaggacuucaaguacaagccggagcccaccgagagccccucccaggcccggagccaccgcuccgaccaguacaacuucaagaacgccgagagcaacuccaacgucaaggugugcaagaacauccagaaggugcugugcaucagcccccggucccgcgccaaguucgagaacaucaucgcgugcggggagcacgccaacccgagcgucuacaugaugcccaacguguccaucuaccagagcaacuccgagcggagccacuacugcaucgccgacucccacugccuggaggacuacgagaucguggagacggagcuccugagcgcccugaagaaguccaagugcugggcgaaggagauggacgacaucguccuccacaagcagagcgacggccugcgcagcugccggaugaaggacaccgggaacugcgacgugcaggagaacgacuggaccaucgugcugugcgagaacggcaacuacuacuacuccgagauccacaaggacuacgacaaggaccaggacgucggccacuucugccucagcccccgcugcuccaccauccgguaccccaucaacaagcgccacaucaagcggugcaacuggcagaucagccacuccacgaucgacaagaucagcgugcaggagcuggccgacaucgagcaguacaagaaggccaucucccagaagcugcagaccagccucuccaucuucaaguacgugaagaccaagaaccugccgcacaucaagcccgccuacaaguacaucaccgucgaggggaucgagacgguggagggcaucgagaacgccuucaucgagagcgagauccccgcgcuggccgggaccgccaucggcuucaagaucaacucccgcgagggcaacuaccucauggacgugaucggguacgucaagagcgccuccuacagcgccaccuacaccaagcuguacacgaccggccccaccaucgggaucaacacccggcacgacgagaagugcacgggcccgugccccgcggugaucgaccacaaggacggguggcugaccuucuccaaggagcgcaccagcaccuggggcugcgaggaguucggcugccucgccguguccgacgggugcgucuucggcagcugccaggacaucaucaaggacgagcuggccguguaccggaagacgaccgaggagcugaccaccguggagcucugccugacguucuccgacaagaccuacugcaccaaccugaacgccaucacccccaucaucaccgacaaguucgagguccaguucaagacgguggagagcuacacccucccgcgcgugaucgccgucaagaaccacgagaucaagguggggcagaucaacgaccugggcguguacagcaaggggugcggcaacguccagaaggugaacggcaccaacuacgggaacggcaugcccaaguucgacuaccugugccaccucgcgucccggaaggaggugauccugcgcaagugcuucgacaacgacuaccaggccugcaaguuccugcagagccccuccagcuaccggcucgaggagcaccaggggaccgucacgaucaucgacuacaagaagauccugggcaccaucaagaugaaggccauccugggggacgugaaguacaagaacuaccaguccaacaucgagaucaacgccgaggggaccugcgcgggcugcaucaacugcuucgagaacauccacugcgaguucaccauccacacgaccguggaggccagcugccccaucgucaccgacugcguguccuuccacgaccgcauccucaucaccccggacgagcacaaguacgcccugaaggucgugugccaggacaagcccaaggugagccugaaguucaagaucugcaacacgaacaucgacgccuccaugaccaucgucgacagcaagcccauccucgagcuggcccccguggaccagaccgcguacaucaaggagaaggacgagcgcugcaagaccuggaugugccgggugcgcgacgagggcuuccaggucauccuggagccguucaagaaccucuucggcuccuacaucgggaucuucuacacgggcauccugagcgugaucugccugcucaucgugaucuacaucauccugcccaucugcuucaagcugcgggacacccuccgccagcacgaggacgccuacaagaaggagaugaagauccgguga

SEQ ID NO: 12649 - RNA, 4335 nt, Artificial Sequence
  derived and/or modified CDS sequence (opt1) from KEYV(KEYV/Ochlerotatus atlanticus/USA/KEYVLK01/2005)__KT630289.1__GP
augaugaucuggauccugcucaccguggucaccgugacgaucgccaaccccguguaccagcgcugcuuccaggacggcgccaucgucaagcagaacccgagcaaggaggcggugaccgaggugugccugaaggacgacgucuccaugaucaagaccgaggccaaguacgugaagaaccugaccgggacguucagcaacaacguggccaugcggaaguggcucgucgccgacuggcacgacugccgcccccagaagcgggccggcgggcacaucaacgugaucgaggugggcgacgaccugucccugcacaccgagagcuacaucugcuccgcggacugcgucaucagcguggacaaggagaccgcccagauccgccuccagaccgacacgaccaaccacuucgagguggccgggaccaccgucaaguccggcugguucaagagcacgaccuacaucacccuggaccagaccugcgagcaccugaagguguccugcggccccaagagcauccaguuccacgccugcuucaaccagcacauguccugcgugcgguuccuccaccgcacgauccugcccgggagcaucgcgaacuccaucugccagaacaucgagaucaucauccuggucacccucacccugcugaucuucauccuccugagcauccuguccaagaccuacaucugcuacauccucaugccgaucuucauccccaucgccuacaucuacggcuggguguacaacaagagcugcaagaagugcaagcugugcgggcugguguaccaccccuucacggagugcggcacccacugcgucugcggggcccgguacgagaccuccgaccgcaugaagcuccaccgggccagcggccugugccccggcuacaagucccugcgcgccgcgcgggugaugugcaagagcaaggggccggccagcauccucuccauccugaccgccgugcugauccucacguucaucacccccaugaacgccaugguccugggcagcuccgaggagguguacaagcuggaggaccuccccgacgacaugcugaacauggccgagaagaucgacaucuacuaccugagcaucguccucaacuacuccaccaccugggggcugcugauccuccugcugaucgugagcugccucuucaagaaguaccagcacguguuccugaacuacuacgcgauguacugccacgagugcgacauguaccacgagaagaagaaccuggucuacaacggcgacuucuccaacaagugccgccagugcacgugcggccaguacgaggacgccaccgggcucaucgugcaccagaaguccuacaacugccugaucaaguacaaggccaagugguucaucaacauccugaucaucuacaccauccucgugcugcugaaggacuccguccucauggccgccgcggagggccccgacuucaacacgugcaucgagcagcggagcaucucccugaacugcaccgggccguucaucaaccugggcgggugcgagaagccccagaagcgcgccagcuaccaguccaucgccgagcagcugaaggccaucaacgccaucagcauccucgacaugcccaugaucuccaagauccccgacgacaucagcggcgcgcugcggcacaucgagaaccugaagaccuaccacgagcagcucaccgccgaguucgccaugcugacccgcuacugcgacuacuacacgcaguucuccgacaacagcggcuacucccagaccagcuggcggaccuaccugcgcagccacgacuucgaggugugcaucgccuacccgaaccagcacuucugccggugcgugaagaacggggagaagugcaccuccgcgaacugggacuucgccaacgagaugaagaacuacuacaccggcaagcagauccgcuucgacaaggaccucaaccuggcccugacgacccuccacaccgccuuccgggggaccagcacguacuacauguccgacauccuggccgagaccaaggcgaacagccugcgcgacuacgcccucgcccugaaguccaaguaccccggcaacgcccugcucaaggccauccuggacuucaucauguaccugcagagccucaacgaggcgaccaaguucaagcuguccagcgacugggaggacuucaaguacaacuccgagcuggaggcccgcgcccucaugccccgggcccgcagcuccggggacuacaacuucagcaacgccgaguccaccaacaaggucaagaucugcaagaacauccagcgggugaugugccugagcccccgcuccaaggcgacgguggaggacaucaucgccugcggcgagcacgagcacccgagcgucuacauggugcccaacaccaccaucuaccaguccaacaucgagcggagccacuacugcaucgccgacagccacugccuggaggaguacgagcucgugcagaacgagcugcugaccgcccucaagaaguccacgugcuggaccggcgagcuggagaacgucaucccccacaagcagagcgacgggauccgcuccugccggaccaagaacaccggccgcugcaacgugaagggggaggacuggacggugauccugugcgagaacgacaaguacuacuacagcgagcucaacaaggacuacgacaaggaccaggacaucggccacgucugccugagcccccggugcaacagcauccgcuacccgaucagcccccggcacaucaccaacugcaagugggagaaccccgcggggaccaucucccgcaucgagacccacucccuggccgacaucgagcaguacaagaaggccaucagccagaagcuccagaacucccugacgaucuucaaguacgagaagaccaagaaccugccccacaucaagccgaucuacaaguacaucaccaucgagggcaccgagacgguggagggcguggagaacgccuucaucgaggccgagauccccgcgcucgccgggaccagcaucggcuucaaggucaacucccgggacggggaccaccugauggacaucaucgccuacaucaagguggccagcuacuccagcaccuacaccaagcuguacacgaccggccccaccaucggcaucaacaccaagcacgacgagaagugcacggggaacugcccggcccgccucgagcacaaggugggcuggcugaccuucgcgaaggagcggaccuccaccugggggugcgaggaguucggcugccuggccgucagcgacgggugcguguucggcuccugccaggacaucaucaaggaggagcucagcguguaccgcaaggacacggaggaggucagcaacguggagcugugccugaccuucgccgacaagaccuacugcaccucccucaacgccaucacccccaucaucacggagaaguucgaggugcaguucaagaccgucgagagcuacucccugccccggaucgugggcauccgcaaccacgagauccggaucgggcagaucaacgaccugggcagcuacuccaaggggugcggcaacgugcagcgcgucaacgggaccaacuacggcagcggccagcccaaguucgacuaccucugccaccuggccucccgcaaggaggugaucgugcggaagugcuucgacaacgacuaccaggcgugcaaguuccugcagaccccgagcuccuaccgccucgaggagcacgaggggacggucaccaucaucgacuacaagaagauccugggcaccaucaagaugaaggccauccugggggacgugcgguacaagaacuacgccagcgccaucgacaucaacgcggagggcgugugcgccgggugcaucaacugcuucgagaacauccacugcgaguucaccauccacacgaccaucgaggccuccugccccaucgagagcgacugcgucuccuuccacgaccgcauccucgugacccccaacgagcacaaguacgcccugaagcugaucugcgaggacaagcccggcagcacccucaaguucaagaucugcaacacgaagaucgacgccgcgaugacccugguggacgccaagccgauccuggagcucgcccccgucgaccagaccgccuacauccgggagaaggacgagcgcugcaagaccuggaugugccgggugcgcgacgagggcaucaaggugcugcuggagcccuucaagaaccucuucggguccuacaucggcaucgucuacagcaucauccugaucaucaucgccgcgaucaucaucaucuacaucauccugcccaucugcuucaagcuccgggacacgcugaagaagcacgaggacgccuaccgcaaggagaugaagauccgguga

SEQ ID NO: 12650 - RNA, 4332 nt, Artificial Sequence
  derived and/or modified CDS sequence (opt1) from KEYV(KEYV/Ochlerotatus atlanticus/USA/KEYVLK01/2005)__KT630289.1__GP
augaucuggauccugcucaccguggucaccgugacgaucgccaaccccguguaccagcgcugcuuccaggacggcgccaucgucaagcagaacccgagcaaggaggcggugaccgaggugugccugaaggacgacgucuccaugaucaagaccgaggccaaguacgugaagaaccugaccgggacguucagcaacaacguggccaugcggaaguggcucgucgccgacuggcacgacugccgcccccagaagcgggccggcgggcacaucaacgugaucgaggugggcgacgaccugucccugcacaccgagagcuacaucugcuccgcggacugcgucaucagcguggacaaggagaccgcccagauccgccuccagaccgacacgaccaaccacuucgagguggccgggaccaccgucaaguccggcugguucaagagcacgaccuacaucacccuggaccagaccugcgagcaccugaagguguccugcggccccaagagcauccaguuccacgccugcuucaaccagcacauguccugcgugcgguuccuccaccgcacgauccugcccgggagcaucgcgaacuccaucugccagaacaucgagaucaucauccuggucacccucacccugcugaucuucauccuccugagcauccuguccaagaccuacaucugcuacauccucaugccgaucuucauccccaucgccuacaucuacggcuggguguacaacaagagcugcaagaagugcaagcugugcgggcugguguaccaccccuucacggagugcggcacccacugcgucugcggggcccgguacgagaccuccgaccgcaugaagcuccaccgggccagcggccugugccccggcuacaagucccugcgcgccgcgcgggugaugugcaagagcaaggggccggccagcauccucuccauccugaccgccgugcugauccucacguucaucacccccaugaacgccaugguccugggcagcuccgaggagguguacaagcuggaggaccuccccgacgacaugcugaacauggccgagaagaucgacaucuacuaccugagcaucguccucaacuacuccaccaccugggggcugcugauccuccugcugaucgugagcugccucuucaagaaguaccagcacguguuccugaacuacuacgcgauguacugccacgagugcgacauguaccacgagaagaagaaccuggucuacaacggcgacuucuccaacaagugccgccagugcacgugcggccaguacgaggacgccaccgggcucaucgugcaccagaaguccuacaacugccugaucaaguacaaggccaagugguucaucaacauccugaucaucuacaccauccucgugcugcugaaggacuccguccucauggccgccgcggagggccccgacuucaacacgugcaucgagcagcggagcaucucccugaacugcaccgggccguucaucaaccugggcgggugcgagaagccccagaagcgcgccagcuaccaguccaucgccgagcagcugaaggccaucaacgccaucagcauccucgacaugcccaugaucuccaagauccccgacgacaucagcggcgcgcugcggcacaucgagaaccugaagaccuaccacgagcagcucaccgccgaguucgccaugcugacccgcuacugcgacuacuacacgcaguucuccgacaacagcggcuacucccagaccagcuggcggaccuaccugcgcagccacgacuucgaggugugcaucgccuacccgaaccagcacuucugccggugcgugaagaacggggagaagugcaccuccgcgaacugggacuucgccaacgagaugaagaacuacuacaccggcaagcagauccgcuucgacaaggaccucaaccuggcccugacgacccuccacaccgccuuccgggggaccagcacguacuacauguccgacauccuggccgagaccaaggcgaacagccugcgcgacuacgcccucgcccugaaguccaaguaccccggcaacgcccugcucaaggccauccuggacuucaucauguaccugcagagccucaacgaggcgaccaaguucaagcuguccagcgacugggaggacuucaaguacaacuccgagcuggaggcccgcgcccucaugccccgggcccgcagcuccggggacuacaacuucagcaacgccgaguccaccaacaaggucaagaucugcaagaacauccagcgggugaugugccugagcccccgcuccaaggcgacgguggaggacaucaucgccugcggcgagcacgagcacccgagcgucuacauggugcccaacaccaccaucuaccaguccaacaucgagcggagccacuacugcaucgccgacagccacugccuggaggaguacgagcucgugcagaacgagcugcugaccgcccucaagaaguccacgugcuggaccggcgagcuggagaacgucaucccccacaagcagagcgacgggauccgcuccugccggaccaagaacaccggccgcugcaacgugaagggggaggacuggacggugauccugugcgagaacgacaaguacuacuacagcgagcucaacaaggacuacgacaaggaccaggacaucggccacgucugccugagcccccggugcaacagcauccgcuacccgaucagcccccggcacaucaccaacugcaagugggagaaccccgcggggaccaucucccgcaucgagacccacucccuggccgacaucgagcaguacaagaaggccaucagccagaagcuccagaacucccugacgaucuucaaguacgagaagaccaagaaccugccccacaucaagccgaucuacaaguacaucaccaucgagggcaccgagacgguggagggcguggagaacgccuucaucgaggccgagauccccgcgcucgccgggaccagcaucggcuucaaggucaacucccgggacggggaccaccugauggacaucaucgccuacaucaagguggccagcuacuccagcaccuacaccaagcuguacacgaccggccccaccaucggcaucaacaccaagcacgacgagaagugcacggggaacugcccggcccgccucgagcacaaggugggcuggcugaccuucgcgaaggagcggaccuccaccugggggugcgaggaguucggcugccuggccgucagcgacgggugcguguucggcuccugccaggacaucaucaaggaggagcucagcguguaccgcaaggacacggaggaggucagcaacguggagcugugccugaccuucgccgacaagaccuacugcaccucccucaacgccaucacccccaucaucacggagaaguucgaggugcaguucaagaccgucgagagcuacucccugccccggaucgugggcauccgcaaccacgagauccggaucgggcagaucaacgaccugggcagcuacuccaaggggugcggcaacgugcagcgcgucaacgggaccaacuacggcagcggccagcccaaguucgacuaccucugccaccuggccucccgcaaggaggugaucgugcggaagugcuucgacaacgacuaccaggcgugcaaguuccugcagaccccgagcuccuaccgccucgaggagcacgaggggacggucaccaucaucgacuacaagaagauccugggcaccaucaagaugaaggccauccugggggacgugcgguacaagaacuacgccagcgccaucgacaucaacgcggagggcgugugcgccgggugcaucaacugcuucgagaacauccacugcgaguucaccauccacacgaccaucgaggccuccugccccaucgagagcgacugcgucuccuuccacgaccgcauccucgugacccccaacgagcacaaguacgcccugaagcugaucugcgaggacaagcccggcagcacccucaaguucaagaucugcaacacgaagaucgacgccgcgaugacccugguggacgccaagccgauccuggagcucgcccccgucgaccagaccgccuacauccgggagaaggacgagcgcugcaagaccuggaugugccgggugcgcgacgagggcaucaaggugcugcuggagcccuucaagaaccucuucggguccuacaucggcaucgucuacagcaucauccugaucaucaucgccgcgaucaucaucaucuacaucauccugcccaucugcuucaagcuccgggacacgcugaagaagcacgaggacgccuaccgcaaggagaugaagauccgguga

SEQ ID NO: 12651 - RNA, 4332 nt, Artificial Sequence
  derived and/or modified CDS sequence (opt1) from KEYV(KEYV/Ochlerotatus atlanticus/USA/KEYVLK02/2005)__KT630292.1__GP
augaucuggauccugcucaccguggucaccgccacgaucgccaaccccguguaccagcgcugcuuccaggacggcgcgaucgugaagcagaacccgagcaaggaggccgucaccgaggugugccugaaggacgacguguccaugaucaagaccgaggccaaguacgucaagaaccugaccgggacguucagcaacaacguggccaugcggaaguggcucguggccgacuggcacgacugccgcccccagaagcgggcgggcgggcacaucaacgucaucgaggugggcgacgaccugucccugcacaccgagagcuacaucugcuccgccgacugcgugaucagcgucgacaaggagaccgcccagauccgccuccagaccgacacgaccaaccacuucgagguggccgggaccaccgugaaguccggcugguucaagagcacgaccuacaucacccuggaccagaccugcgagcaccugaaggucuccugcggccccaagagcauccaguuccacgcgugcuucaaccagcacauguccugcgugcgguuccuccaccgcacgauccugcccgggagcaucgccaacuccaucugccagaacaucgagaucaucauccuggugacccucacccugcugaucuucauccuccugagcauccuguccaagaccuacaucugcuacauccucaugccgaucuucauccccaucgccuacaucuacggcugggucuacaacaagagcugcaagaagugcaagcugugcgggcugguguaccaccccuucacggagugcggcacccacugcgugugcggggcccgguacgagaccuccgaccgcaugaagcuccaccgggccagcggccugugccccggcuacaagucccugcgcgcggcccgggucaugugcaagagcaaggggccggccagcauccucuccauccugaccgccgugcugauccucacguucaucacccccaugaacgccauggugcugggcagcuccgaggaggucuacaagcuggaggaccuccccgacgacaugcugaacauggcggagaagaucgacaucuacuaccugagcaucgugcucaacuacuccaccaccugggggcugcugauccuccugcugaucgucagcugccucuucaagaaguaccagcacguguuccugaacuacuacgccauguacugccacgagugcgacauguaccacgagaagaagaaccugguguacaacggcgacuucuccaacaagugccgccagugcacgugcggccaguacgaggacgccaccgggcucaucguccaccagaaguccuacaacugccugaucaaguacaaggccaagugguucaucaacauccugaucaucuacaccauccucgugcugcugaaggacuccgugcucauggccgcggccgagggccccgacuucaacacgugcaucgagcagcggagcaucucccugaacugcaccgggccguucaucaaccugggcgggugcgagaagccccagaagcgcgccagcuaccaguccaucgccgagcagcugaaggccaucaacgcgaucagcauccucgacaugcccaugaucuccaagauccccgacgacaucagcggcgcccugcggcacaucgagaaccugaagaccuaccacgagcagcucaccgccgaguucgccaugcugacccgcuacugcgacuacuacacgcaguucuccgacaacagcggcuacucccagaccagcuggcggaccuaccugcgcagccacgacuucgaggucugcaucgcguacccgaaccagcacuucugccggugcgugaagaacggggagaagugcaccuccgccaacugggacuucgccaacgagaugaagaacuacuacaccggcaagcagauccgcuucgacaaggaccucaaccuggcccugacgacccuccacaccgccuuccgggggaccagcacguacuacauguccgacauccuggcggagaccaaggccaacagccugcgcgacuacgcccucgcccugaaguccaaguaccccggcaacgcccugcucaaggcgauccuggacuucaucauguaccugcagagccucaacgaggccaccaaguucaagcuguccagcgacugggaggacuucaaguacaacuccgagcccgaggcccgcgcccugaugccccgggcccgcagcuccggggacuacaacuucagcaacgcggaguccaccaacaaggccaaggugugcaagaacauccagcgggucaugugccucagcccgcgcuccaaggccacgguggaggacaucaucgccugcggcgagcacgagcaccccagcguguacaugguccccaacaccaccguguaccaguccaacaucgagcggagccacuacugcaucgcggacagccacugccuggaggaguacgagcuggugcagaacgagcuccugaccgcccugaagaaguccacgugcuggaccggcgagcucgagaacgucaucccccacaagcagagcgacgggacccgcuccugccggaccaagaacacgggccgcugcaacgugaagggggaggacuggaccgugauccugugcgagaacgacaaguacuacuacagcgagcugaacaaggacuacgacaaggaccaggacaucggccacgucugccucuccccgcggugcaacagcauccgcuaccccaucagcccccggcacaucaccaacugcaagugggagaaccccgccgggaccaucagccgcaucgagacgcacucccuggccgacaucgagcaguacaagaaggccaucagccagaagcugcagaacucccucaccaucuucaaguacgagaagaccaagaaccugccgcacaucaagcccaucuacaaguacaucaccaucgagggcacggagaccguggagggcguggagaacgcguucaucgaggccgagauccccgcccuggccgggaccagcaucggcuucaaggucaacucccgggacggggaccaccucauggacaucaucgccuacaucaagguggcgagcuacuccagcaccuacacgaagcuguacaccaccggcccgaccaucggcaucaacacgaagcacgacgagaagugcaccgggaacugccccgcccgccuggagcacaaggugggcuggcucaccuucgccaaggagcggaccuccacgugggggugcgaggaguucggcugccuggccgucagcgacgggugcguguucggcuccugccaggacaucaucaaggaggagcugagcguguaccgcaaggacaccgaggaggucaccaacguggagcucugccugaccuucgccgacaagaccuacugcacgagccugaacgcgaucacccccaucaucaccgagaaguucgaggugcaguucaagaccgucgaguccuacagccucccccggaucgugggcauccgcaaccacgagauccggaucgggcagaucaacgaccugggcuccuacagcaaggggugcggcaacgugcagcgcgucaacgacacgaacuacggguccggccagccgaaguucgacuaccugugccaccucgccagccgcaaggaggugaucgugcggaagugcuucgacaacgacuaccaggccugcaaguuccugcagacccccuccagcuaccgccuggaggagcacgagggcaccgucaccaucaucgacuacaagaagauccucgggacgaucaagaugaaggccauccugggcgacgugcgguacaagaacuacgcguccgccaucgacaucaacgccgagggggugugcgccggcugcaucaacugcuucgagaacauccacugcgaguucaccauccacaccaccaucgaggccagcugccccaucgaguccgacugcgucagcuuccacgaccgcaugcuggugacgcccaacgagcacaaguacgcgcucaagcugaucugcgaggacaagccgggguccacccugaaguucaagaucugcaacaccaagaucgacgccgccaugacccucguggacgccaagcccauccuggagcuggcccccgucgaccagacggcguacauccgggagaaggacgagcgcugcaagaccuggaugugccgggugcgcgacgagggcaucaaggugcuccuggagcccuucaagaaccuguucggcagcuacaucgggaucgucuacuccaucauccucaucaucaucgccgccaucaucaucaucuacgugauccugccgaucugcuucaagcugcgggacacccucaagaagcacgaggacgccuaccgcaaggagaugaagauccgguga

SEQ ID NO: 12652 - RNA, 4332 nt, Artificial Sequence
  derived and/or modified CDS sequence (opt1) from KEYV(C14031-33)__AF123489.1__GP
augaucuggauccugcucaccguggucaccgugacgaucgccaaccccguguaccagcgcugcuuccaggacggcgccaucgucaagcagaacccgagcaaggaggcggugaccgaggugugccugaaggacgacgucuccaugaucaagaccgaggccaaguacgugaagaaccugaccgggacguucagcaacaacguggccaugcggaaguggcucgucgccgacuggcacgacugccgcccccagaagcgggccggcgggcacaucaacgugaucgaggugggcgacgaccugucccugcacaccgagagcuacaucugcuccgcggacugcgucaucagcguggacaaggagaccgcccagauccgccuccagaccgacacgaccaaccacuucgagguggccgggaccaccgucaaguccggcugguucaagagcacgaccuacaucacccuggaccagaccugcgagcggcugaagguguccugcggccccaagagcauccaguuccacgccugcuucaaccagcacauguccugcgugcgcuuccuccaccggacgauccugcuggggagcaucgcgaacuccaucugccagaacaucgagaucaucauccucgucacccugacccugcucaucuucauccugcugagcauccucuccaagaccuacaucugcuacauccugaugcccaucagcaucccgaucgccuacaucuacggcuggguguacaacaaguccugcaagaagugcaagcugugcgggcucguguaccaccccuucacggagugcggcacccacugcgucugcggggcccgcuacgagaccagcgaccggaugaagcugcaccgcgccuccggccugugccccggcuacaagagccuccgggccgcgcgcgugaugugcaagagcaaggggcccgccuccauccugagcauccugaccgccgugcucauccugacguucaucaccccgaugaacgccaugguccugggcuccagcgaggagguguacaagcucgaggaccugcccgacgacaugcugaacauggccgagaagaucgacaucuacuaccucuccaucguccugaacuacagcaccaccugggggcugcucauccugcugcucaucguguccugccuguucaagaaguaccaccugguguuccucaacuacuacgcgcuguacugccacgagugcgacauguaccacgagaagaagaaccuggucuacaacggcgacuucagcaacaagugccuccagugcacgugcggccaguacgaggacgccaccgggcugaucgugcaccagaaguccuacaacugccugaucaacuacaaggccaagugguucaucaacauccucaucaucuacaccauccuggugcugcugaaggacagcguccucauggccgccgcggagcggcccgacuucaacacgugcaucgagcagcgcuccaucagccugaacugcaccggccccuucaucaaccucgggggcugcaagaagccgcagaagcgggccuccuaccagagcaucgccgagcagcugaaggccaucaacgccaucuccauccuggacaugcccaugaucagcaagauccccgacgacaucuccggggcgcugcgccacaucgagaaccucaagaccuaccacgagcagcugaccgccgaguucgccaugcugacccgguacugcgacuacuacacgcaguucagcgacaacuccggcuacagccagaccagcuggcgcaccuaccuccggucccacgacuucgaggugugcaucgccuaccccaaccagcacuucugccgcugcgugaagaacggcgagaagugcaccagcgcgaacugggacuucgccaacgagaugaagaacuacuacaccgggaagcagauccgguucgacaaggaccugaaccuggcccucacgacccugcacaccgccuuccgcggcaccuccacguacuacaugagcgacauccuggccgagaccaaggcgaacucccuccgcgacuacgcccuggcccugaaguccaaguacccggggaacgcccuccugaaggccauccuggacuucaucauguaccuccagccccugaacgaggcgaccaaguucaagcuguccagcgacugggaggacuucaaguacaacuccgagcccgaggcccgggcccucaugccccgcgcccggagcuccggcgacuacaacuucagcaacgccgaguccaccaacaaggucaaggugugcaagaacauccagcgcgugaugugccugagcccgcgguccaaggcgacggucgaggacaucaucgccugcggggagcacgagcaccccagcguguacauggugcccaacaccaccaucuaccaguccaacaucgagcgcagccacuacugcaucgccgacagccacugccuggaggaguacgagcucguccagaacgagcugcugaccgcccucaagaaguccacgugcuggaccggcgagcuggagaacgugaucccccacaagcagagcgacggcauccgguccugccgcaccaagaacaccgggcggugcaacgugaagggcgaggacuggacggucauccugugcgagaacgacaaguacuacuacagcgagcucaacaaggacuacgacaaggaccaggacaucgggcacgugugccuguccccgcgcugcaacagcauccgguaccccaucagcccccgccacaucaccaacugcaagugggagaaccccgcgggcaccaucagccggaucgagacccacucccuggccgacaucgagcaguacaagaaggccaucagccagaagcuccagaacucccugacgaucuucaaguacgagaagaccaagaaccugccgcacaucaagcccaucuacaaguacaucaccaucgaggggaccgagacgguggagggcgucgagaacgccuucaucgaggccgagauccccgcgcucgccggcaccagcaucggguucaaggugaacucccgcgacggcgaccaccugauggacaucaucgccuacaucaagguggccagcuacuccagcaccuacaccaagcuguacacgaccgggccgaccaucggcaucaacaccaagcacgacgagaagugcacgggcaacugccccgcccggcucgagcacaaggucggguggcugaccuucgcgaaggagcgcaccuccaccuggggcugcgaggaguucgggugccuggccgugagcgacggcugcguguucggguccugccaggacaucaucaaggaggagcucagcgucuaccggaaggacacggaggaggugaccaacguggagcugugccugaccuucgccgacaagaccuacugcaccagccucaacgccaucacgcccaucaucaccgagaaguucgagguccaguucaagaccguggaguccuacagccugccccgcaucgugggcauccggaaccacgagauccgcaucggccagaucaacgaccugggguccuacagcaagggcugcgggaacguccagcgcgugaacggcaccaacuacggguccggccagccgaaguucgacuaccucugccaccuggccagccggaaggaggugaucguccgcaagugcuucgacaacgacuaccaggcgugcaaguuccugcagacgcccuccagcuaccggcucgaggagcacgagggcaccgugaccaucaucgacuacaagaagauccuggggaccaucaagaugaaggccauccugggcgacgugcgcuacaagaacuacgccuccgccaucgacaucaacgcggagggggucugcgccggcugcaucaacugcuucgagaacauccacugcgaguucacgauccacaccaccaucgaggccagcugccccaucgaguccgacugcgugagcuuccacgaccggaugcucgugacccccaacgagcacaaguacgcccugaagcugaucugcgaggacaagccgggguccgcccucaaguucaagaucugcaacacgaagaucgacgcggccaugacccuggucgacgccaagcccauccuggagcucgcccccguggaccagaccgccuacauccgcgagaaggacgagcggugcaagaccuggaugugccgcgugcgggacgagggcaucaagguccugcuggagcccuucaagaaccucuucggcagcuacaucgggaucguguacuccaucauccugaucaucaucgcggccaucaucaucaucuacaucauccugccgaucugcuucaagcuccgcgacacgcugaagaagcacgaggacgccuaccggaaggagaugaagauccgcuga

SEQ ID NO: 12653 - RNA, 4326 nt, Artificial Sequence
  derived and/or modified CDS sequence (opt1) from LACV(Human/78)__NC_004109.1__GP
augaucugcauccuggugcucaucaccgucgccgccgcgagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacccccaucaacuccauggugcucggggagagcaaggagacguucgagcuggaggaccugcccgacgacaugcucgagauggccucccggaucaacagcuacuaccugaccugcauccugaacuacgcgguguccuggggccucgucaucaucggccugcugaucgggcuccuguucaagaaguaccagcaccgcuuccugaacguguacgccauguacugcgaggagugcgacauguaccacgacaagagcggccucaagcggcacggggacuucaccaacaagugccgccagugcacgugcggccaguacgaggacgccgccgggcugauggcccaccggaagacguacaacugccuggugcaguacaaggcgaaguggaugaugaacuuccucaucaucuacaucuuccugauccugaucaaggacuccgccaucgucgugcaggccgccggcaccgacuucacgaccugccucgagaccgagagcaucaacuggaacugcaccggccccuuccugaaccuggggaacugccagaagcagcagaagaaggagccguacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacgcagaagcugcagaccagccugucccucuucaaguacgccaagaccaagaaccugccccacaucaagcccaucuacaaguacaucaccaucgagggcacggagaccgccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacacguucaucaucagcaucguggugcugcucgucaucaucuacgugcugcugcccaucugcuucaagcuccgcgacacccugcggaagcacgaggacgccuacaagcgcgagaugaagauccgguga

SEQ ID NO: 12654 - RNA, 4326 nt, Artificial Sequence
  derived and/or modified CDS sequence (opt1) from LACV__KP271111.1__GP
augauccgcauccuggugcucaucgccgucaccgccgcgagccccguguaccagcggugcuuccaggacggcgccaucgugaagcagaacccguccaaggaggccgucaccgaggugugccugaaggacgacgugagcaugaucaagacggaggcccgcuacguccggaacgccaccgggguguucuccaacaacguggcgauccgcaaguggcuggucagcgacuggcacgacugccggcccaagaagaucaucggcgggcacaucaacgugaucgaggugggcgacgaccucucccugcacaccgagagcuacgucugcuccgccgacugcagcaucgggguggacaaggagaccgcccaggugcgccugcagacggacaccaccaaccacuucgagaucgccggcaccacggucaaguccggcugguucaagagcaccaccuacaucacccucgaccagacgugcgagcaccugaagguguccugcgggcccaagagcgugcaguuccacgcgugcuucaaccagcacauguccugcguccgguuccugcaccgcaccauccuccccggcagcaucgccaacuccaucugccagaacaucgagaucaucauccuggugacccugacccuccugaucuucauccugcucagcauccuguccaagacguacaucugcuaccugcucaugccgaucuucauccccaucgccuacauguacgggaucaucuacaacaagagcugcaagaagugcaagcugugcggccugguguaccaccccuucaccgagugcgggacccacugcgucugcggcgcccgguacgacaccuccgaccgcaugaagcuccaccgggccagcggccugugccccggguacaagagccugcgcgcggcccgggugaugugcaaguccaagggcccggccagcauccucuccaucaucacggccgugcugguccugaccuucgugacccccaucaacagcaugguccucggggaguccaaggagaccuucgagcuggaggagcugcccgacgacaugcucgagauggccagccgcaucaacuccuacuacuucacgugcauccugaacuacgcggugagcuggggccuggugaucaucggccuccugaccgggcuccuguucaagaaguaccagcaccgguuccugaacgucuacgccauguacugcgaggagugcgacauguaccacgacaaguccggccugaagcgccacggggacuucaccaacaagugccggcagugcacgugcggccaguacgaggacgccgccgggcucauggcccaccgcaagaccuacaacugccuggugcaguacaaggcgaaguggaugaugaacuuccugaucaucuacaucuuccucauccugaucaaggacagcgccaucgugguccaggccgccggcaccgacuucacgaccugccuggagaccgaguccaucaacuggaacugcaccggccccuuccucaaccuggggaacugccagaagcagcagaagaaggagccguacaccaacaucgccacccagcugaagggccucaaggcgaucagcgugcuggacauccccaucaucacggggauccccgacgacaucgccggcgcccugcgguacaucgaggagcgcgaggacuuccacgugcagcugaccaucgaguacgccaugcucuccaaguacugcgacuacuacacccaguucagcgacaacuccggguacagccagaccaccuggcgggucuaccugcgcucccacgacuucgaggcgugcauccuguaccccaaccagcacuucugccgcugcgugaagaacggcgagaagugcagcuccagcaacugggacuucgccaacgagaugaaggacuacuacagcggcaagcagacgaaguucgacaaggaccucaaccuggcccugaccgcccuccaccacgccuuccgggggaccuccagcgcguacaucgccaccaugcuguccaagaaguccaacgacgaccugaucgccuacacgaacaagaucaaggccaaguucccgggcaacgcccuccugaaggcgaucaucgacuacaucgccuacaugaagucccugcccgggauggccaacuucaaguacgacgaguucugggacgagcuccuguacaagcccaaccccgccaaggccagcaaccuggcgcgcggcaaggagagcagcuacaacuucaagcucgccaucuccagcaaguccaucaagaccugcaagaacgugaaggacgucgccugccugagcccgcgguccggggccaucuacgcgagcaucaucgccugcggcgagcccaacggccccuccguguaccgcaagcccagcgggggcguguuccaguccagcaccgaccggagcaucuacugccugcucgacucccacugccuggaggaguucgaggccaucaaccaggaggagcuggacgccgucaagaaguccaagugcugggagaucgaguacagcgacgugaagccgcuccaggagggggacggcaccaagagcugccgcaugaaggacuccggcaacugcaacguggccacgaaccgguggcccgucauccagugcgagaacgacaaguucuacuacagcgagcugcagaaggacuacgacaagacccaggacaucgggcacuacugccugucccccggcugcaccaccgugcgcuaccccaucaacccgaagcacaucagcaacugcaacuggcaggucucccggagcuccaucgcgaagaucgacgugcacaacaucgaggacaucgagcaguacaagaaggccaucacgcagaagcuccagaccagccugucccuguucaaguacgccaagaccaagaaccucccccacaucaagcccaucuacaaguacaucaccaucgaggggacggagaccgccgagggcaucgagagcgccuacaucgaguccgaggugccggcgcuggccgggaccagcaucggcuucaagaucaacuccaaggagggcaagcaccuccuggacgugaucgccuacgucaagagcgccuccuacagcagcguguacgccaagcuguacuccaccgggcccacgagcggcaucaacaccaagcacgacgagcugugcaccgggcccugccccgcgaacaucaaccaccaggugggcuggcucaccuucgccaaggagcgcacguccagcugggggugcgaggaguucggcugccuggccgucuccgacggcugcguguucgggagcugccaggacaucaucaaggaggagcuguccguguaccggaaggagaccgaggaggucaccgacguggagcucugccugaccuucagcgacaagacguacugcaccaaccugaacccggugacccccaucaucaccgaccucuucgagguccaguucaagacgguggagaccuacucccugccccgcaucguggccguccagaaccacgagaucaagaucggccagaucaacgaccuggggguguacagcaagggcugcgggaacgugcagaagaucaacggcaccgucuacggcaacggggugccccgguucgacuaccucugccaccuggcgucccgcaaggaggugaucguccggaagugcuucgacaacgacuaccaggccugcaaguuccugcagagcccggccuccuaccgccucgaggaggacagcggcaccgugacgaucaucgacuacaagaagauccuggggaccaucaagaugaaggccauccugggcgacgugaaguacaagaccuucgccgacuccgucgacaucaccgcggaggggagcugcaccggcugcaucaacugcuucgagaacauccacugcgagcucacgcugcacaccaccaucgaggccuccugccccaucaagagcuccugcaccguguuccacgaccggauccuggugacgcccaacgagcacaaguacgcccucaagauggucugcaccgagaagcccggcaacacccugaccaucaaggugugcaacacgaagaucgaggccagcauggcccugguggacgcgaagccgaucaucgagcucgcccccgucgaccagaccgccuacauccgcgagaaggacgagcggugcaagaccuggaugugccgcgugcgcgacgaggggcugcaggucauccuggagcccuucaagaaccucuucggcagcuacaucgggaucuucuacaccuucaucaucuccaucguggcccugcuggugaucgucuacgugcuccugcccaucugcuucaagcugcgggacacgcuccgcaagcacgaggacgccuacaagcgggagaugaagauccgcuga

SEQ ID NO: 12655 - RNA, 4326 nt, Artificial Sequence
  derived and/or modified CDS sequence (opt1) from LACV__M87664.1__GP
augaucugcauccuggugcucaucaccgucgccaccgccagccccgugcugcagcgcugcuuccaggacggcgcgaucgugaagcagaacccguccaaggaggccuucacggaggucugccugaaggacgacgugagcaugaucaagaccgaggcccgguacgugcgcaacgccaccggggucuucuccaacaacguggccauccggaaguggcucgugagcgcguggcacgacugccgccccaagaagaucgucggcgggcacaucaacgugaucgaggugggcgacgaccugucccugcacaccgagagcuacgucugcuccgccgacugcacgaucgggguggacaaggagaccgcccaggugcggcuccagaccgacaccacgaaccacuucgagaucgccggcaccaccgucaagagcggcugguuccgcuccaccacguacaucacccuggaccagaccugcgagcaccugaaggugagcugcgggcccaaguccgugcaguuccacgcgugcuucaaccagcacaugagcugcguccgguuccuccaccgcaccauccugccccgguccaucgccaacagcaucugccagaacaucgagaucaucauccuggugacgcucacccugcugaucuucauccuccuguccauccugagcaagaccuacaucugcuaccuccugaugccgaucuucauccccaucgccuacaucuacggcaccaucuacaacaaguccugcaagaagugcaagcugugcgggcucgcccaccaccccuucacggagugcggcacccacugcgugugcggggcccgcuacgacaccagcgaccggaugaagcugcaccgcgcguccggccugugccccggcuacaagagccuccgggccgcccgcgucaugugcaagagcaaggggccggccuccauccugagcaucaucaccgccgugcuggugcucacguucgucacccccaucaacuccauggugcugggcgagagcaaggagaccuucgagcuggaggaccuccccgacgacaugcuggagauggcgucccggaucaacagcuacuacccgaccugcauccugaacuacgccgucuccugggggcucgugaucaucggccugcugaucggccuccuguucaagaaguaccagcaccgcuuccugaacguguacgccauguacugcgaggagugcgacauguaccacgacaagagcggggucaagcggcacggcgacuucacgaacaagugccgccagugcacgugcgggcaguacgaggacgccgccggccucauggcgcaccggaagaccuacaacugccuggugcaguacaaggccaaguggaugaugaacuuccugaucaucuacaucuuccucauccugaucaaggacuccgccaucgugguccaggccgccgggaccgacuucacgaccugccuggagaccgagagcaucaacuggaacugcaccggccccuuccucaaccugggcaacugccagaagcagcagaagaaggagcccuacaccaacaucgcgacccagcugaaggggcucaaggccaucuccgugcuggacauccccaucaucaccggcauccccgacgacaucgccggggcccugcgcuacaucgaggagaaggaggacuuccacgugcagcugaccaucgaguacgcgaugcucagcaaguacugcgacuacuacacccaguucuccgacaacagcggcuacucccagacgaccuggcgggucuaccugcgcagccacgacuucgaggccugcauccuguacccgaaccagcacuucugccgcugcgugaagaacggggagaagugcuccagcuccaaccgggacuucgccaacgagaugaaggacuacuacagcggcaagcagaccaaguucgacaaggaccucaaccuggcccugaccgcccuccacagccaggugaugcacugcuccagcgcguacaucgccacgaugcuguccaagaaguccaacgacgaccugaucgccuacaccaacaagaucaagaccaaguuccccggcaacgcccuccugaaggccaucaucgacuacaucgcguacaugaagucccugcccgggauggccaacuucaaguacgacgaguucugggacgagcuccuguacaagcccaacccggccaaggccagcaaccuggcccgcggcaaggagagcagcuacaacuucaagcucgcgaucuccagcaaguccaucaagaccugcaagaacgucaaggacguggccugccugagcccccgguccggggccaucuacgccagcaucaucgcgugcggcgagcccaacgggcccuccguguaccgcaagccgagcggcggcgucuuccaguccagcacggaccggagcaucuacugccugcucgacucccacugccuggaggaguucgaggccaucagccaggaggagcuggacgccgugaagaaguccaagugcugggagaucgaguaccccgacgugaagcucauccaggagggggacggcaccaagagcugccgcaugaaggacuccgggaacugcaacgucgccaccaaccgguggcccgugacccagugcgagaacgacaaguucuacuacagcgaccugcagaaggacuacgacaagacgcaggacaucggccacuacugccugucccccggcugcaccaccgugcgcuacccgaucaaccccaagcacaucagcaacugcaacuggcaggucucccggagcuccaucgccgagaucgacgugcacaacaucgaggacaucgagcaguacaagaaggcgaucacccagaagcuccagacgagccugucccuguucaaguacgccaagaccaagaaccucccccacaucaagccgaucuacaaguacaucaccaugaaggggaccgagacggccgagggcaucgagagcgccuacaucgaguccgaggugcccgcccuggcggggaccagcaucggcuucaagaucaacuccaaggaggggaagcaccuccuggacgucaucgccuacgucaagagcgccuccuacagcagcguguacaccaagcuguacuccaccggccccacgagcggcaucaacaccaagcacgacgagcugugcaccgggcccugcccggccaacaucaaccaccaggugggcuggcucaccuucgcccgcgagcggacguccagcugggggugcgaggaguucggcugccuggcgguguccgacgggugcguguucggcagcugccaggacaucaucaaggaggagcuguccgucuaccgcaaggagaccgaggaggugaccaacguggagcucugccugaccuucagcgacaagacguacugcaccaaccugaaccccgucacccccaucaucaccgaccucuucgaggugcaguucaagacgguggagaccuacucccugccccggaucgucgccgugcagaaccacgagaucaagaucggccagaucaacgaccuggggguguacagcaagggcugcgggaacguccagaaggugaacggcaccaucuacgggaacggcgugccgcgcuucgacuaccucugccaccuggccucccggaaggaggucaucgugcgcaagugcuucgacaacgacuaccaggccugcaaguuccugcagagccccgcguccuaccggcucgaggaggacagcggcaccgugaccaucaucgacuacaagaagauccuggggacgaucaagaugaaggccauccugggcgacgucaaguacaagaccuucgccgacuccguggacaucaccgccgaggggagcugcaccggcugcaucaacugcuucgagaacauccacugcgagcucacgcugcacaccaccaucgaggccuccugccccaucaagagcuccugcaccguguuccacgaccgcauccuggucacgcccaacgagcacaaguacgcgcucaagauggugugcaccgagaagccggggaacacccugaccaucaaggugugcaacacgaagaucgaggccagcauggcccuggucgacgccaagcccaucaucgagcucgcccccguggaccagaccgcguacauccgggagaaggacgagcgcugcaagaccuggaugugccgcguccgggacgagggccuccaggugauccuggagcccuucaagaaccuguucggcagcuacaucgggaucuucuacaccuucaucaucuccaucguggcccugcuggucaucaucuacgugcuccugccgaucugcuucaagcugcgcgacacgcuccggaagcacgaggacgccuacaagcgcgagaugaagauccgguga

SEQ ID NO: 12656 - RNA, 4326 nt, Artificial Sequence
  derived and/or modified CDS sequence (opt1) from LACV__KP271105.1__GP
augauccgcauccuggugcucaucgccgucaccgccgcgagccccguguaccagcggugcuuccaggacggcgccaucgugaagcagaacccguccaaggaggccgucaccgaggugugccugaaggacgacgugagcaugaucaagacggaggcccgcuacguccggaacgccaccgggguguucuccaacaacguggcgauccgcaaguggcuggucagcgacuggcacgacugccggcccaagaagaucaucggcgggcacaucaacgugaucgaggugggcgacgaccucucccugcacaccgagagcuacgucugcuccgccgacugcagcaucgggguggacaaggagaccgcccaggugcgccugcagacggacaccaccaaccacuucgagaucgccggcaccacggucaaguccggcugguucaagagcaccaccuacaucacccucgaccagacgugcgagcaccugaagguguccugcgggcccaagagcgugcaguuccacgcgugcuucaaccagcacauguccugcguccgguuccugcaccgcaccauccuccccggcagcaucgccaacuccaucugccagaacaucgagaucaucauccuggugacccugacccuccugaucuucauccugcucagcauccuguccaagacguacaucugcuaccugcucaugccgaucuucauccccaucgccuacauguacgggaucaucuacaacaagagcugcaagaagugcaagcugugcggccugguguaccaccccuucaccgagugcgggacccacugcgucugcggcgcccgguacgacaccuccgaccgcaugaagcuccaccgggccagcggccugugccccggguacaagagccugcgcgcggcccgggugaugugcaaguccaagggcccggccagcauccucuccaucaucacggccgugcugguccugaccuucgugacccccaucaacagcaugguccucggggaguccaaggagaccuucgagcuggaggagcugcccgacgacaugcucgagauggccagccgcaucaacuccuacuacuucacgugcauccugaacuacgcggugagcuggggccuggugaucaucggccuccugaccgggcuccuguucaagaaguaccagcaccgguuccugaacgucuacgccauguacugcgaggagugcgacauguaccacgacaaguccggccugaagcgccacggggacuucaccaacaagugccggcagugcacgugcggccaguacgaggacgccgccgggcucauggcccaccgcaagaccuacaacugccuggugcaguacaaggcgaaguggaugaugaacuuccugaucaucuacaucuuccucauccugaucaaggacagcgccaucgugguccaggccgccggcaccgacuucacgaccugccuggagaccgaguccaucaacuggaacugcaccggccccuuccucaaccuggggaacugccagaagcagcagaagaaggagccguacaccaacaucgccacccagcugaagggccucaaggcgaucagcgugcuggacauccccaucaucacggggauccccgacgacaucgccggcgcccugcgguacaucgaggagcgcgaggacuuccacgugcagcugaccaucgaguacgccaugcucuccaaguacugcgacuacuacacccaguucagcgacaacuccggguacagccagaccaccuggcgggucuaccugcgcucccacgacuucgaggcgugcauccuguaccccaaccagcacuucugccgcugcgugaagaacggcgagaagugcagcuccagcaacugggacuucgccaacgagaugaaggacuacuacagcggcaagcagacgaaguucgacaaggaccucaaccuggcccugaccgcccuccaccacgccuuccgggggaccuccagcgcguacaucgccaccaugcuguccaagaaguccaacgacgaccugaucgccuacacgaacaagaucaaggccaaguucccgggcaacgcccuccugaaggcgaucaucgacuacaucgccuacaugaagucccugcccgggauggccaacuucaaguacgacgaguucugggacgagcuccuguacaagcccaaccccgccaaggccagcaaccuggcgcgcggcaaggagagcagcuacaacuucaagcucgccaucuccagcaaguccaucaagaccugcaagaacgugaaggacgucgccugccugagcccgcgguccggggccaucuacgcgagcaucaucgccugcggcgagcccuccggccccagcguguaccgcaagcccuccgggggcguguuccagagcagcaccgaccgguccaucuacugccugcucgacagccacugccuggaggaguucgaggccaucaaccaggaggagcuggacgccgucaagaaguccaagugcugggagaucgaguacagcgacgugaagccgcuccaggagggggacggcaccaaguccugcaagaugaaggacagcggcaacugcaacguggccacgaaccgcuggcccgucauccagugcgagaacgacaaguucuacuacuccgagcugcagaaggacuacgacaagacccaggacaucgggcacuacugccugagccccggcugcaccaccgugcgguaccccaucaacccgaagcacaucuccaacugcaacuggcaggucagccgcuccagcaucgcgaagaucgacgugcacaacaucgaggacaucgagcaguacaagaaggccaucacgcagaagcuccagaccucccugagccuguucaaguacgccaagaccaagaaccucccccacaucaagcccaucuacaaguacaucaccaucgaggggacggagaccgccgagggcaucgaguccgccuacaucgagagcgaggugccggcgcuggccgggaccuccaucggcuucaagaucaacagcaaggagggcaagcaccuccuggacgugaucgccuacgucaaguccgccagcuacagcuccguguacgccaagcuguacagcaccgggcccacguccggcaucaacaccaagcacgacgagcugugcaccgggcccugccccgcgaacaucaaccaccaggugggcuggcucaccuucgccaaggagcggacgagcuccugggggugcgaggaguucggcugccuggccgucagcgacggcugcguguucggguccugccaggacaucaucaaggaggagcugagcguguaccgcaaggagaccgaggaggucaccgacguggagcucugccugaccuucuccgacaagacguacugcaccaaccugaacccggugacccccaucaucaccgaccucuucgagguccaguucaagacgguggagaccuacagccugccccggaucguggccguccagaaccacgagaucaagaucggccagaucaacgaccuggggguguacuccaagggcugcgggaacgugcagaaggucaacggcaccguguacggcaacggggugccccgcuucgacuaccucugccaccuggcgagccggaaggaggucaucgugcgcaagugcuucgacaacgacuaccaggccugcaaguuccugcaguccccggccagcuaccggcucgaggaggacuccggcaccgugacgaucaucgacuacaagaagauccuggggaccaucaagaugaaggccauccugggcgacgucaaguacaagaccuucgccgacagcguggacaucaccgcggagggguccugcaccggcugcaucaacugcuucgagaacauccacugcgagcucacgcugcacaccaccaucgaggccagcugccccaucaaguccagcugcaccguguuccacgaccgcauccuggucacgcccaacgagcacaaguacgcccucaagauggugugcaccgagaagcccggcaacacccugaccaucaaggugugcaacacgaagaucgaggccagcauggcccuggucgacgcgaagccgaucaucgagcucgcccccguggaccagaccgccuacauccgggagaaggacgagcgcugcaagaccuggaugugccggguccgcgacgaggggcuccaggugauccuggagcccuucaagaaccuguucggcuccuacaucgggaucuucuacaccuucaucaucagcaucguggcccugcuggucaucguguacgugcuccugcccaucugcuucaagcugcgcgacacgcuccggaagcacgaggacgccuacaagcgcgagaugaagauccgguga

SEQ ID NO: 12657 - RNA, 4326 nt, Artificial Sequence
  derived and/or modified CDS sequence (opt1) from LACV(74-32813)__D10370.1__GP
augauccgcaugcuggugcucaucgucgugaccgccgccagccccguguaccagcggugcuuccaggacggcgcgaucgucaagcagaacccguccaaggaggccgugaccgaggugugccugaaggacgacgucagcaugaucaagacggaggcccgcuacgugaagaacgccaccgggguguucuccaacaacgucgccauccggaaguggcuggugagcgacuggcacgacugccgccccaagaagaucgugggcgggcacaucaacgucaucgaggugggcgacgaccucucccugcacaccgagagcuacgugugcuccgcggacugcaccaucggggucgacaaggagacggcccaggugcggcugcagaccgacaccaccaaccacuucgagaucgccggcacgaccgucaagagcggcugguucaaguccaccaccuacaucacgcucgaccagaccugcgagcaccugaaggugagcugcgcccccaaguccgugcaguuccacgcgugcuucaaccagcacaugagcugcgugcgcuuccugcaccggaccauccuccccggguccaucgccaacagcaucugccagaacaucgagaucaucauccuggucacccugacgcuccugaucuucauccugcucuccauccugagcaagaccuacaucugcuaccugcucaugccgaucuucauccccaucgccuacauguacggcgugaucuacaacaaguccugcaagaagugcaagcugugcgggcugguguaccaccccuucaccgagugcggcacccacugcgucugcggggcccgcuacgacacgagcgaccggaugaagcuccaccgcgccuccggccugugccccggcuacaagagccugcgggcggcccgcgugaugugcaagagcaaggggccggccuccauccucagcaucaucaccgccguccuggugcugaccuucgugacccccaucaacuccaugguccucggcgagagcaaggagacguucgagcuggaggagcugcccgacgacaugcucgagauggcccugcggaucaacuccuacuacuucacgugcauccugaacuacgcggugagcugggggcucaucaucgccggccugcuggugggccucaucuucaagaaguaccagcaccgcuuccugaacaucuacgccauguacugcgaggagugcaacauguaccacgacaaguccgggcugaagcggcacggcgacuucaccaacaagugccgccagugcacgugcgggcaguacgaggacgccaccggccucaucacccaccggaagaccuacaacugccugguccaguacaaggccaaguggaugaugaacuuccugaucaucuacaucuuccucauccugaucaaggacagcgcgaucguggggcaggccaccggcaccgacuucacgaccugccuggagaccgaguccaucaacuggaacugcaccggccccuuccucaaccuggggaacugccagaagcagcagaagaaggagccguacaccaacaucgccacccagcugaagggccucaaggccaucagcgugcuggacauccccaucaucaccuccauccccgacgacaucgccggggcgcugcgcuacaucgaggagaaggaggacuuccacguccagcugaccacggaguacgccaugcucagcaaguacugcgacuacuacacccaguucuccgacaacagcggcuacucccagaccaccuggcggguguaccugcgcagccacgacuucgaggccugcauccuguaccccaaccagcacuucugcaagugcgugaagaacggggagaagugcuccagcuccaacugggacuucgccaacggcaugaagaacuacuacagcggcaagcaggcgaaguucgacaaggaccucaaccuggcccugacggcccuccaccacgccuuccgggggaccagcuccgccuacaucgcggccaugcugagcaagaaguccaacgacgaccugaucgccuacaccaacaagaucaaggccaaguucccgggcaacgcccuccugaaggcgaucaucgacuacaucgccuacaugaaggggcugcccgagauggccaacuucaaguacgacgaguucugggacgagcuccuguacaagcccaaccccgccaaggccagcaaccuggcgcgcggcaaggaguccagcuacaacuucaagcucgccaucuccagcaaguccaucaagaccugcaagaacgucaaggacguggccugccugagcccgcgcuccggggccaucuacagcuccaucaucgcgugcggcgagcccaacggccccagcguguaccggaagcccuccgggggcgucuuccagagcuccacggaccgcagcaucuacugccugcucgacagccacugccuggaggaguucgaggccaucucccaggaggagcuggacgccgugaagaaguccaagugcugggagaucgaguacccggacgugcggccccuccaggagagcgacggggccaagagcugccgcaugaaggacuccggcaacugcaacgucgccaccaaccgguggcccgugaugcagugcgagaacgacaaguucuacuacagcgagcugcagaaggacuacgacaagacccaggacaucggccacuacugccugucccccgggugcaccacgauccgcuacccgaucaaccccaagcacaucagcaacugcaacuggcaggucucccggagcuccaucgcgaagaucgacgugcacaacguggaggacaucgagcaguacaagaaggccaucacccagaagcuccagaccagccugucccuguucaaguacgccaagaccaagaaccucccccacauccgcccgaucuacaaguacaucacgaugaaggagaccgagaccgccgagggcaucgagagcgccuacaucgaguccgaggugcccgcgcuggccgggaccagcgucggcuucaagaucaacuccaaggaggggaagcaccuccuggacgugaucgccuacgucaagagcgccuccuacagcagcguguacgccaagcuguacuccacgggccccaccagcggcaucaacaccaagcacgacgagcugugcaccgggcccugcccggcgaacaucaaccaccaggugggcuggcucacguucgcccgggagcgcaccuccagcugggggugcgaggaguucggcugccuggccguguccgacgggugcgucuucggcagcugccaggacaucaucaaggaggagcuguccguguaccggaaggagaccgaggaggugaccaacgucgagcucugccugacguucagcgacaagaccuacugcaccaaccugaaccccgugacccccaucaucacggaccucuucgaggugcaguucaagaccgucgagaccuacucccugccccgcaucguggccgugcagaaccacgagaucaagaucggccagaucaacgaccugggggucuacagcaagggcugcgggaacgugcagaaggugaacggcaccgucuacgggaacggcgugccgcgguucgacuaccucugccaccuggcgucccgcaaggaggugaucguccggaagugcuucgacaacgacuaccaggccugcaaguuccugcagagccccgccuccuaccgccucgaggaggacagcggcacggugaccaucaucgacuacaagaagauccuggggaccaucaagaugaaggccauccugggcgacgugaaguacaagaccuucgccgacuccgucgacaucaccgcggaggggagcugcgccggcugcaucaacugcuuccagaacauccacugcgagcucacgcugcacaccaccaucgaggccuccugccccaucaagagcuccugcaccguguuccacgaccggauccuggugacgcccaacgagcacaaguacgcccucaagaucgucugcaccgagaagccggggaacacccugaccaucaaggugugcaacacgcgcaucgaggccagcauggcgcuggucgacgccaagcccaucaucgagcucgcccccguggaccagaccgccuacauccgggagaaggacgagcgcugcaagaccuggaugugccgcgugcgggacgagggccugcaggucauccuggagcccuucaagaaccucuucggcagcuacaucgggaucuucuacaccuucaucaucuccaucaucgcccugcuggugaucaucuacgugcuccugccgaucugcuucaagcugcgcgacacgcuccggaagcacgacgacgcguacaagcgcgagaugaagauccgguga

SEQ ID NO: 12658 - RNA, 4326 nt, Artificial Sequence
  derived and/or modified CDS sequence (opt1) from LACV(Craig County/VA/2009)__KP226848.1__GP
augauccgcauccuggugcucaucgccgucaccgccgcgagccccguguaccagcggugcuuccaggacggcgccaucgugaagcagaacccguccaaggaggccgucaccgaggugugccugaaggacgacgugagcaugaucaagacggaggcccgcuacguccggaacgccaccgggguguucuccaacaacguggcgauccgcaaguggcuggucagcgacuggcacgacugccggcccaagaagaucaucggcgggcacaucaacgugaucgaggugggcgacgaccucucccugcacaccgagagcuacgucugcuccgccgacugcaccaucgggguggacaaggagacggcccaggugcgccugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcguccgguuccugcaccgcaccauccuccccggcuccaucgccaacagcaucugccagaacaucgagaucaucauccuggugacccugacgcuccugaucuucauccugcucuccauccugagcaagaccuacaucugcuaccugcucaugccgguguucauccccaucgccugcaucuacgggaucaucuacaacaaguccugcaagaagugcaagcugugcggccuggucuaccaccccuucaccgagugcgggacccacugcgugugcggcgcccgguacgacacgagcgaccgcaugaagcuccaccgggccuccggccugugccccggguacaagagccugcgcgcggcccgggugaugugcaagagcaagggcccggccuccauccucagcaucaucaccgccguccuggugcugaccuucgucacccccaucaacuccauggugcucggggagagcaaggagacguucgagcuggaggagcugcccgacgacaugcucgagauggccucccgcaucaacagcuacuacuucacgugcauccugaacuacgcgguguccuggggccuggucaucaucggccuccugaucgggcugcuguucaagaaguaccagcaccgguuccugaacaucuacgccauguacugcgaggagugcgacauguaccacgacaagagcggccugaagcgccacggggacuucaccaacaagugccggcagugcacgugcggccaguacgaggacgccgccgggcucauggcccaccgcaagaccuacaacugccuggugcaguacaaggcgaaguggaucaugaacuuccugaucaucuacaucuuccucauccugaucaaggacuccgccaucgugguccaggccgccggcaccgacuucacgaccugccuggagaccgagagcaucaacuggaacugcaccggccccuuccucaaccuggggaacugccagaagcagcagaagaaggagccguacaccaacaucgccacccagcugaagggccucaaggcgaucuccgugcuggacauccccaucaucacggggauccccgacgacaucgccggcgcccugcgguacaucgaggagcgcgaggacuuccacgugcagcugaccaucgaguacgccaugcucagcaaguacugcgacuacuacacccaguucuccgacaacagcggguacucccagaccaccuggcgggucuaccugcgcagccacgacuucgaggcgugcauccuguaccccaaccagcacuucugccgcugcgugaagaacggcgagaagugcuccagcuccaacugggacuucgccaacggcaugaaggacuacuacagcgggaagcaggccaaguucgacaaggaccucaaccuggcccugacggcccuccaccacgcguuccggggcaccagcuccgccuacaucgccaccaugcugagcaagaaguccaacgacgaccugaucaccuacacgaacaagaucaagaccaaguucccggggaacgcccuccugaaggccaucaucgacuacaucgcguacaugaagucccugcccggcauggccaacuucaaguacgacgaguucugggacgagcuccuguacaagcccaaccccgccaaggccagcaaccuggcccgcgggaaggagagcuccuacaacuucaagcucgcgaucagcuccaagagcaucaagaccugcaagaacgugaaggacgucgccugccuguccccgcggagcggcgccaucuacgccuccaucaucgcgugcggcgagcccaacgggcccagcguguaccgcaagcccuccggcgggguguuccagagcuccaccgaccggagcaucuacugccugcucgacagccacugccuggaggaguucgaggccaucucccaggaggagcuggacgccgucaagaaguccaagugcugggagaucgaguacccggacgugaagccccuccaggagagcgacggcaccaagagcugccgcaugaaggacuccggcaacugcaacguggccaccaaccgguggcccaucauccagugcgagaacgacaaguucuacuacagcgagcugcagaaggacuacgacaagacccaggacaucgggcacuacugccugucccccggcugcaccacgguccgcuacccgaucaaccccaagcacaucagcaacugcaacuggcaggucucccggagcuccaucgccaagaucgacgugcacaacaucgaggacaucgagcaguacaagaaggcgaucacccagaagcuccagaccagccugucccuguucaaguacgccaagaccaagaaccucccccacaucaagccgaucuacaaguacaucacgaucgaggggaccgagaccgccgagggcaucgagagcgccuacaucgaguccgaggugcccgcccuggcgggggccagcaucggcuucaagaucaacuccaaggagggcaagcaccuccucgacgugaucgccuacgucaagagcgccuccuacagcagcguguacgccaagcuguacuccaccgggcccacgagcggcaucaacaccaagcacgacgagcugugcaccgggcccugcccggcgaacaucaaccaccaggugggcuggcucaccuucgcccgcgagcggacguccagcugggggugcgaggaguucggcugccuggccguguccgacggcugcgucuucgggagcugccaggacaucaucaaggaggagcuguccguguaccgcaaggagaccgaggaggugaccgacgucgagcucugccugaccuucagcgacaagacguacugcaccaaccugaaccccgugacccccaucaucaccgaccucuucgaggugcaguucaagacggucgagaccuacucccugccccggaucguggccgugcagaaccacgagaucaagaucggccagaucaacgaccugggggucuacagcaagggcugcgggaacgugcagaaggugaacggcaccgucuacggcaacggggugccgcgcuucgacuaccucugccaccuggcgucccggaaggaggugaucguccgcaagugcuucgacaacgacuaccaggccugcaaguuccugcagagccccgccuccuaccggcucgaggaggacagcggcaccgugacgaucaucgacuacaagaagauccuggggaccaucaagaugaaggccauccugggcgacgugaaguacaagaccuucgccgacuccgucgacaucaccgcggaggggagcugcaccggcugcaucaacugcuucgagaacauccacugcgagcucacgcugcacaccaccaucgaggccuccugccccaucaagagcuccugcaccguguuccacgaccgcauccuggugacgcccaacgagcacaaguacgcccucaagauggucugcaccgagaagccgggcaacacccugaccaucaaggugugcaacacgaagaucgaggccagcauggcccugguggacgcgaagcccaucaucgagcucgcccccgucgaccagaccgccuacauccgggagaaggacgagcgcugcaagaccuggaugugccgcgugcgggacgaggggcugcaggucauccuggagcccuucaagaaccucuucggcagcuacaucgggaucuucuacaccuucaucaucuccaucguggccauccuggugaucaucuacguccugcucccgaucugcuucaagcugcgcgacacgcugcggaagcacgaggacgccuacaagcgcgagaugaagauccgguga

SEQ ID NO: 12659 - RNA, 4326 nt, Artificial Sequence
  derived and/or modified CDS sequence (opt1) from LACV(Dallas/TX/2009)__GU591165.1__GP
augauccgcauccuggugcucaucgucgugaccgccgccagccccguguaccagcggugcuuccaggacggcgcgaucgucaagcagaacccguccaaggaggccgugaccgaggugugccugaaggacgacgucagcaugaucaagacggaggcccgcuacgugaagaacgccaccgggguguucuccaacaacgucgccauccggaaguggcuggugagcgacuggcacgacugccgccccaagaagaucgugggcgggcacaucaacgucaucgaggugggcgacgaccucucccugcacaccgagagcuacgugugcuccgcggacugcaccaucggggucgacaaggagacggcccaggugcggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgccugcuucaaccagcacaugagcugcgugcgcuuccugcaccggaccauccuccccggcuccaucgcgaacagcaucugccagaacaucgagaucaucauccuggucacccugacgcuccugaucuucauccugcucuccauccugagcaagaccuacaucugcuaccugcucaugccgaucuucauccccauggccuacauguacggggugaucuacaacaaguccugcaagaagugcaagcugugcggccugguguaccaccccuucaccgagugcgggacccacugcgucugcggcgcccgcuacgacacgagcgaccggaugaagcuccaccgcgccuccggccugugccccggguacaagagccugcgggccgcgcgcgugaugugcaagagcaagggcccggccuccauccucagcaucaucaccgccguccuggugcugaccuucgugacccccaucaacuccaugguccucggggagagcaaggagacguucgagcuggaggagcugcccgacgacaugcucgagauggcccugcggaucaacuccuacuacuucacgugcauccugaacuacgccgugagcuggggccucaucaucgcgggccugcugguggggcucaucuucaagaaguaccagcaccgcuuccugaacaucuacgccauguacugcgaggagugcgacauguaccacgacaaguccggccugaagcggcacggggacuucaccagcaagugccgccagugcacgugcggccaguacgaggacgccaccgggcucaucacccaccggaagaccuacaacugccugguccaguacaaggccaaguggaugaugaacuuccugaucaucuacaucuuccucauccugaucaaggacuccgccaucguggugcaggcgaccggcaccgacuucacgaccugccuggagaccgagagcaucaacuggaacugcaccggccccuuccucaaccuggggaacugccagaagcagcagaagaaggagccguacaccaacaucgccacccagcugaagggccucaaggccaucuccguccuggacauccccaucaucaccgggauccccgacgacaucgccggcgcccugcgcuacaucgaggagaaggaggacuuccacgugcagcugaccacggaguacgcgaugcucagcaaguacugcgacuacuacacccaguucuccgacaacagcggguacucccagaccaccuggcggguguaccugcgcagccacgacuucgaggccugcauccuguaccccaaccagcacuucugccggugcgucaagaacggcgagaagugcuccagcuccaacugggacuucgccaacgagaugaagaacuacuacagcggcaagcaggccaaguucgacaaggaccucaaccuggcgcugacggcccuccaccacgccuuccgcgggaccagcuccgccuacaucgccaccaugcugagcaagaaguccaacgacgaccugguggcguacaccaacaagaucaaggccaaguucccgggcaacgcccuccugaaggccaucaucgacuacaucgccuacaugaaggggcugcccgacauggcgaacuucaaguacgacgaguucugggacgagcuccuguacaagcccaaccccgccaaggccagcaaccuggcccgcggcaaggaguccagcuacaacuucaagcucgccguguccagcaaguccauccggacgugcaagaacgucaaggacguggcgugccugagcccgcgcuccggggccaucuacagcuccaucaucgccugcggcgagcccaacggccccagcguguaccggaagcccuccgggggcgucuuccagagcuccaccgaccgcagcaucuacugccugcucgacagccacugccuggaggaguucgaggccaucucccaggaggagcuggacgcggugaagaaguccaagugcugggagaucgaguacccggacauccggccccuccaggagagcgacgggagcaaguccugccgcaugaaggacagcggcaacugcaacguggccaccaaccgguggcccgucaugcagugcgagaacgacaaguucuacuacuccgagcugcagaaggacuacgacaagacccaggacaucggccacuacugccugagccccgggugcacgaccauccgcuacccgaucaaccccaagcacaucuccaacugcaacuggcaggucagccgguccagcaucgccaagaucgacgugcacaacguggaggacaucgagcaguacaagaaggccaucacccagaagcuccagaccucccugagccuguucaaguacgccaagacgaagaaccucccccacaucaagccgaucuacaaguacaucaccaucgagggcaccgagaccgcggaggggaucgaguccgccuacaucgagagcgaggugcccgcccuggccggcacguccaucggguucaagaucaacagcaaggagggcaagcaccuccuggacgugaucgccuacgucaaguccgcgagcuacagcuccguguacgccaagcuguacagcaccggccccaccuccgggaucaacaccaagcacgacgagcugugcacgggccccugcccggccaacaucaaccaccaggugggguggcucaccuucgcccgcgagcggaccagcuccuggggcugcgaggaguucgggugccuggccgucagcgacggcugcguguucggcuccugccaggacaucaucaaggaggagcugagcguguaccgcaaggacaccgaggaggucacgaacguggagcucugccugaccuucuccgacaagaccuacugcaccaaccugaaccccgugacgcccaucaucaccgaccucuucgagguccaguucaagaccguggagaccuacagccugccccggaucguggcgguccagaaccacgagaucaagaucgggcagaucaacgaccugggcguguacuccaaggggugcggcaacgugcagaaggucaacgggacgguguacggcaacggcgugccgcgcuucgacuaccucugccaccuggccagccggaaggaggucaucgugcgcaagugcuucgacaacgacuaccaggccugcaaguuccugcagucccccgccagcuaccggcucgaggaggacuccgggaccgugaccaucaucgacuacaagaagauccugggcaccaucaagaugaaggcgauccugggggacgucaaguacaagaccuucgccgacagcguggacaucacggccgagggcuccugcgccgggugcaucaacugcuucgagaacauccacugcgagcucacccugcacaccaccaucgaggccagcugccccaucaaguccagcugcacgguguuccacgaccgcauccuggucacccccaacgagcacaaguacgcgcucaagauggugugcaccgagaagccgggcaacacccugacgaucaaggucugcaacacccggaucgaggugagcauggcccugguggacgccaagcccaucaucgagcucgcccccgucgaccagaccgccuacauccgcgagaaggacgagcgcugcaagaccuggaugugccgggugcgcgacgagggccuccaggugauccuggagcccuucaagaaccuguucggguccuacaucggcaucuucuacacguucaucaucagcaucaucgcgcugcuggucaucaucuacgugcuccugccgaucugcuucaagcugcgggacacccuccgcaagcacgacgacgccuacaagcgggagaugaagauccgcuga

SEQ ID NO: 12660 - RNA, 4326 nt, Artificial Sequence
  derived and/or modified CDS sequence (opt1) from LACV(Fort Bend County/TX/2009)__GU591168.1__GP
augauccgcaugcuggugcucaucgucgugaccgccgccagccccguguaccagcggugcuuccaggacggcgcgaucgucaagcagaacccguccaaggaggccgugaccgaggugugccugaaggacgacgucagcaugaucaagacggaggcccgcuacgugaagaacgccaccgggguguucuccaacaacgucgccauccggaaguggcuggugagcgacuggcacgacugccgccccaagaagaucgugggcgggcacaucaacgucaucgaggugggcgacgaccucucccugcacaccgagagcuacgugugcuccgcggacugcaccaucggggucgacaaggagacggcccaggugcggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgccugcuucaaccagcacaugagcugcgugcgcuuccugcaccggaccauccuccccggcuccaucgcgaacagcaucugccagaacaucgagaucaucauccuggucacccugacgcuccugaucuucauccugcucuccauccugagccgcaccuacaucugcuaccugcucaugccgaucuucauccccaucgccuacauguacggggugaucuacaacaaguccugcaagaagugcaagcugugcggccugguguaccaccccuucaccgagugcgggacccacugcgucugcggcgcccgguacgacacgagcgaccgcaugaagcuccaccgggccuccggccugugccccggguacaagagccugcgcgccgcgcgggugaugugcaagagcaagggcccggccuccauccucagcaucaucaccgccguccuggugcugaccuucgugacccccaucaacuccaugguccucggggagagcaaggagacguucgagcuggaggagcugcccgacgacaugcucgagauggcccugcgcaucaacuccuacuacuucacgugcauccugaacuacgccgugagcuggggccucaucaucgcgggccugcugguggggcucaucuucaagaaguaccagcaccgguuccugaacaucuacgccauguacugcgaggagugcgacauguaccacgacaaguccggccugaagcgccacggggacuucaccaacaagugccggcagugcacgugcggccaguacgaggacgccgccgggcucauggcccaccgcaagaccuacaacugccugguccaguacaaggcgaaguggaugaugaacuuccugaucaucuacaucuuccucauccugaucaaggacagcgccaucguggugcaggccaccggcaccgacuucacgaccugccuggagaccgaguccaucaacuggaacugcaccggccccuuccucaaccuggggaacugccagaagcagcagaagaaggagccguacaccaacaucgccacccagcugaagggccucaaggccaucagcguccuggacauccccaucaucaccgggauccccgacgacaucgcgggcgcccugcgguacaucgaggagaaggaggacuuccacauccagcugaccaccgaguacgccaugcucuccaaguacugcgacuacuacacccaguucagcgacaacuccggguacagccagacgaccuggcgcguguaccugcggucccacgacuucgaggccugcauccuguaccccaaccagcacuucugccgcugcgugaagaacggcgagaagugcagcuccagcaacugggacuucgcgaacgagaugaagaacuacuacuccggcaagcaggccaaguucgacaaggaccucaaccuggcccugaccgcccuccaccacgccuuccgcgggaccagcagcgcguacaucgccacgaugcuguccaagaaguccaacgacgaccugaucgccuacaccaacaagaucaaggccaaguucccgggcaacgcccuccugaaggcgaucaucgacuacaucgccuacaugaaggggcugcccgacauggccaacuucaaguacgacgaguucugggacgagcuccuguacaagcccaaccccgccaaggccagcaaccuggcgcggggcaaggagagcuccuacaacuucaagcucgccaucagcuccaagagcaucaagaccugcaagaacgucaaggacguggccugccuguccccgcgcagcggggccaucuacuccagcaucaucgcgugcggcgagcccaacggccccuccguguaccggaagcccagcgggggcgucuuccaguccagcaccgaccgcuccaucuacugccugcucgacagccacugccuggaggaguucgaggccaucagccaggaggagcuggacgccgugaagaaguccaagugcugggagaucgaguacccggacgugcggccccuccaggagagcgacggggccaaguccugccgcaugaaggacagcggcaacugcaacgucgccacgaaccgguggcccgugaugcagugcgagaacgacaaguucuacuacuccgagcugcagaaggacuacgacaagacccaggacaucggccacuacugccugagccccgggugcaccaccauccgcuacccgaucaaccccaagcacaucuccaacugcaacuggcaggucagccgguccagcaucgcgaagaucgacgugcacaacguggaggacaucgagcaguacaagaaggccaucacgcagaagcuccagaccucccugagccuguucaaguacgccaagaccaagaaccucccccacaucaagccgaucuacaaguacaucaccaucgagggcacggagaccgccgaggggaucgaguccgccuacaucgagagcgaggugcccgcgcuggccggcaccuccaucggguucaagaucaacagcaaggagggcaagcaccuccuggacgucaucgccuacgugaaguccgccagcuacuccagcguguacgccaagcuguacagcaccggccccacguccgggaucaacaccaagcacgacgagcugugcaccggccccugcccggcgaacaucaaccaccaggucggguggcucaccuucgcccgcgagcggacgagcuccuggggcugcgaggaguucgggugccuggccgugagcgacggcugcguguucggcuccugccaggacaucaucaaggaggagcugagcgucuaccgcaaggagaccgaggaggugaccaacguggagcucugccugaccuucuccgacaagacguacugcaccagccugaaccccgucacccccaucaucaccgaccucuucgaggugcaguucaagacgguggagaccuacucccugccccggaucgucgccgugcagaaccacgagaucaagaucgggcagaucaacgaccugggcguguacagcaaggggugcggcaacguccagaaggugaacgggaccguguacggcaacggcgucccgcgcuucgacuaccucugccaccuggcgucccggaaggaggugaucgugcgcaagugcuucgacaacgacuaccaggccugcaaguuccugcagagccccgccuccuaccggcucgaggaggacagcgggaccgucacgaucaucgacuacaagaagauccugggcaccaucaagaugaaggccauccugggggacgugaaguacaagaccuucgccgacuccguggacaucaccgcggagggcagcugcgccgggugcaucaacugcuucgagaacauccacugcgagcucacccugcacacgaccaucgaggccuccugccccaucaagagcuccugcaccgucuuccacgaccgcauccuggugacccccaacgagcacaaguacgcccucaagauggugugcacggagaagccgggcaacacccugaccaucaaggucugcaacacccggaucgaggccagcauggcgcugguggacgccaagcccaucaucgagcucgcccccgucgaccagacggccuacauccgcgagaaggacgagcgcugcaagaccuggaugugccgggugcgcgacgagggccuccaggugauccuggagcccuucaagaaccuguucgggagcuacaucggcaucuucuacaccuucaucaucuccaucaucgcccugcuggucaucaucuacgugcuccugccgaucugcuucaagcugcgggacacccuccgcaagcacgacgacgcguacaagcgggagaugaagauccgcuga

SEQ ID NO: 12661 - RNA, 4326 nt, Artificial Sequence
  derived and/or modified CDS sequence (opt1) from LACV(LAC22988-89)__U18980.1__GP
augaucugcauccuggugcucaucaccgucgccgccgcgagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacccccaucaacuccauggugcucggggagagcaaggagacguucgagcuggaggaccugcccgacgacaugcucgagauggccucccggaucaacagcuacuaccugaccugcauccugaacuacgcgguguccuggggccucgucaucaucggccugcugaucgggcuccuguucaagaaguaccagcaccgcuuccugaacguguacgccauguacugcgaggagugcgacauguaccacgacaagagcggccucaagcggcacggggacuucaccaacaagugccgccagugcacgugcggccaguacgaggacgccgccgggcugauggcccaccggaagaccuacaacugccuggugcaguacaaggcgaaguggaugaugaacuuccucaucaucuacaucuuccugauccugaucaaggacuccgccaucgucgugcaggccgccggcaccgacuucacgaccugccucgagaccgagagcaucaacuggaacugcaccggccccuuccugaaccuggggaacugccagaagcagcagaagaaggagccguacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacaacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaucugcaagaacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccacgaaccgguggcccgugauccagugcgagaacgacaaguucuacuacagcgagcugcagaaggacuacgacaaggcccaggacaucggccacuacugccucucccccgggugcaccaccguccgcuaccccaucaacccgaagcacaucagcaacugcaacuggcaggucucccggagcuccaucgcgaagaucgacgugcacaacaucgaggacaucgagcaguacaagaaggccaucacccagaagcugcagacgagccugucccucuucaaguacgccaagaccaagaaccugccccacaucaagcccaucuacaaguacaucaccaucgagggcaccgagacggccgaggggaucgagagcgccuacaucgaguccgaggugccggcgcuggccggcaccagcaucggcuucaagaucaacuccaaggaggggaagcaccuccuggacgugaucgccuacgucaagagcgccuccuacagcuccguguacaccaagcuguacagcaccggccccacgagcgggaucaacaccaagcacgacgagcucugcaccggccccugccccgccaacaucaaccaccaggugggguggcugaccuucgcgcgcgagcggacguccagcuggggcugcgaggaguucggcugccuggccguguccgacgggugcgucuucggcagcugccaggacaucaucaaggaggagcucuccguguaccgcaaggagaccgaggaggugaccgacgucgagcugugccugaccuucagcgacaagacguacugcaccaaccucaacccggugacccccaucaucaccgaccuguucgaggugcaguucaagacggucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggaccgucacgaucaucgacuacaagaagauccugggcaccaucaagaugaaggccauccucggggacgugaaguacaagaccuucgccgacuccguggacaucaccgccgagggcagcugcaccggcugcaucaacugcuucgagaacauccacugcgagcugacgcugcacaccaccaucgaggcguccugccccaucaagagcuccugcaccgucuuccacgaccgcauccucgugacgcccaacgagcacaaguacgcccugaagauggugugcaccgagaagcccgggaacacccugaccaucaaggucugcaacacgaagguggaggccagcauggcccucgucgacgccaagccgaucaucgagcuggcgcccguggaccagaccgccuacauccgggagaaggacgagcgcugcaagaccuggaugugccgggugcgcgacgagggccugcaggucauccucgagcccuucaagaaccuguucggguccuacaucggcaucuucuacaccuucaucaucagcaucguggugcugcucgucaucaucuacgugcugcugcccaucugcuucaagcuccgcgacacgcugcggaagcacgaggacgccuacaagcgcgagaugaagauccgguga

SEQ ID NO: 12662 - RNA, 4326 nt, Artificial Sequence
  derived and/or modified CDS sequence (opt1) from LACV(LAC30928-31)__U18979.1__GP
augaucugcauccuggugcucaucaccgucgccgccgcgagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaccaucuacaacaaguccugcaagaagugcaagcugugcggccuggucuaccaccccuucaccgagugcgggacgcacugcgugugcggcgcccgcuacgacaccagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacgcccaucaacuccauggugcucggggagagcaaggagaccuucgagcuggaggaccugcccgacgacaugcucgagauggccucccggaucaacagcuacuaccugaccugcauccugaacuacgcgguguccuggggccucgucaucaucggccugcugaucgggcuccuguucaagaaguaccagcaccgcuuccugaacguguacgccauguacugcgaggagugcgacauguaccacgacaagagcggccucaagcggcacggggacuucaccaacaagugccgccagugcacgugcggccaguacgaggacgccgccgggcugauggcccaccggaagaccuacaacugccuggugcaguacaaggcgaaguggaugaugaacuuccucaucaucuacaucuuccugauccugaucaaggacuccgccaucgucgugcaggccgccggcaccgacuucaccacgugccucgagaccgagagcaucaacuggaacugcaccggccccuuccugaaccuggggaacugccagaagcagcagaagaaggagccguacaccaacaucgccacgcagcucaagggccugaaggcgaucuccgugcuggacguccccaucaucaccgggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccacguggcggguguaccugcgcagccacgacuucgaggcgugcauccucuaccccaaccagcacuucugccggugcgucaagaacggcgagaagugcuccagcuccaaccgcgacuucgccaacgagaugaaggacuacuacagcggcaagcagaccaaguucgacaaggaccugaaccuggcccucaccgcccugcaccacgccuuccgcgggaccagcuccgcguacaucgccacgaugcugagcaagaaguccaacgacgaccucaucgccuacaccaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccggggcaaggagagcuccuacaacuucaagcuggcgaucagcuccaagagcaucaagaucugcaagaacgugaaggacguggccugccuguccccgcgcagcggggccaucuacgccuccaucaucgcgugcggcgagcccaacggccccagcgucuaccggaagcccuccgggggcguguuccagagcuccaccgacccgagcaucuacugccuccuggacagccacugccuggaggaguucgaggccaucgggcaggaggagcucgacgccgugaagaaguccaagugcugggagaucgaguaccccgacgucaagcugauccaggagggcgacggcaccaagagcugccgcaugaaggacuccgggaacugcaacguggccacgaaccgguggcccgugauccagugcgagaacgacaaguucuacuacagcgagcugcagaaggacuacgacaagacccaggacaucggccacuacugccucucccccgggugcaccacgguccgcuacccgaucaaccccaagcacaucagcaacugcaacuggcaggucucccggagcuccaucgccaagaucgacgugcacaacaucgaggacaucgagcaguacaagaaggcgaucacccagaagcugcagaccagccugucccucuucaaguacgccaagaccaagaaccugccccacaucaagccgaucuacaaguacaucacgaucgagggcaccgagaccgccgaggggaucgagagcgccuacaucgaguccgaggugcccgcccuggcgggcaccagcaucggcuucaagaucaacuccaaggaggggaagcaccuccuggacgugaucgccuacgucaagagcgccuccuacagcuccguguacacgaagcuguacagcaccggccccaccagcgggaucaacaccaagcacgacgagcucugcacgggccccugcccggccaacaucaaccaccaggugggguggcugaccuucgcccgcgagcggaccuccagcuggggcugcgaggaguucggcugccuggcgguguccgacgggugcgucuucggcagcugccaggacaucaucaaggaggagcucuccguguaccgcaaggagaccgaggaggugacggacgucgagcugugccugaccuucagcgacaagaccuacugcaccaaccucaaccccgugacgcccaucaucaccgaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcacgaucuacgggaacggcgucccgcgcuucgacuaccugugccaccuggccucccggaaggaggugaucgugcgcaagugcuucgacaacgacuaccaggccugcaaguuccuccagagccccgcguccuaccggcuggaggaggacagcgggaccgucaccaucaucgacuacaagaagauccugggcaccaucaagaugaaggccauccucggggacgugaaguacaagaccuucgccgacuccguggacaucacggccgagggcagcugcaccggcugcaucaacugcuucgagaacauccacugcgagcugacccugcacaccacgaucgaggccuccugccccaucaagagcuccugcaccgucuuccacgaccgcauccucgugacccccaacgagcacaaguacgcgcugaagauggugugcaccgagaagccggggaacacgcugaccaucaaggucugcaacaccaagaucgaggccagcauggcccucguggacgccaagcccaucaucgagcuggcccccgucgaccagaccgcguacauccgggagaaggacgagcgcugcaagacguggaugugccgggugcgcgacgagggccuccaggugauccuggagcccuucaagaaccuguucggguccuacaucggcaucuucuacaccuucaucaucagcaucgucgcccugcucgugaucaucuacgugcugcugccgaucugcuucaagcuccgcgacacccugcggaagcacgaggacgccuacaagcgcgagaugaagauccgguga

SEQ ID NO: 12663 - RNA, 4326 nt, Artificial Sequence
  derived and/or modified CDS sequence (opt1) from LACV(LAC76-40)__U70206.1__GP
augaucugcauccuggugcucaucaccgucgccgccgcgagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacccccaucaacuccauggugcucggggagagcaaggagacguucgagcuggaggaccugcccgacgacaugcucgagauggccucccggaucaacagcuacuaccugaccugcauccugaacuacgcgguguccuggggccucgucaucaucggccugcugaucgggcuccuguucaagaaguaccagcaccgcuuccugaacguguacgccauguacugcgaggagugcgacauguaccacgacaagagcggccucaagcggcacggggacuucaccaacaagugccgccagugcacgugcggccaguacgaggacgccgccgggcugauggcccaccggaagacguacaacugccuggugcaguacaaggcgaaguggaugaugaacuuccucaucaucuacaucuuccugauccugaucaaggacuccgccaucgucgugcaggccgccggcaccgacuucacgaccugccucgagaccgagagcaucaacuggaacugcaccggccccuuccugaaccuggggaacugccagaagcagcagaagaaggagccguacaccaacaucgccacccagcucaagggccugaaggcgaucuccgugcuggacguccccaucaucacggggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacaucgccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaaggacgugaaggacguggccugccuguccccgcggagcggggccaucuacgccuccaucaucgcgugcggcgagcccaacggccccagcgucuaccgcaagcccuccgggggcguguuccagagcuccaccgaccggagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaagacccaggacaucggccacuacugccucucccccgggugcaccacgguccgcuaccccaucaacccgaagcacaucagcaacugcaacuggcaggucucccggagcuccaucgccaagaucgacgugcacaacaucgaggacaucgagcaguacaagaaggcgaucacccagaagcugcagaccagccugucccucuucaaguacgccaagaccaagaaccugccccacaucaagcccaucuacaaguacaucacgaucgagggcaccgagaccgccgaggggaucgagagcgccuacaucgaguccgaggugccggcccuggcgggcaccagcaucggcuucaagaucaacuccaaggaggggaagcaccuccuggacgugaucgccuacgucaagagcgccuccuacagcuccguguacgccaagcuguacagcacgggccccaccagcgggaucaacaccaagcacgacgagcucugcaccggccccugccccgccaacaucaaccaccaggugggguggcugacguucgcgcgcgagcggaccuccagcuggggcugcgaggaguucggcugccuggccguguccgacgggugcgucuucggcagcugccaggacaucaucaaggaggagcucuccguguaccgcaaggagaccgaggaggugaccgacgucgagcugugccugacguucagcgacaagaccuacugcaccaaccucaacccggugacccccaucaucacggaccuguucgaggugcaguucaagaccgucgagaccuacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggcgugcaaguuccuccagagcccggccuccuaccggcuggaggaggacagcgggacggucaccaucaucgacuacaagaagauccugggcaccaucaagaugaaggccauccucggggacgugaaguacaagaccuucgccgacuccguggacaucaccgccgagggcagcugcacgggcugcaucaacugcuucgagaacauccacugcgagcugacccugcacaccaccaucgaggcguccugccccaucaagagcuccugcacggucuuccacgaccgcauccucgugacccccaacgagcacaaguacgcccugaagauggugugcaccgagaagcccgggaacacccugacgaucaaggucugcaacaccaagaucgaggccagcauggcccucguggacgccaagccgaucaucgagcuggcgcccgucgaccagaccgccuacauccgggagaaggacgagcgcugcaagaccuggaugugccgggugcgcgacgagggccuccaggugauccuggagcccuucaagaaccuguucggguccuacaucggcaucuucuacacguucaucaucagcaucgucgcccugcucgugaucaucuacgugcugcugcccaucugcuucaagcuccgcgacacccugcggaagcacgaggacgccuacaagcgcgagaugaagauccgguga

SEQ ID NO: 12664 - RNA, 4326 nt, Artificial Sequence
  derived and/or modified CDS sequence (opt1) from LACV(LAC79-283)__U70207.1__GP
augauccgcauccuggugcucaucgccgucaccgccgcgagccccguguaccagcggugcuuccaggacggcgccaucgugaagcagaacccguccaaggaggccgucaccgaggugugccugaaggacgacgugagcaugaucaagacggaggcccgcuacauccggaacgccaccggggucuucuccaacaacguggcgauccgcaaguggcuggugagcgacuggcacgacugccggcccaagcgcaucaucggcgggcacaucaacgucaucgaggugggcgacgaccucucccugcacaccgagagcuacgugugcuccgccgacugcaccaucggggucgacaaggagacggcccaggugcggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggucacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccugguguaccaccccuucaccgagugcgggacccacugcgugugcggcgcccgcuacgacacgagcgaccggaugaagcuccaccgcgccuccggccugugccccggguacaagagccugcgggcggcccgcgucaugugcaagagcaagggcccggccuccauccucagcaucaucaccgccgugcuggugcugaccuucgucacccccaucaacuccauggugcucggggagagcaaggagacguucgagcuggaggagcugcccgacgacaugcucggcauggccucccggaucaacagcuacuacuucacgugcauccugaacuacgcggucuccuggggccuggugaucaucgggcuccugaccggccuccuguucaagaaguaccagcaccgcuuccugaacguguacgccauguacugcgaggagugcgacauguaccacgacaagagcgggcugaagcggcacggcgacuucaccaacaagugccgccagugcacgugcgggcaguacgaggacgccaccggccucauggcccaccggaagaccuacaacugccugguccaguacaaggccaaguggaugaugaacuuccuggugaucuacaucuuccucauccugaucaaggacuccgcgaucgugguccaggccgccggcaccgacuucacgaccugccuggagaccgagagcaucaacuggaacugcaccgggcccuuccucaaccugggcaacugccagaagcagcagaagaaggagccguacaccaacaucgccacccagcugaaggggcucaaggccaucuccgugcuggacauccccaucaucaccggcauccccgacgacaucgcgggggcccugcgcuacaucgaggagcgggaggacuuccacgugcagcugaccaucgaguacgccaugcucagcaaguacugcgacuacuacacccaguucuccgacaacagcggcuacucccagacgaccuggcgcgucuaccugcgcagccacgacuucgaggccugcauccuguaccccaaccagcacuucugccggugcgugaagaacggcgagaagugcuccagcuccaacugggacuucgcgaacgagaugaaggacuucuacagcgggaagcagaccaaguucgacaaggaccucaaccuggcccugaccgcccuccaccacgccuuccgcggcacgagcuccgccuacaucgcgaccaugcugagcaagaaguccaacgacgaccugaucgccuacaccaacaagaucaagaccaaguucccggggaacgcccuccugaaggccaucaucgacuacaucgccuacaugaagucccugcccggcauggcgaacuucaagcacgacgaguucugggacgagcuccuguacaagcccaaccccgccaaggccagcaaccuggcccgggggaaggagagcuccuacaacuucaagcucgccaucagcuccaagagcaucaagacgugcaagaacgugaaggacgucgcgugccuguccccgcgcagcggcgccaucuacgccuccaucaucgccugcggcgagcccaacgggcccagcguguaccggaagcccuccggcgggguguuccagagcuccaccgaccgcagcaucuacugccugcucgacagccacugccuggaggaguucgaggcgaucucccaggaggagcuggacgccgucaagaaguccaagugcugggagaucgaguacccggacgugaagccccuccaggagggcgacggcaccaagagcugccggaugaaggacagcgggaacugcaacguggccaccaaccgcuggcccgucauccagugcgagaacgacaaguucuacuacuccgagcugcagaaggacuacgacaagacgcaggacaucggccacuacugccugagccccgggugcaccaccgugcgguacccgaucaaccccaagcacaucuccaacugcaacuggcaggucagccgcuccagcaucgccaagaucgacgugcacaacaucgaggacaucgagcaguacaagaaggccaucacccagaagcuccagacgucccugagccuguucaaguacgcgaagaccaagaaccucccccacaucaagccgaucuacaaguacaucaccaucgagggcaccgagacggccgaggggaucgaguccgccuacaucgagagcgaggugcccgcccuggccggcaccuccaucggcuucaagaucaacagcaaggaggggaagcaccuccuggacgugaucgcguacgucaaguccgccagcuacuccagcguguacgccaagcuguacagcaccggccccaccuccgggaucaacacgaagcacgacgagcugugcaccggccccugcccggccaacaucaaccaccaggugggguggcucaccuucgcccgggagcgcaccagcuccuggggcugcgaggaguucggcugccuggcggucagcgacgggugcguguucggcuccugccaggacaucaucaaggaggagcugagcguguaccggaaggagacggaggaggucaccgacguggagcucugccugaccuucuccgacaagaccuacugcacgaaccugaaccccgugacccccaucaucaccgaccucuucgagguccaguucaacaccguggagacguacagccugccccgcaucguggccguccagaaccacgagaucaagaucgggcagaucaacgaccugggcguguacuccaaggggugcggcaacgugcagaaggucaacggcaccguguacgggaacggcgugccgcgguucgacuaccucugccaccuggccagccgcaaggaggucaucgugcggaagugcuucgacaacgacuaccaggccugcaaguuccugcagucccccgcgagcuaccgccucgaggaggacuccgggaccgugaccaucaucgacuacaagaagauccugggcaccaucaagaugaaggccauccugggggacgucaaguacaagacguucgccgacagcguggacaucaccgccgagggcuccugcaccggcugcaucaacugcuucgagaacauccacugcgagcucacccugcacacgaccaucgaggccagcugccccaucaaguccagcugcaccguguuccacgaccggauccuggucacccccaacgagccgcaguacgcgcucaagauggugugcacggagcgccccgggaacacccugaccaucaaggugugcaacaccaagaucgaggccuccauggcccuggucgacgccaagcccaucaucgagcucgcccccguggaccagacggcguacauccgcgagaaggacgagcggugcaagaccuggaugugccgcguccgggacgagggccuccaggugauccuggagccguucaagaaccuguucgggagcuacaucggcaucuucuacaccuucaucaucagcaugguggcccugcuggucaucaucuacgugcuccugcccaucugcuucaagcugcgcgacacccuccggaagcacgaggacgccuacaagcgcgagaugaagauccgguga

SEQ ID NO: 12665 - RNA, 4326 nt, Artificial Sequence
  derived and/or modified CDS sequence (opt1) from LACV(LAC81-4)__U70208.1__GP
augauccgcauccuggugcucaucgccgucaccgccgcgagccccguguaccagcggugcuuccaggacggcgccaucgugaagcagaacccguccaaggaggccgucaccgaggugugccugaaggacgacgugagcaugaucaagacggaggcccgcuacauccggaacgccaccggggucuucuccaacaacguggcgauccgcaaguggcuggugagcgacuggcacgacugccggcccaagaagaucaucggcgggcacaucaacgucaucgaggugggcgacgaccucucccugcacaccgagagcuacgugugcuccgccgacugcaccaucggggucgacaaggagacggcccaggugcgccugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgguuccugcaccgcaccauccuccccggcuccaucgccaacagcaucugccagaacaucgagaucaucauccuggucacccugacgcuccugaucuucauccugcucuccauccugagcaagaccuacaucugcuaccugcucaugccgaucuucauccccaucgccuacguguacgggaucaucuacaacaaguccugcaagaagugcaagcugugcggccugguguaccaccccuucaccgagugcgggacccacugcgucugcggcgcccgguacgacacgagcgaccgcaugaagcuccaccgggccuccggccugugccccggguacaagagccugcgcgcggcccgggugaugugcaagagcaagggcccggccuccauccucagcaucaucaccgccgugcugguccugaccuucgugacccccaucaacuccaugguccucggggagagcaaggagacguucgagcuggaggagcugcccgacgacaugcucggcauggccucccgcaucaacagcuacuacuucacgugcauccugaacuacgcgguguccuggggccuggugaucaucgggcuccugaccggccuccuguucaagaaguaccagcaccgguuccugaacgucuacgccauguacugcgaggagugcgacauguaccacgacaagagcgggcugaagcgccacggcgacuucaccaacaagugccggcagugcacgugcgggcaguacgaggacgccaccggccucauggcccaccgcaagaccuacaacugccuggugcaguacaaggccaaguggaugaugaacuuccuggugaucuacaucuuccucauccugaucaaggacuccgcgaucgucgugcaggccgccggcaccgacuucacgaccugccuggagaccgagagcaucaacuggaacugcaccgggcccuuccucaaccugggcaacugccagaagcagcagaagaaggagccguacaccaacaucgccacccagcugaaggggcucaaggccaucuccgugcuggacauccccaucaucaccggcauccccgacgacaucgcgggggcccugcgguacaucgaggagcgcgaggacuuccacguccagcugaccaucgaguacgccaugcucagcaaguacugcgacuacuacacccaguucuccgacaacagcggcuacucccagacgaccuggcggguguaccugcgcagccacgacuucgaggccugcauccuguaccccaaccagcacuucugccgcugcgugaagaacggcgagaagugcuccagcuccaacugggacuucgcgaacgagaugaaggacuucuacagcgggaagcagaccaaguucgacaaggaccucaaccuggcccugaccgcccuccaccacgccuuccggggcacgagcuccgccuacaucgcgaccaugcugagcaagaaguccaacgacgaccugaucgccuacaccaacaagaucaagaccaaguucccggggaacgcccuccugaaggccaucaucgacuacaucgccuacaugaagucccugcccggcauggcgaacuucaagcacgacgaguucugggacgagcuccuguacaagcccaaccccgccaaggccagcaaccuggcccgcgggaaggagagcuccuacaacuucaagcucgccaucagcuccaagagcaucaagacgugcaagaacgucaaggacguggcgugccuguccccgcggagcggcgccaucuacgccuccaucaucgccugcggcgagcccaacgggcccagcguguaccgcaagcccuccggcggggucuuccagagcuccaccgaccggagcaucuacugccugcucgacagccacugccuggaggaguucgaggcgaucucccaggaggagcuggacgccgugaagaaguccaagugcugggagaucgaguacccggacgugaagccccuccaggagggcgacggcaccaagagcugccgcaugaaggacagcgggaacugcaacgucgccaccaaccgguggcccgugauccagugcgagaacgacaaguucuacuacuccgagcugcagaaggacuacgacaagacgcaggacaucggccacuacugccugagccccgggugcaccaccgugcgcuacccgaucaaccccaagcacaucuccaacugcaacuggcaggucagccgguccagcaucgccaagaucgacgugcacaacaucgaggacaucgagcaguacaagaaggccaucacccagaagcuccagacgucccugagccuguucaaguacgcgaagaccaagaaccucccccacaucaagccgaucuacaaguacaucaccaucgagggcaccgagacggccgaggggaucgaguccgccuacaucgagagcgaggugcccgcccuggccggcaccuccaucggcuucaagaucaacagcaaggaggggaagcaccuccuggacgucaucgcguacgugaaguccgccagcuacuccagcguguacgccaagcuguacagcaccggccccaccuccgggaucaacacgaagcacgacgagcugugcaccggccccugcccggccaacaucaaccaccaggucggguggcucaccuucgcccgcgagcggaccagcuccuggggcugcgaggaguucggcugccuggcggugagcgacgggugcguguucggcuccugccaggacaucaucaaggaggagcugagcgucuaccgcaaggagacggaggaggugaccgacguggagcucugccugaccuucuccgacaagaccuacugcacgaaccugaaccccgucacccccaucaucaccgaccucuucgaggugcaguucaagaccguggagacguacagccugccccggaucgucgccgugcagaaccacgagaucaagaucgggcagaucaacgaccugggcguguacuccaaggggugcggcaacguccagaaggugaacggcaccguguacgggaacggcgucccgcgcuucgacuaccucugccaccuggccagccggaaggaggugaucgugcgcaagugcuucgacaacgacuaccaggccugcaaguuccugcagucccccgcgagcuaccggcucgaggaggacuccgggaccgucaccaucaucgacuacaagaagauccugggcaccaucaagaugaaggccauccugggggacgugaaguacaagacguucgccgacagcguggacaucaccgccgagggcuccugcaccggcugcaucaacugcuucgagaacauccacugcgagcucacccugcacacgaccaucgaggccagcugccccaucaaguccagcugcaccgucuuccacgaccgcauccuggugacccccaacgagccgcaguacgcgcucaagauggugugcacggagcggcccgggaacacccugaccaucaaggucugcaacaccaagaucgaggccuccauggcccugguggacgccaagcccaucaucgagcucgcccccgucgaccagacggcguacauccgcgagaaggacgagcgcugcaagaccuggaugugccgggugcgcgacgagggccuccaggugauccuggagccguucaagaaccuguucgggagcuacaucggcaucuucuacaccuucaucaucagcauggucgcccugcuggugaucaucuacgugcuccugcccaucugcuucaagcugcgggacacccuccgcaagcacgaggacgccuacaagcgggagaugaagauccgcuga

SEQ ID NO: 12666 - RNA, 4326 nt, Artificial Sequence
  derived and/or modified CDS sequence (opt1) from LACV(LACR56869)__U70205.1__GP
augaucugcauccuggugcucaucaccgucgccgccgcgagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacccccaucaacuccauggugcucggggagagcaaggagacguucgagcuggaggaccugcccgacgacaugcucgagauggccucccggaucaacagcuacuaccugaccugcauccugaacuacgcgguguccuggggccucgucaucaucggccugcugaucgggcuccuguucaagaaguaccagcaccgcuuccugaacaucuacgccauguacugcgaggagugcgacauguaccacgacaagagcggccucaagcggcacggggacuucaccaacaagugccgccagugcacgugcggccaguacgaggacgccgccgggcugauggcccaccggaagacguacaacugccuggugcaguacaaggcgaaguggaugaugaacuuccucaucaucuacaucuuccugauccugaucaaggacuccgccaucgugguccaggccgccggcaccgacuucacgaccugccucgagaccgagagcaucaacuggaacugcaccggccccuuccugaaccuggggaacugccagaagcagcagaagaaggagccguacaccaacaucgccacccagcucaagggccugaaggcgaucuccgugcuggacgugcccaucaucacggggauccccgacgacaucgccggcgcccugcgcuacaucgaggagaaggaggacuuccacguccagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgugaagaacggcgagaagugcuccagcuccaacugggacuucgccaacgagaugaaggacuacuacagcggcaagcagacgaaguucgacaaggaccugaaccuggcccucaccgcccugcaccacgccuuccgcgggaccagcuccgcguacauggccaccaugcugagcaagaaguccaacgacgaccucaucgccuacacgaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgucaaggacguggccugccuguccccgcggagcggggccaucuacgccuccaucaucgcgugcggcgagcccaacggccccagcguguaccgcaagcccuccgggggcgucuuccagagcuccaccgaccggagcaucuacugccuccuggacagccacugccuggaggaguucgaggccaucgggcaggaggagcucgacgccgugaagaaguccaagugcugggagaucgaguacccggacgugaagcugauccaggagggcgacggcaccaagagcugccgcaugaaggacuccgggaacugcaacgucgccaccaaccgguggcccgugauccagugcgagaacgacaaguucuacuacagcgagcugcagaaggacuacgacaagacccaggacaucggccacuacugccucucccccgggugcaccacggugcgcuaccccaucaacccgaagcacaucagcaacugcaacuggcaggucucccggagcuccaucgccaagaucgacgugcacaacaucgaggacaucgagcaguacaagaaggcgaucacccagaagcugcagaccagccugucccucuucaaguacgccaagaccaagaaccugccccacaucaagcccaucuacaaguacaucacgaucgagggcaccgagaccgccgaggggaucgagagcgccuacaucgaguccgaggugccggcccuggcgggcaccagcaucggcuucaagaucaacuccaaggaggggaagcaccuccuggacgucaucgccuacgucaagagcgccuccuacagcuccguguacacgaagcuguacagcaccggccccaccagcgggaucaacaccaagcacgacgagcucugcacgggccccugccccgccaacaucaaccaccaggacggguggcugaccuucgcccgcgagcggaccuccagcuggggcugcgaggaguucggcugccuggcgguguccgacgggugcguguucggcagcugccaggacaucaucaaggaggagcucuccguguaccgcaaggagaccgaggaggucacggacguggagcugugccugaccuucagcgacaagaccuacugcaccaaccucaacccggugacgcccaucaucaccgaccuguucgagguccaguucaagaccguggagaccuacucccugccccggaucguggccguccagaaccacgagaucaagaucgggcagaucaacgaccucggcguguacagcaaggggugcggcaacgugcagaaggucaacggcacgaucuacgggaacggcgugccccgcuucgacuaccugugccaccuggccucccggaaggaggugaucguccgcaagugcuucgacaacgacuaccaggccugcaaguuccuccagagcccggcguccuaccggcuggaggaggacagcgggaccgugaccaucaucgacuacaagaagauccugggcaccaucaagaugaaggccauccucggggacgugaaguacaagaccuucgccgacuccgucgacaucacggccgagggcagcugcaccggcugcaucaacugcuucgagaacauccacugcgagcugacccugcacaccacgaucgaggccuccugccccaucaagagcuccugcaccguguuccacgaccgcauccucgugacccccaacgagcacaaguacgcgcugaagauggucugcaccgagaagcccgggaacacgcugaccaucgaggugugcaacaccaagaucgaggccagcauggcccucguggacgccaagccgaucaucgagcuggcccccgucgaccagaccacguacauccgggagaaggacgagcgcugcaagaccuggaugugccgggugcgcgacgagggccugcaggucauccucgagcccuucaagaaccuguucggguccuacaucggcaucuucuacaccuucaucaucagcaucguggcgcugcucgugaucaucuacguccugcugcccaucugcuucaagcuccgcgacacccugcggaagcacgaggacgccuacaagcgcgagaugaagauccgguga

SEQ ID NO: 12667 - RNA, 4326 nt, Artificial Sequence
  derived and/or modified CDS sequence (opt1) from LACV(NAT_Crawford_WI_2007)__GU596383.1__GP
augauccgcauccuggugcucaucgccgucaccgccgcgagccccguguaccagcggugcuuccaggacggcgccaucgugaagcagaacccguccaaggaggccgucaccgaggugugccugaaggacgacgugagcaugaucaagacggaggcccgcuacguccggaacgccaccgggguguucuccaacaacguggcgauccgcaaguggcuggucagcgacuggcacgacugccggcccaagaagaucaucggcgggcacaucaacgugaucgaggugggcgacgaccucucccugcacaccgagagcuacgucugcuccgccgacugcaccaucgggguggacaaggagacggcccaggugcgccugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcguccgguuccugcaccgcaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacguguacgggaucaucuacaacaaguccugcaagaagugcaagcugugcggccuggucuaccaccccuucaccgagugcgggacccacugcgugugcggcgcccgguacgacacgagcgaccgcaugaagcuccaccgggccuccggccugugccccggguacaagagccugcgcgcggcccgggugaugugcaagagcaagggcccggccuccauccucagcaucaucaccgccguccuggugcugaccuucgucacccccaucaacuccauggugcucggggagagcaaggagacguucgagcuggaggagcugcccgacgacaugcucgagauggccucccgcaucaacagcuacuacuucacgugcauccugaacuacgcgguguccuggggccuggucaucaucggccuccugaccgggcuccuguucaagaaguaccagcaccgguuccugaacguguacgccauguacugcgaggagugcgacauguaccacgacaagagcggccugaagcgccacggggacuucaccaacaagugccggcagugcacgugcggccaguacgaggacgccaccgggcucauggcccaccgcaagaccuacaacugccuggugcaguacaaggccaaguggaugaugaacuuccugaucaucuacaucuuccucauccugaucaaggacuccgcgaucgucgugcaggccgccggcaccgacuucacgaccugccuggagaccgagagcaucaacuggaacugcaccggccccuuccucaaccuggggaacugccagaagcagcagaagaaggagccguacaccaacaucgccacccagcugaagggccucaaggccaucuccgugcuggacauccccaucaucaccgggauccccgacgacaucgcgggcgcccugcgguacaucgaggagcgcgaggacuuccacguccagcugaccaucgaguacgccaugcucagcaaguacugcgacuacuacacccaguucuccgacaacagcggguacucccaggccacguggcggguguaccugcgcagccacgacuucgaggcgugcauccuguaccccaaccagcacuucugccgcugcgugaagaacggcgagaagugcuccagcuccaacugggacuucgccaacgagaugaaggacuucuacagcggcaagcagaccaaguucgacaaggaccucaaccuggcccugaccgcccuccaccacgccuuccgggggaccagcuccgcguacaucgccacgaugcugagcaagaaguccaacgacgaccugaucgccuacaccaacaagaucaagaccaaguucccgggcaacgcccuccugaaggccaucaucgacuacaucgcguacaugaagucccugcccgggauggccaacuucaaguacgacgaguucugggacgagcuccuguacaagcccaaccccgccaaggccagcaaccuggcccgcggcaaggagagcuccuacaacuucaagcucgcgaucagcuccaagagcaucaagaccugcaagaacgucaaggacguggccugccuguccccgcggagcggggccaucuacgccuccaucaucgcgugcggcgagcccaacggccccagcguguaccgcaagcccuccgggggcgucuuccagagcuccacggaccggagcaucuacugccugcucgacagccacugccuggaggaguucgaggccaucucccaggaggagcuggacgccgugaagaaguccaagugcugggagaucgaguacccggacgugaagccccuccaggagagcgacgggaccaagagcugccgcaugaaggacuccggcaacugcaacgucgccaccaaccgguggcccgugauccagugcgagaacgacaaguucuacuacagcgagcugcagaaggacuacgacaagacccaggacaucggccacuacugccugucccccgggugcacgaccgugcgcuacccgaucaaccccaagcacaucagcaacugcaacuggcaggucucccggagcuccaucgccaagaucgacgugcacaacaucgaggacaucgagcaguacaagaaggcgaucacccagaagcuccagaccagccugucccuguucaaguacgccaagacgaagaaccucccccacaucaagccgaucuacaaguacaucaccaucgagggcaccgagaccgccgaggggaucgagagcgccuacaucgaguccgaggugcccgcccuggcgggcacgagcaucggguucaagaucaacuccaaggagggcaagcaccuccuggacgucaucgccuacgucaagagcgccuccuacagcagcguguacgccaagcuguacuccaccggccccaccagcgggaucaacaccaagcacgacgagcugugcacgggccccugcccggccaacaucaaccaccaggugggguggcucaccuucgcgcgcgagcggaccuccagcuggggcugcgaggaguucgggugccuggccguguccgacggcugcguguucggcagcugccaggacaucaucaaggaggagcuguccgucuaccgcaaggagaccgaggaggugacggacguggagcucugccugaccuucagcgacaagaccuacugcaccaaccugaaccccgucacgcccaucaucaccgaccucuucgaggugcaguucaagaccguggagaccuacucccugccccggaucgucgccgugcagaaccacgagaucaagaucgggcagaucaacgaccugggcguguacagcaaggggugcggcaacguccagaaggugaacgggacgguguacggcaacggcgucccgcgcuucgacuaccucugccaccuggccucccggaaggaggugaucgugcgcaagugcuucgacaacgacuaccaggcgugcaaguuccugcagagccccgccuccuaccggcucgaggaggacagcgggaccgucaccaucaucgacuacaagaagauccugggcaccaucaagaugaaggccauccugggggacgugaaguacaagaccuucgccgacuccguggacaucacggccgagggcagcugcaccgggugcaucaacugcuucgagaacauccacugcgagcucacccugcacaccacgaucgaggcguccugccccaucaagagcuccugcaccgucuuccacgaccgcauccuggugacccccaacgagcacaaguacgcccucaagauggugugcaccgagcggccgggcaacacgcugaccaucaaggucugcaacaccaagaucgaggccagcauggcccugguggacgccaagcccaucaucgagcucgcgcccgucgaccagaccgccuacauccgcgagaaggacgagcgcugcaagacguggaugugccgggugcgcgacgagggccuccaggugauccuggagcccuucaagaaccuguucgggagcuacaucggcaucuucuacaccuucaucaucuccaucgucgcccugcuggugaucaucuacgugcuccugccgaucugcuucaagcugcgggacacccuccgcaagcacgaggacgccuacaagcgggagaugaagauccgcuga

SEQ ID NO: 12668 - RNA, 4326 nt, Artificial Sequence
  derived and/or modified CDS sequence (opt1) from LACV(77)__DQ196119.1__GP
augaucugcauccuggugcucaucaccgucgccgccgcgagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucgaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaccaucuacaacaaguccugcaagaagugcaagcugugcggccuggucuaccaccccuucaccgagugcgggacgcacugcaucugcggcgcccgcuacgacaccagcgaccggaugaagcuccaccgcgccuccggccugugccccggguacaagagccugcgggcggcccgcgugaugugcaagagcaagggcccggccuccauccucagcaucaucaccgccgugcugguccugaccuucgugacgcccaucaacuccaugguccucggggagagcaaggagaccuucgagcuggaggaccugcccgacgacaugcucgagauggccucccggaucaacagcuacuaccugaccugcauccugaacuacgcgguguccuggggccucgugaucaucggccugcugaucgggcuccuguucaagaaguaccagcaccgcuuccugaacgucuacgccauguacugcgaggagugcgacauguaccacgacaagagcggccucaagcggcacggggacuucaccaacaagugccgccagugcacgugcggccaguacgaggacgccgccgggcugauggcccaccggaagaccuacaacugccuggugcaguacaaggcgaaguggaugaugaacuuccucaucaucuacaucuuccugauccugaucaaggacuccgccaucgugguccaggccgccggcaccgacuucaccacgugccucgagaccgagagcaucaacuggaacugcaccggccccuuccugaaccuggggaacugccagaagcagcagaagaaggagccguacaccaacaucgccacgcagcucaagggccugaaggcgaucuccgugcuggacgugcccaucaucaccgggauccccgacgacaucgccggcgcccugcgcuacaucgaggagaaggaggacuuccacguccagcucaccaucgaguacgccaugcugagcaaguacugcgacuacuacacccaguucuccgacaacagcggguacucccagaccacguggcggguguaccugcgcagccacgacuucgaggcgugcauccucuaccccaaccagcacuucugccggugcgugaagaacggcgagaagugcuccagcuccaaccgcgacuucgccaacgagaugaaggacuacuacagcggcaagcagaccaaguucgacaaggaccugaaccuggcccucaccgcccugcaccacgccuuccgcgggaccagcuccgcguacaucgccacgaugcugagcaagaaguccaacgacgaccucaucgccuacaccaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccggggcaaggagagcuccuacaacuucaagcuggcgaucagcuccaagagcaucaagaccugcaagaacgucaaggacguggccugccuguccccgcgcagcggggccaucuacgccuccaucaucgcgugcggcgagcccaacggccccagcguguaccggaagcccuccgggggcgucuuccagagcuccacggaccagagcaucuacugccuccuggacagccacugccuggaggaguucgaggccaucgggcaggaggagcucgacgccgugaagaaguccaagugcugggagaucgaguacccggacgugaagcugauccaggagggcgacggcaccaagagcugccgcaugaaggacuccgggaacugcaacgucgccaccaaccgguggcccgugauccagugcgagaacgacaaguucuacuacagcgagcugcagaaggacuacgacaagacccaggacaucggccacuacugccucucccccgggugcacgaccgugcgcuaccccaucaacccgaagcacaucagcaacugcaacuggcaggucucccggagcuccaucgccaagaucgacgugcacaacaucgaggacaucgagcaguacaagaaggcgaucacccagaagcugcagaccagccugucccucuucaaguacgccaagacgaagaaccugccccacaucaagcccaucuacaaguacaucaccaucgagggcaccgagaccgccgaggggaucgagagcgccuacaucgaguccgaggugccggcccuggcgggcacgagcaucggcuucaagaucaacuccaaggaggggaagcaccuccuggacgucaucgccuacgucaagagcgccuccuacagcuccguguacaccaagcuguacagcaccggccccaccagcgggaucaacacgaagcacgacgagcucugcaccggccccugccccgccaacaucaaccaccaggugggguggcugaccuucgcccgcgagcggaccuccagcuggggcugcgaggaguucggcugccuggcgguguccgacgggugcguguucggcagcugccaggacaucaucaaggaggagcucuccgucuaccgcaaggagacggaggaggugaccgacguggagcugugccugaccuucagcgacaagaccuacugcacgaaccucaacccggucacccccaucaucaccgaccuguucgaggugcaguucaagaccguggaggccuacucccugccccggaucgucgccgugcagaaccacgagaucaagaucgggcagaucaacgaccucggcguguacagcaaggggugcggcaacguccagaaggugaacggcacgaucuacgggaacggcgugccccgcuucgacuaccugugccaccuggccucccggaaggaggucaucgugcgcaagugcuucgacaacgacuaccaggcgugcaaguuccuccagagcccggccuccuaccggcuggaggaggacagcgggaccgugaccaucaucgacuacaagaagauccugggcaccaucaagaugaaggccauccucggggacgucaaguacaagaccuucgccgacuccguggacaucacggccgagggcagcugcaccggcugcaucaacugcuucgagaacauccacugcgagcugacccugcacaccacgaucgaggcguccugccccaucaagagcuccugcaccguguuccacgaccgcauccucgucacccccaacgagcacaaguacgcccugaagauggugugcaccgagaagcccgggaacacgcugaccaucaaggugugcaacaccaagaucgaggccagcauggcccucgucgacgccaagccgaucaucgagcuggcgcccguggaccagaccgccuacauccgggagaaggacgagcgcugcaagacguggaugugccggguccgcgacgagggccuccaggugauccuggagcccuucaagaaccuguucggguccuacaucggcaucuucuacaccuucaucaucagcaucguggcccugcucgucaucaucuacgugcugcugcccaucugcuucaagcuccgcgacacccugcggaagcacgaggacgccuacaagcgcgagaugaagauccgguga

SEQ ID NO: 12669 - RNA, 4326 nt, Artificial Sequence
  derived and/or modified CDS sequence (opt1) from LACV(LACV/00/NC-M (NC00-283))__GU206112.1__GP
augauccgcauccuggugcucaucgccgucaccgccgcgagccccguguaccagcggugcuuccaggacggcgccaucgugaagcagaacccguccaaggaggccgucaccgaggugugccugaaggacgacgugagcaugaucaagacggaggcccgcuacguccggaacgccaccgggguguucuccaacaacguggcgauccgcaaguggcuggucagcgacuggcacgacugccggcccaagaagaucaucggcgggcacaucaacgugaucgaggugggcgacgaccucucccugcacaccgagagcuacgucugcuccgccgacugcaccaucgggguggacaaggagacggcccaggugcgccugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcguccgguuccugcaccgcaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacauguacgggaucaucuacaacaaguccugcaagaagugcaagcugugcggccugguguaccaccccuucaccgagugcgggacccacugcgucugcggcgcccgguacgacacgagcgaccgcaugaagcuccaccgggccuccggccugugccccggguacaagagccugcgcgcggcccgggugaugugcaagagcaagggcccggccuccauccucagcaucaucaccgccgugcugguccugaccuucgugacccccaucaacuccaugguccucggggagagcaaggagacguucgagcuggaggagcugcccgacgacaugcucgagauggccucccgcaucaacagcuacuacuucacgugcauccugaacuacgcgguguccuggggccuggugaucaucggccuccugaccgggcuccuguucaagaaguaccagcaccgguuccugaacgucuacgccauguacugcgaggagugcgacauguaccacgacaagagcggccugaagcgccacggggacuucaccaacaagugccggcagugcacgugcggccaguacgaggacgccgccgggcucauggcccaccgcaagaccuacaacugccuggugcaguacaaggcgaaguggaugaugaacuuccugaucaucuacaucuuccucauccugaucaaggacuccgccaucgugguccaggccgccggcaccgacuucacgaccugccuggagaccgagagcaucaacuggaacugcaccggccccuuccucaaccuggggaacugccagaagcagcagaagaaggagccguacaccaacaucgccacccagcugaagggccucaaggcgaucuccgugcuggacauccccaucaucaccgggauccccgacgacaucgccggcgcccugaaguacaucgaggagcgggaggacuuccacgugcagcugaccaucgaguacgccaugcucagcaaguacugcgacuacuacacccaguucuccgacaacagcggguacucccagaccacguggcgcgucuaccugcggagccacgacuucgaggcgugcauccuguaccccaaccagcacuucugccgcugcgugaagaacggcgagaagugcuccagcuccaacugggacuucgccaacgagaugaaggacuacuacagcggcaagcagaccaaguucgacaaggaccucaaccuggcccugaccgcccuccaccacgccuuccgcgggaccagcuccgcguacaucgccacgaugcugagcaagaaguccaacgacgaccugaucgccuacaccaacaagaucaagaccaaguucccgggcaacgcccuccugaaggccaucaucgacuacaucgcguacaugaagucccugcccgggaugaccaacuucaaguacgacaaguucugggacgagcuccuguacaagcccaaccccgccaaggccagcaaccuggcccggggcaaggagagcuccuacaacuucaagcucgccaucagcuccaagagcaucaagacgugcaagaacgugaaggacgucgcgugccuguccccgcgcagcggggccaucuacgccuccaucaucgccugcggcgagcccaacggccccagcguguaccggaagcccuccgggggcguguuccagagcuccaccgaccgcagcaucuacugccugcucgacagccacugccuggaggaguucgaggcgaucaaccaggaggagcuggacgccgucaagaaguccaagugcugggagaucgaguacagcgacgugaagccgcuccaggagggggacggcaccaaguccugccggaugaaggacagcggcaacugcaacguggccaccaaccgcuggcccgucauccagugcgagaacgacaaguucuacuacuccgagcugcagaaggacuacgacaagacgcaggacaucgggcacuacugccugagccccggcugcaccaccgugcgguaccccaucaacccgaagcacaucuccaacugcaacuggcaggucagccgcuccagcaucgccaagaucgacgugcacaacaucgaggacaucgagcaguacaagaaggccaucacccagaagcuccagacgucccugagccuguucaaguacgcgaagaccaagaaccucccccacaucaagcccaucuacaaguacaucaccaucgaggggaccgagacggccgagggcaucgaguccgccuacaucgagagcgaggugccggcccuggccgggaccuccaucggcuucaagaucaacagcaaggagggcaagcaccuccuggacgugaucgcguacgucaaguccgccagcuacuccagcguguacgccaagcuguacagcaccgggcccaccuccggcaucaacacgaagcacgacgagcugugcaccgggcccugccccgccaacaucaaccaccaggugggcuggcucaccuucgccaaggagcggaccagcuccugggggugcgaggaguucggcugccuggcggucagcgacggcugcguguucggguccugccaggacaucaucaaggaggagcugagcguguaccgcaaggagacggaggaggucaccgacguggagcucugccugaccuucuccgacaagaccuacugcacgaaccugaacccggugacccccaucaucaccgaccucuucgagguccaguucaagaccguggagacguacagccugccccggaucguggccguccagaaccacgagaucaagaucggccagaucaacgaccuggggguguacuccaagggcugcgggaacgugcagaaggucaacggcaccguguacggcaacggggugccccgcuucgacuaccucugccaccuggccagccggaaggaggucaucgugcgcaagugcuucgacaacgacuaccaggccugcaaguuccugcaguccccggcgagcuaccggcucgaggaggacuccggcaccgugaccaucaucgacuacaagaagauccuggggaccaucaagaugaaggccauccugggcgacgucaaguacaagacguucgccgacaacguggacaucaccgccgaggggagcugcaccggcugcaucaacugcuucgagaacauccacugcgagcucacccugcacacgaccaucgaggccuccugccccaucaagagcuccugcaccguguuccacgaccgcauccuggucacccccagcgagcacaaguacgcgcucaagauggugugcacggagaagcccggcaacacccugaccaucaaggugugcaacaccaagaucgaggccuccauggcccuggucgacgccaagccgaucaucgagcucgcccccguggaccagacggcguacauccgggagaaggacgagcgcugcaagaccuggaugugccggguccgcgacgaggggcuccaggugauccuggagcccuucaagaaccuguucggcagcuacaucgggaucuucuacaccuucaucaucagcaucauggcccugcuggugaucaucuacguccuccugcccaucugcuucaagcugcgcgacacccuccggaagcacgaggacgccuacaagcgcgagaugaagauccgguga

SEQ ID NO: 12670 - RNA, 4326 nt, Artificial Sequence
  derived and/or modified CDS sequence (opt1) from LACV(LACV/00/WV-M (WV00-3178))__GU206148.1__GP
augauccgcauccuggugcucaucgccaucaccgccgcgagccccgucuaccagcggugcuuccaggacggcgccaucgugaagcagaacccguccaaggaggccgugaccgaggucugccugaaggacgacgugagcaugaucaagacggaggcccgcuacgugcggaacgccaccggggucuucuccaacaacguggcgauccgcaaguggcuggugagcgacuggcacgacugccggcccaagaagaucaucggcgggcacaucaacgucaucgaggugggcgacgaccucucccugcacaccgagagcuacgugugcuccagcgacugcaccaucggggucgacaaggagacggcccaggugcgccugcagaccgacaccaccaaccacuucgagaucgccggcacgaccgugaaguccggcugguucaagagcaccaccuacaucacgcucgaccagaccugcgagcaccugaaggucuccugcgggcccaagagcgugcaguuccacgccugcuucaaccagcacauguccugcgugcgguuccugcaccgcaccauccuccccggcagcaucgcgaacuccaucugccagaacaucgagaucaucauccuggucacccugacgcuccugaucuucauccugcucagcauccuguccaagaccuacaucugcuaccugcucaugccgaucuucauccccaucgccuacaucuacgggaucaucuacaacaagagcugcaagaagugcaagcugugcggccugguguaccaccccuucaccgagugcgggacccacugcgugugcggcgcccgguacgacacguccgaccgcaugaagcuccaccgggccagcggccugugccccggguacaagagccugcgcgccgcgcgggucaugugcaaguccaagggcccggccagcauccucuccaucaucaccgccgugcuggugcugaccuucgucacccccaucaacagcauggugcucggggaguccaaggagacguucgagcuggaggagcugcccgacgacaugcucgagauggccagccgcaucaacuccuacuaccugaccugcauccugaacuacgccgucagcuggggccucgugaucaucggccugcugaccgggcuccuguucaagaaguaccagcaccgguuccugaacaccuacgcgauguacugcgaggagugcgacauguaccacgacaaguccggccucaagcgccacggggacuucacgaacaagugccggcagugcacgugcggccaguacgaggacgccgccgggcugaugacccaccgcaagaccuacaacugccuggugcaguacaaggccaaguggaugaugaacuuccucaucaucuacaucuuccugauccugaucaaggacagcgccaucaucguccaggcggccggcacggacuucacgaccugccucgagaccgaguccaucaacuggaacugcaccggccccuuccugaaccuggggaacugccagaagcagcagaagaaggagccguacaccaacaucgccacccagcucaagggccugaaggccaucagcgugcuggacauccccaucaucaccgggauccccgacgacaucgccggcgcgcugcgguacaucgaggagcgcgaggacuuccacgugcagcucaccacggaguacgccaugcugucccgguacugcgacuacuacacccaguucagcgacaacucccgcuacagccagaccaccuggcgcgucuaccugcggucccacgacuucgaggccugcauccucuaccccaaccagcacuucugccgcugcgugaagaacggggagaagugcagcuccagcaacugggacuucgccaacgagaugaaggacuacuacagcggcaagcagacgaaguucgacaaggaccugaaccuggcgcucaccgcccugcaccacgccuuccggggcaccuccagcgccuacaucgccaccaugcuguccaagaaguccaacgacgaccucaucacguacaccaacaagaucaagaccaaguucccggggaacgcgcugcugaaggccaucaucgacuacaucgccuacaugaagucccuccccggcauggccaacuucaaguacgacgaguucugggacgagcugcuguacaagcccaaccccgccaagaccagcaaccucgcgcgcgggaaggagagcacguacaacuucaagcuggccaucagcuccaagagcaucaagaccugcaagaacgugaaggacgucgccugccuguccccgcggagcggcgccaucuacgccuccaucaucgcgugcggggagcccaacggccccagcguguaccgcaagcccuccggcgggguguuccagagcuccaccgaccggagcaucuacugccuccuggacagccacugccuggaggaguucgaggccaucucccaggaggagcucgacgccgucaagaaguccaagugcugggagaccgaguacccggaggugaagccccugcaggagagcgacggcaccaagagcugccgcaugaaggacuccgggaacugcaacguggccaccaaccgguggcccgucauccagugcgagaacgacaaguucuacuacagcgagcugcagaaggacuacgacaagacccaggacaucggccacuacugccucucccccggcugcaccacggugcgcuacccgaucaaccccaagcacaucagcaacugcaacuggcaggucucccggagcuccaucgcgaagaucgacgugcacaacaucgaggacaucgagcaguacaagaaggccaucacccagaagcugcagaccagccugucccucuucaaguacgccaagaccaagaaccugccccacaucaagccgaucuacaaguacaucacgaucgaggggaccgagaccgccgagggcaucgagagcgccuacaucgaguccgaggugcccgcgcuggccgggaccagcaucggcuucaagaucaacuccaaggaggggaagcaccuccuggacgugaucgccuacgucaagagcgccuccuacagcagcguguacgccaagcuguacuccacgggccccaccagcggcaucaacaccaagcacgacgagcucugcaccgggcccugcccggcgaacaucaaccaccagaucggcuggcugacguucgccaaggagcgcaccuccagcugggggugcgaggaguucggcugccuggccguguccgacgggugcgucuucggcagcugccaggacaucaucaaggaggagcucuccguguaccggaaggagaccgaggaggugaccgacgucgagcugugccugacguucagcgacaagaccuacugcaccaaccucaaccccgugacccccaucaucaccgaccuguucgaggugcaguucaagacggucgagaccuacucccugccccgcaucguggccgugcagaaccacgagaucaagaucggccagaucaacgaccucggggucuacagcaagggcugcgggaacgugcagaaggugaacggcaccgucuacgggaacggcgugccgcgguucgacuaccugugccaccuggccucccgcaaggaggugaucguccggaagugcuucgacaacgacuaccaggcgugcaaguuccuccagagccccgccuccuaccgccuggaggaggacagcggcaccgugacgaucaucgacuacaagaagauccuggggaccaucaagaugaaggccauccucggcgacgugaaguacaagaccuucgccgaguccgucgacaucaccgcggaggggagcugcacgggcugcaucaacugcuucgagaacauccacugcgagcugacccugcacaccaccaucgaggccuccugccccaucaagagcuccugcacgguguuccacgaccggauccucgugacccccaacgagcacaaguacgcccugaagauggucugcaccgagcgcccggggaacacccugacgaucaaggugugcaacaccaagaucgaggccagcaugacccucguggacgccaagcccaucaucgagcuggcgcccgucgaccagaccgccuacauccgcgagaaggacgagcggugcaagacguggaugugccgcgugcgggacgagggccuccaggugauccuggagcccuucaagaaccuguucggcagcuacaucgggaucuucuacaccuucaucaucuccaucgucgcccugcucgugaucaucuacguccugcugccgaucugcuucaagcuccgcgacacccugcggaagcacgaggacgccuacaagcgcgagaugaagauccgguga

SEQ ID NO: 12671 - RNA, 4326 nt, Artificial Sequence
  derived and/or modified CDS sequence (opt1) from LACV(LACV/03/NY-M (41030016))__GU206130.1__GP
augaucuacauccuggugcucaucgccgucaccgccgcgagccccguguaccagcgcugcuuccaggacggcgccaucgugaagcagaacccguccaaggaggccgucaccgaggugugccugaaggacgacgugagcaugaucaagacggaggcccgguacauccgcaacgccaccggggucuucuccaacaacguggcgauccggaaguggcuggugagcgacuggcacgacugccgccccaagaagaucgucggcgggcacaucaacgugaucgaggugggcgacgaccucucccugcacaccgagagcuacgucugcuccgccgacugcaccaucgggguggacaaggagacggcccaggugcggcugcagaccgacaccaccaaccacuucgagaucgccggcacgaccgucaagagcggcugguucaaguccaccaccuacaucacgcucgaccagaccugcgagcaccugaaggugagcugcgggcccaaguccauccaguuccacgcgugcuucaaccagcacaugagcugcgugcgcuuccugcaccggaccauccuccccggcuccaucgccaacagcaucugccagaacaucgagaucaucauccuggucacccugacgcuccugaucuucauccugcucuccauccugagcaagaccuacaucugcuaccugcucaugccgguguucauccccaucgccuacguguacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacccccaucaacuccauggugcucggggagagcaaggagguguucgagcuggaggagcugcccgacgacaugcucgagauggcccugcggaucaacuucuacuacuucacgugcauccugaacuacgcggucuccuggagccucgugaucaucggccugcugaccggccuccuguucaagcgcuaccagcacaaguuccugaacaucuacgccauguacugcgaggagugcgacauguaccacgacaaguccgggcucaagcggcacggcgacuucaccaacaagugccgccagugcacgugcgggcaguacgaggacgccaccggccugaugacccaccggaagaccuacaacugccuggugcaguacaaggccaaguggaucaugaacuuccucaucaucuacaucuuccugguccugaucaaggacagcgccaucaucgugcaggcggccgggaccgacuucuccagcugccucgagacggaguccaucaacuggaacugcaccggccccuuccugaaccugggcaacugccagaagcagcagaagaaggagccguacaccaacaucgccgcccagcucaaggggcugcgcgccaucagcgugcuggacauccccaugaucaccgagauccccgacgacaucgcguccgcccugcgguacaucgaggagcgcgaggccuuccacguccagcucacggccgaguacgcgaugcugacccgguacugcgacuacuacacccaguucagcgacaacuccggcuacagccagaccaccuggcgcguguaccugcgcucccacgacuucgaggccugcaucauguaccccaaccagcacuucugccggugcgugaagaacggggagaagugcagcuccagcaacugggacuucgccaacgagaugaaggacuacuacagcggcaagcaggccaaguucgacaaggaccucaaccuggcccugacggcgcuccaccacgccuuccgcgggaccuccagcgccuacaucgccgccaugcuguccaagaaguccaacgacgaccugaucaccuacaccaacaagaucaagacgaaguucccgggcaacgcgcuccugaaggccaucaucgacuacaucgccuacaugaagggccugcccgggauggccuccuucaagcacgacgaguucugggacgagcuccuguacaagcccacccccaccaaggccccgaaccuggcgcggggccgcgagagcuccuacaacuucaagcucgccaucagcuccaagagcaucaagaccugcaagaacgucaaggacguggccugccugagcccccggagcggggccaucuacgcguccaucaucgccugcggcgagcccaacgggcccagcguguaccgcaagccguccaacggcgucuuccagagcuccacggaccagagcauguacugccugcucgacagccacugccuggaggaguucgaggccaucucccaggaggagcuggacgccgugaagaaguccaagugcugggagaucgaguaccccgacaucaagccccuccaggagagcgacggcaccaagagcugccggaugaaggacuccgggaacugcaacguggccaccaaccgcuggcccgucauccagugcgagaacgacaaguucuacuacagcgagcugcagaaggacuacgacaagacccaggacaucggccacuacugccuguccccggggugcacgaccgugcgguaccccaucaaccccaagcacaucagcaacugcaacuggcaggucucccgcagcuccaucgcgaagaucgacgugcacaacaucgaggacaucgagcaguacaagaaggccaucacccagaagcuccagaccagccugucccuguucaaguacgccaagacgaagaaccucccgcacaucaagcccaucuacaaguacaucaccaucgagggcaccgagaccgccgagggcaucgagagcgccuacaucgaguccgaggugcccgcgcuggccgggacgagcaucggcuucaagaucaacuccaaggaggggaagcaccuccuggacgugaucgccuacgucaagagcgccuccuacagcagcguguacaccaagcuguacuccaccggccccaccagcgggaucaacacgaagcacgacgagcugugcaccggcccgugccccgccaacaucaaccaccaggugggcuggcucaccuucgcgaaggagcggaccuccagcugggggugcgaggaguucggcugccuggccgucuccgacgggugcguguucggcagcugccaggacaucaucaaggaggagcuguccguguaccgcaaggagacggaggaggucaccgacguggagcucugccugaccuucagcgacaagaccuacugcacgaaccugaaccccgugacccccaucaucaccgaccucuucgagguccaguucaagaccguggagacguacucccugccgcggaucguggccguccagaaccacgagaucaagaucgggcagaucaacgaccugggcguguacagcaagggcugcgggaacgugcagaaggucaacggcaccguguacgggaacggcgugccccgcuucgacuaccucugccaccuggccucccggaaggaggucaucgugcgcaagugcuucgacaacgacuaccaggcgugcaaguuccugcagagccccgccuccuaccggcucgaggaggacagcgggaccgugaccgucaucgacuacaagaagauccugggcaccaucaagaugaaggccauccugggcgacgugaaguacaagacguucgccgacaacguggacaucaccgccgagggguccugcaccggcugcaucaacugcuucgagaacauccacugcgagcucacccugcacacgaccaucgaggcgagcugccccaucaaguccagcugcaccgucuuccacgaccgcauccuggugaccccgaacgagcacaaguacgcccucaagguggucugcacggagaagcccgggaacacccugaccaucaaggugugcaacaccaagaucgaggccuccauggcccuggucgacgccaagcccaucaucgagcucgcgcccguggaccagacggccuacauccgggagaaggacgagcgcugcaagaccuggaugugccgcgugcgggacgagggccugcaggucauccuggagccguucaagaaccucuucgggagcuacaucggcaucuucuacaccuucaucaucagcaucguggcccugcuggugaucaucuacauccuccugcccaucugcuucaagcugcgcgacacccuccggaagcacgaggacgccuacaagcgcgagaugaagauccgguga

SEQ ID NO: 12672 - RNA, 4326 nt, Artificial Sequence
  derived and/or modified CDS sequence (opt1) from LACV(LACV/06/NY(1)-M (06MS2900303))__GU206118.1__GP
augaucuacauccuggugcucaucgccgucaccgccgcgagccccguguaccagcgcugcuuccaggacggcgccaucgugaagcagaacccguccaaggaggccgucaccgaggugugccugaaggacgacgugagcaugaucaagacggaggcccgguacauccgcaacgccaccggggucuucuccaacaacguggcgauccggaaguggcuggugagcgacuggcacgacugccgccccaagaagaucgucggcgggcacaucaacgugaucgaggugggcgacgaccucucccugcacaccgagagcuacgucugcuccgccgacugcaccaucgggguggacaaggagacggcccaggugcggcugcagaccgacaccaccaaccacuucgagaucgccggcacgaccgucaagagcggcugguucaaguccaccaccuacaucacgcucgaccagaccugcgagcaccugaaggugagcugcgggcccaaguccauccaguuccacgcgugcuucaaccagcacaugagcugcgugcgcuuccugcaccggaccauccuccccggcuccaucgccaacagcaucugccagaacaucgagaucaucauccuggucacccuggcccuccugaucuucauccugcucuccauccugagcaagacguacaucugcuaccugcucaugccgguguucauccccaucgccuacguguacggggucaucuacaacaaguccugcaagaagugcaagcugugcggccugguguaccaccccuucaccgagugcgggacccacugcgugugcggcgcccgcuacgacaccagcgaccggaugaagcuccaccgcgcguccggccugugccccggguacaagagccugcgggccgcccgcgucaugugcaagagcaagggcccggccuccauccucagcaucaucacggccgugcugguccugaccuucgugacccccaucaacuccauggugcucggggagagcaaggaggucuucgagcuggaggagcugcccgacgacaugcucgagauggcgcugcggaucaacuucuacuacuucacgugcauccugaacuacgccguguccuggagccucgugaucaucggccugcugaccggccuccuguucaagcgcuaccagcacaaguuccugaacaucuacgccauguacugcgaggagugcgacauguaccacgacaaguccgggcucaagcggcacggcgacuucaccaacaagugccgccagugcacgugcgggcaguacgaggacgccaccggccugaugacccaccggaagaccuacaacugccugguccaguacaaggccaaguggaucaugaacuuccucaucaucuacaucuuccuggugcugaucaaggacagcgcgaucaucgugcaggccgccgggaccgacuucuccagcugccucgagaccgaguccaucaacuggaacugcacgggccccuuccugaaccugggcaacugccagaagcagcagaagaaggagccguacgccaacaucgccgcgcagcucaaggggcugaaggccaucagcguccuggacauccccaugaucaccgagauccccgacgacaucgccuccgcccugcgcuacaucgaggagcgggaggcguuccacgugcagcucaccgccgaguacgccaugcugacccgcuacugcgacuacuacacgcaguucagcgacaacuccggcuacagccagaccaccuggcggguguaccugcgcucccacgacuucgaggccugcaucauguaccccaaccagcacuucugccgcugcgucaagaacggggagaagugcagcuccagcaacugggacuucgccaacggcaugaaggacuacuacagcgggaagcaggcgaaguucgacaaggaccucaaccuggcccugaccgcccuccaccacgccuuccggggcaccuccagcgccuacaucgcgacgaugcuguccaagaaguccaacgacgaccugaucgccuacaccaacaagaucaagaccaaguucccgggcaacgcccuccugaaggccaucaucgacuacaucgccuacaugaaggggcugcccggcauggcgaacuucaagcacgacgaguucugggacgagcuccuguacaagcccacccccacgaaggccccgaaccuggcccgcgggcgggagagcagcuacaacuucaagcucgccaucuccagcaaguccaucaagaccugcaagaacgugaaggacguggcgugccugagcccccgcuccggcgccaucuacgccagcaucaucgccugcggggagcccaacggccccuccgucuaccggaagccgcugaacggcguguuccagagcuccaccgaccagagcauguacugccuccuggacucccacugccuggaggaguucgaggccaucagccaggaggagcucgacgcggugaagaaguccaagugcugggagaucgaguacagcgacaucaagccccugcaggagagcgacgggaccaaguccugccgcaugaaggacagcggcaacugcaacgucgccacgaaccgguggcccgugauccagugcgagaacgacaaguucuacuacuccgagcugcagaaggacuacgacaagacccaggacaucgggcacuacugccucagccccggcugcaccaccgugcgcuacccgaucaaccccaagcacaucuccaacugcaacuggcaggucagccgguccagcaucgccaagaucgacgugcacaacaucgaggacaucgagcaguacaagaaggccaucacgcagaagcugcagaccucccugagccucuucaaguacgccaagaccaagaaccugccccacaucaagccgaucuacaaguacaucaccaucgagggcacggagaccgcggaggggaucgaguccgccuacaucgagagcgaggugcccgcccuggccggcaccuccaucggguucaagaucaacagcaaggagggcaagcaccuccuggacgucaucgccuacgugaaguccgcgagcuacuccagcguguacaccaagcuguacagcacggggcccaccuccggcaucaacaccaagcacgacgagcucugcaccggccccugcccggccaacaucaaccaccaggucggguggcugacguucgccaaggagcgcaccagcuccuggggcugcgaggaguucgggugccuggccgugagcgacggcugcguguucggguccugccaggacaucaucaaggaggagcucagcgucuaccggaaggagaccgaggaggugaccgacguggagcugugccugacguucuccgacaagaccuacugcaccaaccucaaccccgucacccccaucaucacggaccuguucgaggugcaguucaagaccguggagaccuacagccugccccgcaucgucgcggugcagaaccacgagaucaagaucggccagaucaacgaccucggcguguacuccaaggggugcggcaacguccagaaggugaacgggaccguguacggcaacggggucccgcgguucgacuaccugugccaccuggccagccgcaaggaggugaucgugcggaagugcuucgacaacgacuaccaggccugcaaguuccuccagucccccgccagcuaccgccuggaggaggacuccggcacggucaccgugaucgacuacaagaagauccugggcaccaucaagaugaaggccauccucggggacgugaaguacaagaccuucgcggacaacgucgacaucaccgccgagggcagcugcacggggugcaucaacugcuucgagaacauccacugcgagcugacccugcacaccaccaucgaggccuccugccccaucaagagcuccugcacgguguuccacgaccggauccucgugacccccaacgagcacaaguacgcccugaaggucgugugcaccgagaagccgggcaacacccugacgaucaaggucugcaacaccaagaucgaggccagcauggcgcucguggacgccaagcccaucaucgagcuggcccccguggaccagaccgccuacauccgcgagaaggacgagcggugcaagaccuggaugugccgcguccgcgacgaggggcuccaggugauccuggagcccuucaagaaccuguucggcuccuacaucggcaucuucuacacguucaucaucagcaucgugacccugcucgucaucaucuacauccugcugccgaucugcuucaaggugcgggacacccuccgcaagcacgaggacgccuacaagcgggagaugaagauccgcuga

SEQ ID NO: 12673 - RNA, 4326 nt, Artificial Sequence
  derived and/or modified CDS sequence (opt1) from LACV(LACV/06/NY(2)-M (06MS350140))__GU206109.1__GP
augaucuacauccuggugcucaucgccgucaccgccgcgagccccguguaccagcgcugcuuccaggacggcgccaucgugaagcagaacccguccaaggaggccgucaccgaggugugccugaaggacgacgugagcaugaucaagacggaggcccgguacauccgcaacgccaccggggucuucuccaacaacguggcgauccggaaguggcuggugagcgacuggcacgacugccgccccaagaagaucgucggcgggcacaucaacgugaucgaggugggcgacgaccucucccugcacaccgagagcuacgucugcuccgccgacugcaccaucgggguggacaaggagacggcccaggugcggcugcagaccgacaccaccaaccacuucgagaucgccggcacgaccgucaagagcggcugguucaaguccaccaccuacaucacgcucgaccagaccugcgagcaccugaaggugagcugcgggcccaaguccauccaguuccacgcgugcuucaaccagcacaugagcugcgugcgcuuccugcaccggaccauccuccccggcuccaucgccaacagcaucugccagaacaucgagaucaucauccuggucacccuggcccuccugaucuucauccugcucuccauccugagcaagacguacaucugcuaccugcucaugccgguguucauccccaucgccuacguguacggggucaucuacaacaaguccugcaagaagugcaagcugugcggccugguguaccaccccuucaccgagugcgggacccacugcgugugcggcgcccgcuacgacaccagcgaccggaugaagcuccaccgcgcguccggccugugccccggguacaagagccugcgggccgcccgcgucaugugcaagagcaagggcccggccuccauccucagcaucaucacggccgugcugguccugaccuucgugacccccaucaacuccauggugcucggggagagcaaggaggucuucgagcuggaggagcugcccgacgacaugcucgagauggcgcugcggaucaacuucuacuacuucacgugcauccugaacuacgccguguccuggagccucgugaucaucggccugcugaccggccuccuguucaagcgcuaccagcacaaguuccugaacaucuacgccauguacugcgaggagugcgacauguaccacgacaaguccgggcucaagcggcacggcgacuucaccaacaagugccgccagugcacgugcgggcaguacgaggacgccaccggccugaugacccaccggaagaccuacaacugccugguccaguacaaggccaaguggaucaugaacuuccucaucaucuacaucuuccuggugcugaucaaggacagcgcgaucaucgugcaggccgccgggaccgacuucuccagcugccucgagaccgaguccaucaacuggaacugcacgggccccuuccugaaccugggcaacugccagaagcagcagaagaaggagccguacgccaacaucgccgcgcagcucaaggggcugaaggccaucagcguccuggacauccccaugaucaccgagauccccgacgacaucgccuccgcccugcgcuacaucgaggagcgggaggcguuccacgugcagcucaccgccgaguacgccaugcugacccgcuacugcgacuacuacacgcaguucagcgacaacuccggcuacagccagaccaccuggcggguguaccugcgcucccacgacuucgaggccugcaucauguaccccaaccagcacuucugccgcugcgucaagaacggggagaagugcagcuccagcaacugggacuucgccaacgagaugaaggacuacuacagcggcaagcaggcgaaguucgacaaggaccucaaccuggcccugaccgcccuccaccacgccuuccgggggaccuccagcgccuacaucgcgacgaugcuguccaagaaguccaacgacgaccugaucgccuacaccaacaagaucaagaccaaguucccgggcaacgcccuccugaaggccaucaucgacuacaucgccuacaugaagggccugcccgggauggcgaacuucaagcacgacgaguucugggacgagcuccuguacaagcccacccccacgaaggccccgaaccuggcccgcggccgggagagcagcuacaacuucaagcucgccaucuccagcaaguccaucaagaccugcaagaacgugaaggacguggcgugccugagcccccgcuccggggccaucuacgccagcaucaucgccugcggcgagcccaacgggcccuccgucuaccggaagccgcugaacggcguguuccagagcuccaccgaccagagcauguacugccuccuggacucccacugccuggaggaguucgaggccaucagccaggaggagcucgacgcggugaagaaguccaagugcugggagaucgaguaccccgacaucaagccccugcaggagagcgacggcaccaagagcugccgcaugaaggacuccgggaacugcaacgucgccacgaaccgguggcccgugauccagugcgagaacgacaaguucuacuacagcgagcugcagaaggacuacgacaagacccaggacaucggccacuacugccucuccccggggugcaccaccgugcgcuaccccaucaaccccaagcacaucagcaacugcaacuggcaggucucccggagcuccaucgccaagaucgacgugcacaacaucgaggacaucgagcaguacaagaaggccaucacgcagaagcugcagaccagccugucccucuucaaguacgccaagaccaagaaccugccgcacaucaagcccaucuacaaguacaucaccaucgagggcacggagaccgcggagggcaucgagagcgccuacaucgaguccgaggugcccgcccuggccgggaccagcaucggcuucaagaucaacuccaaggaggggaagcaccuccuggacgucaucgccuacgucaagagcgcguccuacagcuccguguacaccaagcuguacagcacgggccccaccagcgggaucaacaccaagcacgacgagcucugcaccggcccgugccccgccaacaucaaccaccaggugggcuggcugacguucgccaaggagcgcaccuccagcugggggugcgaggaguucggcugccuggccguguccgacgggugcguguucggcagcugccaggacaucaucaaggaggagcucuccgucuaccggaaggagaccgaggaggugaccgacguggagcugugccugacguucagcgacaagaccuacugcaccaaccucaaccccgucacccccaucaucacggaccuguucgaggugcaguucaagaccguggagaccuacucccugccgcgcaucgucgcggugcagaaccacgagaucaagaucgggcagaucaacgaccucggcguguacagcaagggcugcgggaacguccagaaggugaacggcaccguguacgggaacggcgucccccgguucgacuaccugugccaccuggccucccgcaaggaggugaucgugcggaagugcuucgacaacgacuaccaggccugcaaguuccuccagagccccgccuccuaccgccuggaggaggacagcgggacggucaccgugaucgacuacaagaagauccugggcaccaucaagaugaaggccauccucggcgacgugaaguacaagaccuucgcggacaacgucgacaucaccgccgagggguccugcacgggcugcaucaacugcuucgagaacauccacugcgagcugacccugcacaccaccaucgaggccagcugccccaucaaguccagcugcacgguguuccacgaccggauccucgugaccccgaacgagcacaaguacgcccugaaggucgugugcaccgagaagcccgggaacacccugacgaucaaggucugcaacaccaagaucgaggccuccauggcgcucguggacgccaagcccaucaucgagcuggcccccguggaccagaccgccuacauccgcgagaaggacgagcggugcaagaccuggaugugccgcguccgcgacgagggccuccaggugauccuggagccguucaagaaccuguucgggagcuacaucggcaucuucuacacguucaucaucuccaucgugacccugcucgucaucaucuacauccugcugcccaucugcuucaagcuccgggacacccugcgcaagcacgaggacgccuacaagcgggagaugaagauccgcuga

SEQ ID NO: 12674 - RNA, 4326 nt, Artificial Sequence
  derived and/or modified CDS sequence (opt1) from LACV(LACV/06/NY(3)-M (06MS270036))__GU206121.1__GP
augaucuacauccuggugcucaucgccgucaccgccgcgagccccguguaccagcgcugcuuccaggacggcgccaucgugaagcagaacccguccaaggaggccgucaccgaggugugccugaaggacgacgugagcaugaucaagacggaggcccgguacauccgcaacgccaccggggucuucuccaacaacguggcgauccggaaguggcuggugagcgacuggcacgacugccgccccaagaagaucgucggcgggcacaucaacgugaucgaggugggcgacgaccucucccugcacaccgagagcuacgucugcuccgccgacugcaccaucgggguggacaaggagacggcccaggugcggcugcagaccgacaccaccaaccacuucgagaucgccggcacgaccgucaagagcggcugguucaaguccaccaccuacaucacgcucgaccagaccugcgagcaccugaaggugagcugcgggcccaaguccauccaguuccacgcgugcuucaaccagcacaugagcugcgugcgcuuccugcaccggaccauccuccccggcuccaucgccaacagcaucugccagaacaucgagaucaucauccuggucacccuggcccuccugaucuucauccugcucuccauccugagcaagacguacaucugcuaccugcucaugccgguguucauccccaucgccuacguguacggggucaucuacaacaaguccugcaagaagugcaagcugugcggccugguguaccaccccuucaccgagugcgggacccacugcgugugcggcgcccgcuacgacaccagcgaccggaugaagcuccaccgcgcguccggccugugccccggguacaagagccugcgggccgcccgcgucaugugcaagagcaagggcccggccuccauccucagcaucaucacggccgugcugguccugaccuucgugacccccaucaacuccauggugcucggggagagcaaggaggucuucgagcuggaggagcugcccgacgacaugcucgagauggcgcugcggaucaacuucuacuacuucacgugcauccugaacuacgccguguccuggagccucgugaucaucggccugcugaccggccuccuguucaagcgcuaccagcacaaguuccugaacaucuacgccauguacugcgaggagugcgacauguaccacgacaaguccgggcucaagcggcacggcgacuucaccaacaagugccgccagugcacgugcgggcaguacgaggacgccaccggccugaugacccaccggaagaccuacaacugccugguccaguacaaggccaaguggaucaugaacuuccucaucaucuacaucuuccuggugcugaucaaggacagcgcgaucaucgugcaggccgccgggaccgacuucuccagcugccucgagaccgaguccaucaacuggaacugcacgggccccuuccugaaccugggcaacugccagaagcagcagaagaaggagccguacgccaacaucgccgcgcagcucaaggggcugaaggccaucagcguccuggacauccccaugaucaccgagauccccgacgacaucgccuccgcccugcgcuacaucgaggagcgggaggcguuccacgugcagcucaccgccgaguacgccaugcugacccgcuacugcgacuacuacacgcaguucagcgacaacuccggcuacagccagaccaccuggcggguguaccugcgcucccacgacuucgaggccugcaucauguaccccaaccagcacuucugccgcugcgucaagaacggggagaagugcagcuccagcaacugggacuucgccaacggcaugaaggacuacuacagcgggaagcaggcgaaguucgacaaggaccucaaccuggcccugaccgcccuccaccacgccuuccggggcaccuccagcgccuacaucgcgacgaugcuguccaagaaguccaacgacgaccugaucgccuacaccaacaagaucaagaccaaguucccgggcaacgcccuccugaaggccaucaucgacuacaucgccuacaugaaggggcugcccggcauggcgaacuucaagcacgacgaguucugggacgagcuccuguacaagcccacccccacgaaggccccgaaccuggcccgcgggcgggagagcagcuacaacuucaagcucgccaucuccagcaaguccaucaagaccugcaagaacgugaaggacguggcgugccugagcccccgcuccggcgccaucuacgccagcaucaucgccugcggggagcccaacggccccuccgucuaccggaagccgcugaacggcguguuccagagcuccaccgaccagagcauguacugccuccuggacucccacugccuggaggaguucgaggccaucagccaggaggagcucgacgcggugaagaaguccaagugcugggagaucgaguacagcgacaucaagccccugcaggagagcgacgggaccaaguccugccgcaugaaggacagcggcaacugcaacgucgccacgaaccgguggcccgugauccagugcgagaacgacaaguucuacuacuccgagcugcagaaggacuacgacaagacccaggacaucgggcacuacugccucagccccggcugcaccaccgugcgcuacccgaucaaccccaagcacaucuccaacugcaacuggcaggucagccgguccagcaucgccaagaucgacgugcacaacaucgaggacaucgagcaguacaagaaggccaucacgcagaagcugcagaccucccugagccucuucaaguacgccaagaccaagaaccugccccacaucaagccgaucuacaaguacaucaccaucgagggcacggagaccgcggaggggaucgaguccgccuacaucgagagcgaggugcccgcccuggccggcaccuccaucggguucaagaucaacagcaaggagggcaagcaccuccuggacgucaucgccuacgugaaguccgcgagcuacuccagcguguacaccaagcuguacagcacggggcccaccuccggcaucaacaccaagcacgacgagcucugcaccggccccugcccggccaacaucaaccaccaggucggguggcugacguucgccaaggagcgcaccagcuccuggggcugcgaggaguucgggugccuggccgugagcgacggcugcguguucggguccugccaggacaucaucaaggaggagcucagcgucuaccggaaggagaccgaggaggugaccgacguggagcugugccugacguucuccgacaagaccuacugcaccaaccucaaccccgucacccccaucaucacggaccuguucgaggugcaguucaagaccguggagaccuacagccugccccgcaucgucgcggugcagaaccacgagaucaagaucggccagaucaacgaccucggcguguacuccaaggggugcggcaacguccagaaggugaacgggaccguguacggcaacggggucccgcgguucgacuaccugugccaccuggccagccgcaaggaggugaucgugcggaagugcuucgacaacgacuaccaggccugcaaguuccuccagucccccgccagcuaccgccuggaggaggacuccggcacggucaccgugaucgacuacaagaagauccugggcaccaucaagaugaaggccauccucggggacgugaaguacaagaccuucgcggacaacgucgacaucaccgccgagggcagcugcacggggugcaucaacugcuucgagaacauccacugcgagcugacccugcacaccaccaucgaggccuccugccccaucaagagcuccugcacgguguuccacgaccggauccucgugacccccaacgagcacaaguacgcccugaaggucgugugcaccgagaagccgggcaacacccugacgaucaaggucugcaacaccaagaucgaggccagcauggcgcucguggacgccaagcccaucaucgagcuggcccccguggaccagaccgccuacauccgcgagaaggacgagcggugcaagaccuggaugugccgcguccgcgacgaggggcuccaggugauccuggagcccuucaagaaccuguucggcuccuacaucggcaucuucuacacguucaucaucagcaucgugacccugcucgucaucaucuacauccugcugccgaucugcuucaagcuccgggacacccugcgcaagcacgaggacgccuacaagcgggagaugaagauccgcuga

SEQ ID NO: 12675 - RNA, 4326 nt, Artificial Sequence
  derived and/or modified CDS sequence (opt1) from LACV(LACV/65/OH-M (W17258))__GU206124.1__GP
augauccgcauccuggugcucaucgccgucaccgccgcgaaccccguguaccagcggugcuuccaggacggcgccaucgugaagcagaacccgagcaaggaggccgucaccgaggugugccugaaggacgacguguccaugaucaagacggaggcccgcuacauccggaacgccaccggggucuucagcaacaacguggcgauccgcaaguggcugguguccgacuggcacgacugccggcccaagaagaucaucggcgggcacaucaacgucaucgaggugggcgacgaccucagccugcacaccgaguccuacgugugcagcgccgacugcaccaucggggucgacaaggagacggcccaggugcgccugcagaccgacaccaccaaccacuucgagaucgccggcacgaccgugaaguccggcugguucaagagcaccaccuacaucacgcucgaccagaccugcgagcaccugaaggucuccugcgggcccaagagcgugcaguuccacgcgugcuucaaccagcacauguccugcgugcgguuccugcaccgcaccguccuccccggcagcaucgccaacuccaucugccagaacaucgagaucaucauccuggugacccugacgcuccugaucuucauccugcucagcauccuguccaagaccuacaucugcuaccugcucaugccgaucuucauccccaucgccuacguguacgggaucaucuacaacaagagcugcaagaagugcaagcugugcggccuggucuaccaccccuucaccgagugcgggacccacugcgugugcggcgcccgguacgacacguccgaccgcaugaagcuccaccgggccagcggccugugccccggguacaagucccugcgcgcggcccgggugaugugcaagagcaagggcccggccagcauccucuccaucaucaccgccguccuggugcugaccuucgucacccccaucaacagcauggugcucggggaguccaaggagacguucgagcuggaggagcugcccgacgacaugcucgagauggccagccgcaucgacuccuacuacuucacgugcauccugaacuacgcggugagcuggggccuggucaucaucggccuccugaccgggcuccuguucaagaaguaccagcaccgguuccugaacguguacgccauguacugcgaggagugcgacauguaccacgacaaguccggccugaagcgccacggggacuucaccaacaagugccggcagugcacgugcggccaguacgaggacgccaccgggcucauggcccaccgcaagaccuacaacugccuggugcaguacaaggccaaguggaugaugaacuuccugaucaucuacaucuuccucauccugaucaaggacagcgcgaucgucgugcaggccgccggcaccgacuucacgaccugccuggagaccgagaacaucaacuggaacugcaccggccccuuccucaaccuggggaacugccagaagcagcagaagaaggagccguacaccaacaucgccacccagcugaagggccucaaggccaucuccgugcuggacauccccaucaucaccgggauccccgacgacaucgcgggcgcccugcgguacaucgaggagaaggaggacuuccacguccagcugaccaucgaguacgccaugcucagcaaguacugcgacuacuacacccaguucuccgacaacagcggguacucccagacgaccuggcgcguguaccugcggagccacgacuucgaggccugcauccuguaccccaaccagcacuucugccgcugcgugaagaacggcgagaagugcuccagcuccaacugggacuucgcgaacgagaugaaggacuucuacagcggcaagcagaccaaguucgacaaggaccucaaccuggcccugaccgcccuccaccacgccuuccgcgggacguccagcgccuacaucgcgaccaugcugagcaagaaguccaacgacgaccugaucgccuacaccaacaagaucaagaccaaguucccgggcaacgcccuccugaaggccaucaucgacuacaucgccuacaugaagucccugcccgggauggcgaacuucaaguacgacgaguucugggacgagcuccuguacaagcccaaccccgccaaggccagcaaccuggcccggggcaaggagagcuccuacaacuucaagcucgccaucagcuccaagagcaucaagacgugcaagaacgucaaggacguggcgugccuguccccgcgcagcggggccaucuacgccuccaucaucgccugcggcgagcccaacggccccagcguguaccggaagcccuccgggggcgucuuccagagcuccaccgaccgcagcaucuacugccugcucgacucccacugccuggaggaguucgaggcgaucagccaggaggagcuggacgccgugaagaaguccaagugcugggagaucgaguacccggacgugaagccccuccaggagggggacggcaccaagagcugccggaugaaggacagcggcaacugcaacgucgccaccaaccgcuggcccgugauccagugcgagaacgacaaguucuacuacuccgagcugcagaaggacuacgacaagacgcaggacaucgggcacuacugccugagccccggcugcaccaccgugcgguacccgaucaaccccaagcacaucuccaacugcaacuggcaggucagccgcuccagcaucgccaagaucgacgugcacaacaucgaggacaucgagcaguacaagaaggccaucacccagaagcuccagacgucccugagccuguucaaguacgcgaagaccaagaaccucccccacaucaagccgaucuacaaguacaucaccaucgaggggaccgagacggccgagggcaucgaguccgccuacaucgagagcgaggugcccgcccuggccgggaccuccaucggcuucaagaucaacagcaaggagggcaagcaccuccuggacgucaucgcguacgugaaguccgccagcuacuccagcguguacgccaagcuguacuccaccgggcccaccagcggcaucaacacgaagcacgacgagcugugcaccgggcccugcccggccaacaucaaccaccaggucggcuggcucaccuucgcccgggagcgcaccagcuccugggggugcgaggaguucggcugccuggcggugagcgacggcugcguguucggguccugccaggacaucaucaaggaggagcugagcgucuaccggaaggagacggaggaggugaccgacguggagcucugccugaccuucuccgacaagaccuacugcacgaaccugaaccccgucacccccaucaucaccgaccucuucgaggugcaguucaagaccguggagacguacagccugccccgcaucgucgccgugcagaaccacgagaucaagaucggccagaucaacgaccuggggguguacuccaagggcugcgggaacguccagaaggugaacggcaccguguacggcaacggggucccgcgguucgacuaccucugccaccuggccagccgcaaggaggugaucgugcggaagugcuucgacaacgacuaccaggccugcaaguuccugcagucccccgcgagcuaccgccucgaggaggacuccggcaccgucaccaucaucgacuacaagaagauccuggggaccaucaagaugaaggccauccugggcgacgugaaguacaagacguucgccgacagcguggacaucaccgccgagggguccugcaccggcugcaucaacugcuucgagaacauccacugcgagcucacccugcacacgaccaucgaggccagcugccccaucaaguccagcugcaccgucuuccacgaccggauccuggugacccccaacgagcacaaguacgcgcucaagauggugugcacggagaagccgggcaacacccugaccaucaaggucugcaacaccaagaucgaggccuccauggcccugguggacgccaagcccaucaucgagcucgcccccgucgaccagacggcguacauccgcgagaaggacgagcggugcaagaccuggaugugccgcgugcgcgacgaggggcuccaggugauccuggagcccuucaagaaccuguucggcagcuacaucgggaucuucuacaccuucaucaucuccaucgucgcccugcuggugaucaucuacgugcuccugccgaucugcuucaagcugcgggacacccuccgcaagcacgaggacgccuacaagcgggagaugaagauccgcuga

SEQ ID NO: 12676 - RNA, 4326 nt, Artificial Sequence
  derived and/or modified CDS sequence (opt1) from LACV(LACV/67/NY-M (67-8109))__GU206115.1__GP
augaucugcauccuggugcucaucaccgucgccgccgcgagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaccaucuacaacaaguccugcaagaagugcaagcugugcggccuggucuaccaccccuucaccgagugcgggacgcacugcgugugcggcgcccgcuacgacaccagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacgcccaucaacuccauggugcucggggagagcaaggagaccuucgagcuggaggaccugcccgacgacaugcucgagauggccucccggaucaacagcuacuaccugaccugcauccugaacuacgcgguguccuggggccucgucaucaucggccugcugaucgggcuccuguucaagaaguaccagcaccgcuuccugaacguguacgccauguacugcgaggagugcgacauguaccacgacaagagcggccucaagcggcacggggacuucaccaacaagugccgccagugcacgugcggccaguacgaggacgccgccgggcugauggcccaccggaagaccuacaacugccuggugcaguacaaggcgaaguggaugaugaacuuccucaucaucuacaucuuccugauccugaucaaggacuccgccaucgucgugcaggccgccggcaccgacuucaccacgugccucgagaccgagagcaucaacuggaacugcaccggccccuuccugaaccuggggaacugccagaagcagcagaagaaggagccguacaccaacaucgccacgcagcucaagggccugaaggcgaucuccgugcuggacguccccaucaucaccgggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccacguggcggguguaccugcgcagccacgacuucgaggcgugcauccucuaccccaaccagcacuucugccggugcgucaagaacggcgagaagugcuccagcuccaaccgcgacuucgccaacgagaugaaggacuacuacagcggcaagcagaccaaguucgacaaggaccugaaccuggcccucaccgcccugcaccacgccuuccgcgggaccagcuccgcguacaucgccacgaugcugagcaagaaguccaacgacgaccucaucgccuacaccaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccggggcaaggagagcuccuacaacuucaagcuggcgaucagcuccaagagcaucaagaccugcaagaacgugaaggacguggccugccuguccccgcgcagcggggccaucuacgccuccaucaucgcgugcggcgagcccaacggccccagcgucuaccggaagcccuccgggggcguguuccagagcuccacggaccagagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccgcaugaaggacuccgggaacugcaacguggccaccaaccgguggcccgugauccagugcgagaacgacaaguucuacuacagcgagcugcagaaggacuacgacaagacccaggacaucggccacuacugccucucccccgggugcacgaccguccgcuaccccaucaacccgaagcacaucagcaacugcaacuggcaggucucccggagcuccaucgccaagaucgacgugcacaacaucgaggacaucgagcaguacaagaaggcgaucacccagaagcugcagaccagccugucccucuucaaguacgccaagacgaagaaccugccccacaucaagcccaucuacaaguacaucaccaucgagggcaccgagaccgccgaggggaucgagagcgccuacaucgaguccgaggugccggcccuggcgggcacgagcaucggcuucaagaucaacuccaaggaggggaagcaccuccuggacgugaucgccuacgucaagagcgccuccuacagcuccguguacaccaagcuguacagcaccggccccaccagcgggaucaacacgaagcacgacgagcucugcaccggccccugccccgccaacaucaaccaccaggugggguggcugaccuucgcccgcgagcggaccuccagcuggggcugcgaggaguucggcugccuggcgguguccgacgggugcgucuucggcagcugccaggacaucaucaaggaggagcucuccguguaccgcaaggagacggaggaggugaccgacgucgagcugugccugaccuucagcgacaagaccuacugcacgaaccucaacccggugacccccaucaucaccgaccuguucgaggugcaguucaagaccgucgagacguacucccugccccggaucguggccgugcagaaccacgagaucaagaucgggcagaucaacgaccucggcgucuacagcaaggggugcggcaacgugcagaaggugaacggcaccaucuacgggaacggcgucccccgcuucgacuaccugugccaccuggccucccggaaggaggugaucgugcgcaagugcuucgacaacgacuaccaggccugcaaguuccuccagagcccggcguccuaccggcuggaggaggacagcgggaccgucaccaucaucgacuacaagaagauccugggcaccaucaagaugaaggccauccucggggacgugaaguacaagacguucgccgacuccguggacaucaccgccgagggcagcugcaccggcugcaucaacugcuucgagaacauccacugcgagcugacccugcacacgaccaucgaggccuccugccccaucaagagcuccugcaccgucuuccacgaccgcauccucgugacccccaacgagcacaaguacgcgcugaagauggugugcacggagaagcccgggaacacccugaccaucaaggucugcaacaccaagaucgaggccagcauggcccucguggacgccaagccgaucaucgagcuggcccccgucgaccagacggcguacauccgggagaaggacgagcgcugcaagaccuggaugugccgggugcgcgacgagggccuccaggugauccuggagcccuucaagaaccuguucggguccuacaucggcaucuucuacaccuucaucaucagcaucgucgcccugcucgugaucaucuacgugcugcugcccaucugcuucaagcuccgcgacacccugcggaagcacgaggacgccuacaagcgcgagaugaagauccgguga

SEQ ID NO: 12677 - RNA, 4326 nt, Artificial Sequence
  derived and/or modified CDS sequence (opt1) from LACV(LACV/74/NY-M (74-32813))__GU206142.1__GP
augauccgcaugcuggugcucaucgucgugaccgccgccagccccguguaccagcggugcuuccaggacggcgcgaucgucaagcagaacccguccaaggaggccgugaccgaggugugccugaaggacgacgucagcaugaucaagacggaggcccgcuacgugaagaacgccaccgggguguucuccaacaacgucgccauccggaaguggcuggugagcgacuggcacgacugccgccccaagaagaucgugggcgggcacaucaacgucaucgaggugggcgacgaccucucccugcacaccgagagcuacgugugcuccgcggacugcaccaucggggucgacaaggagacggcccaggugcggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgccugcuucaaccagcacaugagcugcgugcgcuuccugcaccggaccauccuccccggcuccaucgcgaacagcaucugccagaacaucgagaucaucauccuggucacccugacgcuccugaucuucauccugcucuccauccugagcaagaccuacaucugcuaccugcucaugccgaucuucauccccaucgccuacauguacggggugaucuacaacaaguccugcaagaagugcaagcugugcggccugguguaccaccccuucaccgagugcgggacccacugcgucugcggcgcccgcuacgacacgagcgaccggaugaagcuccaccgcgccuccggccugugccccggguacaagagccugcgggccgcgcgcgugaugugcaagagcaagggcccggccuccauccucagcaucaucaccgccguccuggugcugaccuucgugacccccaucaacuccaugguccucggggagagcaaggagacguucgagcuggaggagcugcccgacgacaugcucgagauggcccugcggaucaacuccuacuacuucacgugcauccugaacuacgccgugagcuggggccucaucaucgcgggccugcugguggggcucaucuucaagaaguaccagcaccgcuuccugaacaucuacgccauguacugcgaggagugcaacauguaccacgacaaguccggccugaagcggcacggggacuucaccaacaagugccgccagugcacgugcggccaguacgaggacgccaccgggcucaucacccaccggaagaccuacaacugccugguccaguacaaggccaaguggaugaugaacuuccugaucaucuacaucuuccucauccugaucaaggacagcgccaucguggugcaggcgaccggcaccgacuucacgaccugccuggagaccgaguccaucaacuggaacugcaccggccccuuccucaaccuggggaacugccagaagcagcagaagaaggagccguacaccaacaucgccacccagcugaagggccucaaggccaucagcguccuggacauccccaucaucaccuccauccccgacgacaucgccggggcccugcgcuacaucgaggagaaggaggacuuccacgugcagcugaccacggaguacgcgaugcucagcaaguacugcgacuacuacacccaguucuccgacaacagcggcuacucccagaccaccuggcggguguaccugcgcagccacgacuucgaggccugcauccuguaccccaaccagcacuucugcaagugcgucaagaacggggagaagugcuccagcuccaacugggacuucgccaacgagaugaagaacuacuacagcggcaagcaggccaaguucgacaaggaccucaaccuggcgcugacggcccuccaccacgccuuccggggcaccagcuccgccuacaucgccgcgaugcugagcaagaaguccaacgacgaccugaucgccuacaccaacaagaucaaggccaaguucccggggaacgcccuccugaaggccaucaucgacuacaucgcguacaugaagggccugcccgagauggccaacuucaaguacgacgaguucugggacgagcuccuguacaagcccaaccccgccaaggccagcaaccuggcccgcgggaaggaguccagcuacaacuucaagcucgcgaucuccagcaaguccaucaagaccugcaagaacgugaaggacguggccugccugagcccgcgcuccggcgccaucuacagcuccaucaucgccugcggggagcccaacggccccagcgucuaccggaagcccuccggcgggguguuccagagcuccacggaccgcagcaucuacugccugcucgacagccacugccuggaggaguucgaggcgaucucccaggaggagcuggacgccgugaagaaguccaagugcugggagaucgaguacccggacguccggccccuccaggagagcgacggcgccaagagcugccgcaugaaggacuccgggaacugcaacguggccaccaaccgguggcccgugaugcagugcgagaacgacaaguucuacuacagcgagcugcagaaggacuacgacaagacccaggacaucggccacuacugccugucccccggcugcaccacgauccgcuacccgaucaaccccaagcacaucagcaacugcaacuggcaggucucccggagcuccaucgccaagaucgacgugcacaacguggaggacaucgagcaguacaagaaggcgaucacccagaagcuccagaccagccugucccuguucaaguacgccaagaccaagaaccucccccacaucaagccgaucuacaaguacaucacgaucgaggggaccgagaccgccgagggcaucgagagcgccuacaucgaguccgagguccccgcccuggcggggaccagcgugggcuucaagaucaacuccaaggaggggaagcaccuccuggacgugaucgccuacgucaagagcgccuccuacagcagcguguacgccaagcuguacuccacgggccccaccagcggcaucaacaccaagcacgacgagcugugcaccgggcccugcccggccaacaucaaccaccaggugggcuggcucacguucgcgcgcgagcggaccuccagcugggggugcgaggaguucggcugccuggccgucuccgacgggugcguguucggcagcugccaggacaucaucaaggaggagcuguccguguaccgcaaggagaccgaggaggucaccaacguggagcucugccugacguucagcgacaagaccuacugcaccaaccugaaccccgugacccccaucaucacggaccucuucgagguccaguucaagaccguggagaccuacucccugccccggaucguggccguccagaaccacgagaucaagaucggccagaucaacgaccuggggguguacagcaagggcugcgggaacgugcagaaggucaacggcaccguguacgggaacggcgugccgcgcuucgacuaccucugccaccuggccucccggaaggaggucaucgugcgcaagugcuucgacaacgacuaccaggcgugcaaguuccugcagagccccgccuccuaccggcucgaggaggacagcggcacggugaccaucaucgacuacaagaagauccuggggaccaucaagaugaaggccauccugggcgacgucaaguacaagaccuucgccgacuccguggacaucaccgccgaggggagcugcgcgggcugcaucaacugcuucgagaacauccacugcgagcucacgcugcacaccaccaucgaggccuccugccccaucaagagcuccugcaccguguuccacgaccgcauccuggucacgcccaacgagcacaaguacgcccucaagauggugugcaccgagaagccggggaacacccugaccaucaaggucugcaacacgcggaucgaggccagcauggcccugguggacgcgaagcccaucaucgagcucgcccccguggaccagaccgccuacauccgcgagaaggacgagcggugcaagaccuggaugugccgcguccgcgacgagggccuccaggugauccuggagcccuucaagaaccuguucggcagcuacaucgggaucuucuacaccuucaucaucuccaucaucgcccugcuggugaucaucuacguccuccugccgaucugcuucaagcugcgggacacgcuccgcaagcacgacgacgccuacaagcgggagaugaagauccgcuga

SEQ ID NO: 12678 - RNA, 4326 nt, Artificial Sequence
  derived and/or modified CDS sequence (opt1) from LACV(LACV/93/MO-H)__GU206139.1__GP
augaucugcauccuggugcucaucaccgucgccgccgcgagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaucaucuacaacaaguccugcaagaagugcaagcugugcggccuggucuaccaccccuucaccgagugcgggacccacugcgugugcggcgcccgcuacgacacgagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacccccaucaacuccauggugcucggggagagcaaggagacguucgagcuggaggaccugcccgacgacaugcucgagauggccucccggaucaacagcuacuaccugaccugcauccugaacuacgcgguguccuggggccucgucaucaucggccugcugaucgggcuccuguucaagaaguaccagcaccgcuuccugaacaucuacgccauguacugcgaggagugcgacauguaccacgacaagagcggccucaagcggcacggggacuucaccaacaagugccgccagugcacgugcggccaguacgaggacgccgccgggcugauggcccaccggaagacguacaacugccuggugcaguacaaggcgaaguggaugaugaacuuccucaucaucuacaucuuccugauccugaucaaggacuccgccaucgugguccaggccgccggcaccgacuucacgaccugccucgagaccgagagcaucaacuggaacugcaccggccccuuccugaaccuggggaacugccagaagcagcagaagaaggagccguacaccaacaucgccacccagcucaagggccugaaggcgaucuccgugcuggacgugcccaucaucacggggauccccgacgacaucgccggcgcccugcgcuacaucgaggagaaggaggacuuccacguccagcucaccaucgaguacgccaugcugagcaaguacugcgacuacuacacccaguucuccgacaacagcggguacucccagaccaccuggcggguguaccugcgcagccacgacuucgaggcgugcauccucuaccccaaccagcacuucugccggugcgugaagaacggcgagaagugcuccagcuccaacuggggcuucgccaacgagaugaaggacuacuacagcgggaagcagacgaaguucgacaaggaccugaaccuggcccucaccgcccugcaccacgccuuccgcggcaccagcuccgcguacauggccaccaugcugagcaagaaguccaacgacgaccucaucgccuacacgaacaagaucaagaccaaguucccggggaacgcccugcugaaggccaucaucgacuacaucgcguacaugaagucccuccccggcauggccaacuucaaguacgacgaguucugggacgagcugcuguacaagcccaaccccgccaaggccagcaaccucgcccgcgggaaggagagcuccuacaacuucaagcuggcgaucagcuccaagagcaucaagaccugcaagaacgucaaggacguggccugccuguccccgcggagcggcgccaucuacgccuccaucaucgcgugcggcgagcccaacgggcccagcguguaccgcaagcccuccggcggggucuuccagagcuccaccgaccggagcaucuacugccuccuggacagccacugccuggaggaguucgaggccaucggccaggaggagcucgacgccgugaagaaguccaagugcugggagaucgaguacccggacgugaagcugauccaggagggcgacgggaccaagagcugccgcaugaaggacuccggcaacugcaacgucgccaccaaccgguggcccgugauccagugcgacaacgacaaguucuacuacagcgagcugcagaaggacuacgacaagacccaggacaucgggcacuacugccucucccccggcugcaccacggugcgcuaccccaucaacccgaagcacaucagcaacugcaacuggcaggucucccggagcuccaucgccaagaucgacgugcacaacaucgaggacaucgagcaguacaagaaggcgaucacccagaagcugcagaccagccugucccucuucaaguacgccaagaccaagaaccugccccacaucaagcccaucuacaaguacaucacgaucgaggggaccgagaccgccgagggcaucgagagcgccuacaucgaguccgaggugccggcccuggcgggcaccagcaucggguucaagaucaacuccaaggagggcaagcaccuccuggacgucaucgccuacgucaagagcgccuccuacagcuccguguacacgaagcuguacagcaccgggcccaccagcggcaucaacaccaagcacgacgagcucugcacggggcccugccccgccaacaucaaccaccaggacggcuggcugaccuucgcccgcgagcggaccuccagcuggggcugcgaggaguucgggugccuggcgguguccgacggcugcguguucgggagcugccaggacaucaucaaggaggagcucuccguguaccgcaaggagaccgaggaggucacggacguggagcugugccugaccuucagcgacaagaccuacugcaccaaccucaacccggugacgcccaucaucaccgaccuguucgagguccaguucaagaccguggagaccuacucccugccccggaucguggccguccagaaccacgagaucaagaucggccagaucaacgaccucgggguguacagcaagggcugcggcaacgugcagaaggucaacgggacgaucuacggcaacggggugccccgcuucgacuaccugugccaccuggccucccggaaggaggugaucguccgcaagugcuucgacaacgacuaccaggccugcaaguuccuccagagcccggcguccuaccggcuggaggaggacagcggcaccgugaccaucaucgacuacaagaagauccuggggaccaucaagaugaaggccauccucggcgacgugaaguacaagaccuucgccgacuccgucgacaucacggccgagggcagcugcaccgggugcaucaacugcuucgagaacauccacugcgagcugacccugcacaccacgaucgaggccuccugccccaucaagagcuccugcaccguguuccacgaccgcauccucgugacccccaacgagcacaaguacgcgcugaaggucgugugcaccgagaagcccggcaacacgcugaccaucgaggugugcaacaccaagaucgaggccagcauggcccucgucgacgccaagccgaucaucgagcuggcccccguggaccagaccacguacauccgggagaaggacgagcgcugcaagaccuggaugugccggguccgcgacgaggggcuccaggugauccuggagcccuucaagaaccuguucggcuccuacaucggcaucuucuacaccuucaucaucagcaucguggcgcugcucgucaucaucuacgugcugcugcccaucugcuucaagcuccgcgacacccugcggaagcacgaggacgccuacaagcgcgagaugaagauccgguga

SEQ ID NO: 12679 - RNA, 4326 nt, Artificial Sequence
  derived and/or modified CDS sequence (opt1) from LACV(LACV/95/OH-H (CCH-MB96))__GU206136.1__GP
augauccgcauccuggugcucaucgccgucaccgccgcgagccccguguaccagcggugcuuccaggacggcgccaucgugaagcagaacccguccaaggaggccgucaccgaggugugccugaaggacgacgugagcaugaucaagacggaggcccgcuacauccggaacgccaccggggucuucuccaacaacguggcgauccgcaaguggcuggugagcgacuggcacgacugccggcccaagaagaucaucggcgggcacaucaacgucaucgaggugggcgacgaccucucccugcacaccgagagcuacgugugcuccgccgacugcaccaucggggucgacaaggagacggcccaggugcgccugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgguuccugcaccgcaccauccuccccggcuccaucgccaacagcaucugccagaacaucgagaucaucauccuggucacccugacgcuccugaucuucauccugcucuccauccugagcaagaccuacaucugcuaccugcucaugccgaucuucauccccaucgccuacguguacgggaucaucuacaacaaguccugcaagaagugcaagcugugcggccugguguaccaccccuucaccgagugcgggacccacugcgucugcggcgcccgguacgacacgagcgaccgcaugaagcuccaccgggccuccggccugugccccggguacaagagccugcgcgcggcccgggugaugugcaagagcaagggcccggccuccauccucagcaugaucaccgccgugcugguccugaccuucgugacccccaucaacuccaugguccucggggagagcaaggagacguucgagcuggaggagcugcccgacgacaugcucgagauggugucccgcaucaacagcuacuacuucacgugcauccugaacuacgccguguccuggggccugaucaucaucggccuccugaccgggcuccuguucaagaaguaccagcaccgguuccugaacgucuacgcgauguacugcgaggagugcgacauguaccacgacaagagcggccugaagcgccacggggacuucaccaacaagugccggcagugcacgugcggccaguacgaggacgccgccgggcucauggcccaccgcaagaccuacaacugccuggugcaguacaaggccaaguggaugaugaacuuccugaucaucuacaucuuccucauccugaucaaggacuccgcgaucgugguccaggccgccggcaccgacuucacgaccugccuggagaccgagagcaucaacuggaacugcaccggccccuuccucaaccuggggaacugccagaagcagcagaagaaggagccguacaccaacaucgccacccagcugaagggccucaaggccaucuccgugcuggacauccccaucaucaccgggauccccgacgacaucgcgggcgcccugcgguacaucgaggagcgcgaggacuuccacgugcagcugaccaucgaguacgccaugcucagcaaguacugcgacuacuacacccaguucuccgacaacagcggguacucccagaccacguggcgggucuaccugcgcagccacgacuucgaggccugcauccuguaccccaaccagcacuucugccgcugcgugaagaacggcgagaagugcuccagcuccaacuggggcuucgcgaacgagaugaaggacuucuacagcgggaagcagaccaaguucgacaaggaccucaaccuggcccugaccgcccuccaccacgccuuccggggcaccagcuccgccuacaucgcgacggugcugagcaagaaguccaacgacgaccugaucgccuacaccaacaagaucaagaccaaguucccggggaacgcccuccugaaggccaucaucgacuacaucgccuacaugaagucccugcccggcauggcgaacuucaaguacgacgaguucugggacgagcuccuguacaagcccaaccccgccaaggccagcaaccuggcccgcgggaaggagagcuccuacaacuucaagcucgccaucagcuccaagagcaucaagaccugcaagaacgucaaggacguggcgugccuguccccgcggagcggcgccaucuacgccuccaucaucgccugcggcgagcccagcgggcccuccguguaccgcaagcccccgggcggggucuuccagagcuccacggaccggagcaucuacugccugcucgacagccacugccuggaggaguucgaggcgaucucccaggaggagcuggacgccgugaagaaguccaagugcugggagaucgaguaccccgacgugaagccccuccaggagagcgacggcaccaagagcugccgcaugaaggacuccggcaacugcaacgucgccaccaaccgguggcccgugauccagugcgagaacgacaaguucuacuacagcgagcugcagaaggacuacgacaagacccaggacaucgggcacuacugccuguccccgggcugcacgaccgugcgcuaccccaucaaccccaagcacaucagcaacugcaacuggcaggucucccggagcuccaucgccaagaucgacgugcacaacaucgaggacaucgagcaguacaagaaggccaucacccagaagcuccagaccagccugucccuguucaaguacgcgaagacgaagaaccucccgcacaucaagcccaucuacaaguacaucaccaucgaggggaccgagaccgccgagggcaucgagagcgccuacaucgaguccgaggugcccgcccuggccgggacgagcaucggcuucaagaucaacuccaaggagggcaagcaccuccuggacgucaucgcguacgucaagagcgccuccuacagcagcguguacaccaagcuguacuccaccgggcccaccagcggcaucaacacgaagcacgacgagcugugcaccgggccgugccccgccaacaucaaccaccaggugggcuggcucaccuucgcccgcgagcggaccuccagcugggggugcgaggaguucggcugccuggccguguccgacggcugcguguucgggagcugccaggacaucaucaaggaggagcuguccgucuaccgcaaggagacggaggaggugaccgacguggagcucugccugaccuucagcgacaagaccuacugcacgaaccugaaccccgucacccccaucaucaccgaccucuucgaggugcaguucaagaccguggagacguacucccugccgcggaucgucgcggugcagaaccacgagaucaagaucggccagaucaacgaccuggggguguacagccgcggcugcgggaacguccagaaggugaacggcaccguguacggcaacggggucccccgguucgacuaccucugccaccuggccucccgcaaggaggugaucgugcggaagugcuucgacaacgacuaccaggccugcaaguuccugcagagccccgccuccuaccgccucgaggaggacagcggcaccgucaccaucaucgacuacaagaagauccuggggaccaucaagaugaaggcgauccugggcgacgugaaguacaagacguucgccgacuccguggacaucaccgccgaggggagcugcaccggcugcaucaacugcuucgagaacauccacugcgagcucacccugcacacgaccaucgaggccuccugccccaucaagagcuccugcaccgucuuccacgaccggauccuggugaccccgaacgagcacaaguacgcccucaagauggugugcacggagaagcccggcaacacccugaccaucaaggucugcaacaccaagaucgaggcgagcauggcccugguggacgccaagcccaucaucgagcucgcccccgucgaccagacggccuacauccgcgagaaggacgagcgcugcaagaccuggaugugccgggugcgcgacgaggggcuccaggugauccuggagccguucaagaaccuguucggcagcuacaucgggaucuucuacaccuucaucaucuccaucgucgcgcugcuggugaucaucuacgugcuccugcccaucugcuucaagcugcgggacacccuccgcaagcacgaggacgccuacaagcgggagaugaagauccgcuga

SEQ ID NO: 12680 - RNA, 4326 nt, Artificial Sequence
  derived and/or modified CDS sequence (opt1) from LACV(LACV/95/WV-H)__GU206133.1__GP
augaucugcauccuggugcucaucaccgucgccgccgcgagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaccaucuacaacaaguccugcaagaagugcaagcugugcggccuggucuaccaccccuucaccgagugcgggacgcacugcgugugcggcgcccgcuacgacaccagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacgcccaucaacuccauggugcucggggagagcaaggagaccuucgagcuggaggaccugcccgacgacaugcucgagauggccucccggaucaacagcuacuaccugaccugcauccugaacuacgcgguguccuggggccucgucaucaucggccugcugaucgggcuccuguucaagaaguaccagcaccgcuuccugaacguguacgccauguacugcgaggagugcgacauguaccacgacaagagcggccucaagcggcacggggacuucaccaacaagugccgccagugcacgugcggccaguacgaggacgccgccgggcugauggcccaccggaagaccuacaacugccuggugcaguacaaggcgaaguggaugaugaacuuccucaucaucuacaucuuccugauccugaucaaggacuccgccaucgucgugcaggccgccggcaccgacuucaccacgugccucgagaccgagagcaucaacuggaacugcaccggccccuuccugaaccuggggaacugccagaagcagcagaagaaggagccguacaccaacaucgccacgcagcucaagggccugaaggcgaucuccgugcuggacguccccaucaucaccgggauccccgacgacaucgccggcgcccugcgcuacaucgaggagaaggaggacuuccacgugcagcucaccaucgaguacgccaugcugagcaaguacugcgacuacuacacccaguucuccgacaacagcggguacucccagaccacguggcggguguaccugcgcagccacgacuucgaggcgugcauccucuaccccaaccagcacuucugccggugcgucaagaacggcgagaagugcuccagcuccaacugggacuucgccaacgagaugaaggacuacuacagcggcaagcagaccaaguucgacaaggaccugaaccuggcccucaccgcccugcaccacgccuuccgcgggaccagcuccgcguacaucgccacgaugcugagcaagaaguccaacgacgaccucaucgccuacaccaacaagaucaagaccaaguucccgggcaacgcccugcugaaggccaucaucgacuacaucgcguacaugaagucccuccccgggauggccaacuucaaguacgacgaguucugggacgagcugcuguacaagcccaaccccgccaaggccagcaaccucgcccgcggcaaggagagcuccuacaacuucaagcuggcgaucagcuccaagagcaucaagaccugcaagaacgugaaggacguggccugccuguccccgcggagcggggccaucuacgccuccaucaucgcgugcggcgagcccaacggccccagcgucuaccgcaagcccuccgggggcguguuccagagcuccacggaccagagcaucuacugccuccuggacagccacugccuggaggaguucgaggccaucgggcaggaggagcucgacgccgugaagaaguccaagugcugggagaucgaguacccggacgucaagcugauccaggagggcgacggcaccaagagcugccggaugaaggacuccgggaacugcaacguggccaccaaccgcuggcccgugauccagugcgagaacgacaaguucuacuacagcgagcugcagaaggacuacgacaagacccaggacaucggccacuacugccucucccccgggugcacgaccguccgguaccccaucaacccgaagcacaucagcaacugcaacuggcaggucucccgcagcuccaucgccaagaucgacgugcacaacaucgaggacaucgagcaguacaagaaggcgaucacccagaagcugcagaccagccugucccucuucaaguacgccaagacgaagaaccugccccacaucaagcccaucuacaaguacaucaccaucgagggcaccgagaccgccgaggggaucgagagcgccuacaucgaguccgaggugccggcccuggcgggcacgagcaucggcuucaagaucaacuccaaggaggggaagcaccuccuggacgugaucgccuacgucaagagcgccuccuacagcuccguguacaccaagcuguacagcaccggccccaccagcgggaucaacacgaagcacgacgagcucugcaccggccccugccccgccaacaucaaccaccaggugggguggcugaccuucgcccgggagcgcaccuccagcuggggcugcgaggaguucggcugccuggcgguguccgacgggugcgucuucggcagcugccaggacaucaucaaggaggagcucuccguguaccggaaggagacggaggaggugaccgacgucgagcugugccugaccuucagcgacaagaccuacugcacgaaccucaacccggugacccccaucaucaccgaccuguucgaggugcaguucaagaccgucgagacguacucccugccccgcaucguggccgugcagaaccacgagaucaagaucgggcagaucaacgaccucggcgucuacagcaaggggugcggcaacgugcagaaggugaacggcaccaucuacgggaacggcgucccccgguucgacuaccugugccaccuggccucccgcaaggaggugaucgugcggaagugcuucgacaacgacuaccaggccugcaaguuccuccagagcccggcguccuaccgccuggaggaggacagcgggaccgucaccaucaucgacuacaagaagauccugggcaccaucaagaugaaggccauccucggggacgugaaguacaagacguucgccgacuccguggacaucaccgccgagggcagcugcaccggcugcaucaacugcuucgagaacauccacugcgagcugacccugcacacgaccaucgaggccuccugccccaucaagagcuccugcaccgucuuccacgaccggauccucgugacccccaacgagcacaaguacgcgcugaagauggugugcacggagaagcccgggaacacccugaccaucaaggucugcaacaccaagaucgaggccagcauggcccucguggacgccaagccgaucaucgagcuggcccccgucgaccagacggcguacauccgcgagaaggacgagcggugcaagaccuggaugugccgcgugcgggacgagggccuccaggugauccuggagcccuucaagaaccuguucggguccuacaucggcaucuucuacaccuucaucaucagcaucgucgcccugcucgugaucaucuacgugcugcugcccaucugcuucaagcuccgcgacacccugcgcaagcacgaggacgccuacaagcgggagaugaagauccgcuga

SEQ ID NO: 12681 - RNA, 4326 nt, Artificial Sequence
  derived and/or modified CDS sequence (opt1) from LACV(LACV/96/WV-M (WV96-3955))__GU206145.1__GP
augaucuacauccuggugcucaucgccgucaccgccgcgagccccguguaccagcgcugcuuccaggacggcgccaucgugaagcagaacccguccaaggaggccgucaccgaggugugccugaaggacgacgugagcaugaucaagacggaggcccgguacauccgcaacgccaccggggucuucuccaacaacguggcgauccggaaguggcuggugagcgacuggcacgacugccgccccaagaagaucaccggcgggcacaucaacgucaucgaggugggcgacgaccucucccugcacaccgagagcuacgugugcuccgccgacugcacgaucggggucgacaaggagaccgcccaggugcggcugcagaccgacaccacgaaccacuucgagaucgccggcaccaccgucaagagcggcugguucaaguccaccacguacaucacccucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggucacgcugacccuccugaucuucauccugcucuccauccugagcaagaccuacaucugcuaccugcucaugccgaucuucauccccaucgccuacguguacgggaucaucuacaacaaguccugcaagaagugcaagcugugcggccugguguaccaccccuucaccgagugcgggacgcacugcgucugcggcgcccgcuacgacaccagcgaccggaugaagcuccaccgcgccuccggccugugccccggguacaagagccugcgggcggcccgcgugaugugcaagagcaagggcccggccuccauccucagcaucaucaccgccgugcugguccugaccuucgugacgcccaucaacuccaugguccucggggagagcaaggagguguucgagcuggaggagcugcccgacgacaugcucgagauggcccugcggaucaacuccuacuacuucacgugcauccugaacuacgcggugagcuggggccucaucaucaucggccugcugaccgggcuccuguucaagaaguaccagcaccgcuuccugaacaucuacgccauguacugcgaggagugcgacauguaccacgacaaguccggccucaagcggcacggggacuucaccaacaagugccgccagugcacgugcggccaguacgaggacgccgccgggcugaugacccaccggaagaccuacaacugccugguccaguacaaggccaaguggaucaugaacuuccucaucguguacaucuuccugauccugaucaaggacagcgcgaucaucgugcgcgccgccggcaccgacuucuccagcugccucgagaccgagaucaucaacuggaacugcaccggccccuuccugaaccuggggaacugccagcggcagcagaagaaggagccguacgccaacaucgccgcgcagcucaagggccugaaggccaucuccguccuggacauccccaugaucaccgagauccccgacgacaucgccagcgcccugcgcuacaucgaggagcgggaggcguuccacgugcagcucaccgccgaguacgccaugcugucccgcuacugcgacuacuacacgcaguucagcgacaacuccggguacagccagaccaccuggcgcguguaccugcggucccacgacuucgaggccugcauccucuaccccaaccagcacuucugccgcugcgucaagaacggcgagaagugcagcuccgccaacugggacuucgcgaacgagaugaaggacuacuacagcgggaagcaggccaaguucgacaaggaccugaaccuggcccucaccgccaugcaccacgccuuccggggcaccagcuccgcguacauggccgccaugcugagcaagaaguccaacgacgaccugaucacguacaccaacaagcucaagaccaaguucccgggcaacgcccugcugaaggccaucaucgacuacaucgcguacaugaaggggcuccccggcauggccaacuucaagcacgacgaguucugggacgagcugcuguacaagcccacccccacgaaggccccgaaccucgcccgcgggcgggagagcuccuacaacuucgagcuggcgaucagcuccaagagcaucaagaccugcaagaacgugaaggacguggccugccugagcccccgcagcggcgccaucuacgccuccaucaucgccugcggggagcccaacggccccagcgucuaccggaagccguccggcgggguguuccagagcuccaccgaccagagcauguacugccuccuggacucccacugccuggaggaguucgaggcgaucagccaggaggagcucgacgccgugaagaaguccaagugcugggagaucgaguaccccgacgucaagcugcugcaggagaacgacggcaccaaguccugccgcaugaaggacagcgggaacugcaacguggccacgaaccgguggcccgugauccagugcgagaacgacaaguucuacuacuccgagcuccagaaggacuacgacaagacccaggacaucggccacuacugccugagccccggcugcgccaccauccgcuacccgaucaaccccaagcacaucuccaacugcaacuggcaggucagccgguccagcaucgccaagaucgacgugcacaacaucgaggacaucgagcaguacaagaaggcgaucacccagaagcugcagacgucccucagccuguucaaguacgccaagaccaagaaccugccccacaucaagccgaucuacaaguacaucaccaucgaggggaccgagacggccgagggcaucgaguccgccuacaucgagagcgaggugcccgcccucgcggggaccuccaucggcuucaagaucaacagcaaggaggggaagcaccuccuggacgucaucgccuacgugaaguccgccagcuacuccagcguguacaccaagcuguacuccaccggccccacgagcggcgucaacaccaagcacgacgagcugugcaccgggcccugcccggccaacaucaaccaccaggugggcuggcugaccuucgcgcgcgagcggacgagcuccugggggugcgaggaguucggcugccucgccgugagcgacgggugcgucuucggcuccugccaggacaucaucaaggaggagcugagcguguaccgcaaggagaccgaggaggugaccgacgucgagcugugccucaccuucuccgacaagacguacugcaccaaccugaaccccgugacccccaucaucaccgaccuguucgaggugcaguucaagacggucgagaccuacagccucccccggaucguggccgugcagaaccacgagaucaagaucggccagaucaacgaccugggggucuacuccaagggcugcgggaacgugcagaaggugaacggcaccaucuacgggaacggcgucccgcgcuucgacuaccugugccaccucgccagccggaaggaggugaucgugcgcaagugcuucgacaacgacuaccaggccugcaaguuccugcagucccccgcgagcuaccggcuggaggaggacuccggcaccgucacgaucaucgacuacaagaagauccucgggaccaucaagaugaaggccauccugggcgacgugaaguacaagaccuucgccgacaacguggacaucaccgccgaggggagcugcaccggcugcaucaacugcuucgagaacauccacugcgagcugacgcuccacaccaccaucgaggccuccugccccaucaagagcuccugcaccgucuuccacgaccgcauccuggugacgcccaacgagcacaaguacgcgcugaagguggucugcaccgagaagccggggaacacccucaccaucaaggugugcaacacgaagaucgaggccgccauggcccugguggacgccaagcccaucaucgagcuggcgcccgucgaccagaccgccuacauccgcgagaaggacgagcggugcaagaccuggaugugccgcgugcgggacgagggccuccaggucauccuggagcccuucaagaaccuguucggcagcuacaucgggaucuucuacaccuucaucaucuccaucguggcccuccuggugaucaucuacauccugcucccgaucugcuucaagcugcgcgacacgcugcggaagcacgaggacgccuacaagcgcgagaugaagauccgguga

SEQ ID NO: 12682 - RNA, 4326 nt, Artificial Sequence
  derived and/or modified CDS sequence (opt1) from LACV(LACV/97/NC-M (NC97-7306))__GU206127.1__GP
augauccgcauccuggugcucaucgccgucaccgccgcgagccccguguaccagcggugcuuccaggacggcgccaucgugaagcagaacccguccaaggaggccgucaccgaggugugccugaaggacgacgugagcaugaucaagacggaggcccgcuacauccggaacgccaccggggucuucuccaacaacguggcgauccgcaaguggcuggugagcgacuggcacgacugccggcccaagaagaucaucggcgggcacaucaacgucaucgaggugggcgacgaccucucccugcacaccgagagcuacgugugcuccgccgacugcaccaucggggucgacaaggagacggcccaggugcgccugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgguuccugcaccgcaccauccuccccggcuccaucgccaacagcaucugccagaacaucgagaucaucauccuggucacccugacgcuccugaucuucauccugcucuccauccugagcaagaccuacaucugcuaccugcucaugccgaucuucauccccaucgccuacguguacgggaucaucuacaacaaguccugcaagaagugcaagcugugcggccugguguaccaccccuucaccgagugcgggacccacugcgucugcggcgcccgguacgacacgagcgaccgcaugaagcuccaccgggccuccggccugugccccggguacaagagccugcgcgcggcccgggugaugugcaagagcaagggcccggccuccauccucagcaugaucaccgccgugcugguccugaccuucgugacccccaucaacuccaugguccucggggagagcaaggagacguucgagcuggaggagcugcccgacgacaugcucgagauggugucccgcaucaacagcuacuacuucacgugcauccugaacuacgccguguccuggggccugaucaucaucggccuccugaccgggcuccuguucaagaaguaccagcaccgguuccugaacgucuacgcgauguacugcgaggagugcgacauguaccacgacaagagcggccugaagcgccacggggacuucaccaacaagugccggcagugcacgugcggccaguacgaggacgccgccgggcucauggcccaccgcaagaccuacaacugccuggugcaguacaaggccaaguggaugaugaacuuccugaucaucuacaucuuccucauccugaucaaggacuccgcgaucgugguccaggccgccggcaccgacuucacgaccugccuggagaccgagagcaucaacuggaacugcaccggccccuuccucaaccuggggaacugccagaagcagcagaagaaggagccguacaccaacaucgccacccagcugaagggccucaaggccaucuccgugcuggacauccccaucaucaccgggauccccgacgacaucgcgggcgcccugcgguacaucgaggagcgcgaggacuuccacgugcagcugaccaucgaguacgccaugcucagcaaguacugcgacuacuacacccaguucuccgacaacagcggguacucccagaccacguggcgggucuaccugcgcagccacgacuucgaggccugcauccuguaccccaaccagcacuucugccgcugcgugaagaacggcgagaagugcuccagcuccaacugggacuucgcgaacgagaugaaggacuucuacagcggcaagcagaccaaguucgacaaggaccucaaccuggcccugaccgcccuccaccacgccuuccgggggaccagcuccguguacaucgccacgaugcugagcaagaaguccaacgacgaccugaucgcguacaccaacaagaucaagaccaaguucccgggcaacgcccuccugaaggccaucaucgacuacaucgccuacaugaagucccugcccgggauggccaacuucaaguacgacgaguucugggacgagcuccuguacaagcccaaccccgcgaaggccagcaaccuggcccgcggcaaggagagcuccuacaacuucaagcucgccaucagcuccaagagcaucaagaccugcaagaacgucaaggacguggccugccuguccccgcggagcggggcgaucuacgccuccaucaucgccugcggcgagcccaacggccccagcguguaccgcaagcccccgggcggggucuuccaguccagcacggaccgguccaucuacugccugcucgacagccacugccuggaggaguucgaggccaucagccaggaggagcuggacgcggugaagaaguccaagugcugggagaucgaguaccccgacgugaagccccuccaggagagcgacgggaccaaguccugccgcaugaaggacagcggcaacugcaacgucgccaccaaccgguggcccgugauccagugcgagaacgacaaguucuacuacuccgagcugcagaaggacuacgacaagacccaggacaucggccacuacugccugagcccggggugcacgaccgugcgcuaccccaucaaccccaagcacaucuccaacugcaacuggcaggucagccgguccagcaucgccaagaucgacgugcacaacaucgaggacaucgagcaguacaagaaggccaucacccagaagcuccagaccucccugagccuguucaaguacgccaagacgaagaaccucccgcacaucaagcccaucuacaaguacaucaccaucgagggcaccgagaccgcggaggggaucgaguccgccuacaucgagagcgaggugcccgcccuggccggcacguccaucggguucaagaucaacagcaaggagggcaagcaccuccuggacgucaucgccuacgugaaguccgcgagcuacuccagcguguacaccaagcuguacagcaccggccccaccuccgggaucaacacgaagcacgacgagcugugcaccggcccgugccccgccaacaucaaccaccaggucggguggcucaccuucgcccgcgagcggaccagcuccuggggcugcgaggaguucgggugccuggccgugagcgacggcugcguguucggcuccugccaggacaucaucaaggaggagcugagcgucuaccgcaaggagacggaggaggugaccgacguggagcucugccugaccuucuccgacaagaccuacugcacgaaccugaaccccgucacccccaucaucaccgaccucuucgaggugcaguucaagaccguggagacguacagccugccgcggaucgucgccgugcagaaccacgagaucaagaucgggcagaucaacgaccugggcguguacuccaaggcgugcgggaacguccagaaggugaacggcaccguguacgggaacggcgucccccgcuucgacuaccucugccaccuggccagccggaaggaggugaucgugcgcaagugcuucgacaacgacuaccaggccugcaaguuccugcagucccccgccagcuaccggcucgaggaggacuccggcaccgucaccaucaucgacuacaagaagauccuggggaccaucaagaugaaggcgauccugggcgacgugaaguacaagacguucgccgacagcguggacaucaccgccgagggguccugcaccggcugcaucaacugcuucgagaacauccacugcgagcucacccugcacacgaccaucgaggccagcugccccaucaaguccagcugcaccgucuuccacgaccgcauccuggugaccccgaacgagcacaaguacgcccucaagauggugugcacggagcggcccgggaacacccugaccaucaaggucugcaacaccaagaucgaggcguccauggcccugguggacgccaagcccaucaucgagcucgcccccgucgaccagacggccuacauccgcgagaaggacgagcgcugcaagaccuggaugugccgggugcgcgacgagggccuccaggugauccuggagccguucaagaaccuguucggcagcuacaucgggaucuucuacaccuucaucaucagcaucgucgcgcugcuggugaucaucuacgugcuccugcccaucugcuucaagcugcgggacacccuccgcaagcacgaggacgccuacaagcgggagaugaagauccgcuga

SEQ ID NO: 12683 - RNA, 4326 nt, Artificial Sequence
  derived and/or modified CDS sequence (opt1) from LACV(LACV/human/1960)__EF485031.1__GP
augaucugcauccuggugcucaucaccgucgccgccgcgagccccguguaccagcgcugcuuccaggacggcgccaucgugaagcagaacccguccaaggaggccgucaccgaggugugccugaaggacgacgugagcaugaucaagacggaggcccgguacguccgcaacgccaccgggguguucuccaacaacguggcgauccggaaguggcuggucagcgacuggcacgacugccgccccaagaagaucgugggcgggcacaucaacgugaucgaggucggcgacgaccucucccugcacaccgagagcuacgugugcuccgccgacugcaccaucgggguggacaaggagacggcccagguccggcugcagaccgacaccaccaaccacuucgagaucgccggcacgaccgucaagagcggcugguucaaguccaccaccuacaucacgcucgaccagaccugcgagcaccugaaggugagcugcgggcccaaguccgugcaguuccacgcgugcuucaaccagcacaugagcugcgugcgcuuccugcaccggaccauccuccccggcuccaucgccaacagcaucugccagaacaucgagaucaucauccuggugacccugacgcuccugaucuucauccugcucuccauccugagcaagaccuacaucugcuaccugcucaugccgaucuucauccccaucgccuacaucuacgggaccaucuacaacaaguccugcaagaagugcaagcugugcggccuggucuaccaccccuucaccgagugcgggacgcacugcgugugcggcgcccgcuacgacaccagcgaccggaugaagcuccaccgcgccuccggccugugccccggguacaagagccugcgggcggcccgcgugaugugcaagagcaagggcccggccuccauccucagcaucaucaccgccguccuggugcugaccuucgucacgcccaucaacuccauggugcucggggagagcaaggagaccuucgagcuggaggaccugcccgacgacaugcucgagauggccucccggaucaacagcuacuaccugaccugcauccugaacuacgcgguguccuggggccucgucaucaucggccugcugaucgggcuccuguucaagaaguaccagcaccgcuuccugaacguguacgccauguacugcgaggagugcgacauguaccacgacaagagcggccucaaggggcacggcgacuucaccaacaagugccggcagugcacgugcgggcaguacgaggacgccgccggccugauggcccaccgcaagaccuacaacugccuggugcaguacaaggcgaaguggaugaugaacuuccucaucaucuacaucuuccugauccugaucaaggacuccgccaucgucgugcaggccgccggcaccgacuucaccacgugccucgagaccgagagcaucaacuggaacugcaccgggcccuuccugaaccugggcaacugccagaagcagcagaagaaggagccguacaccaacaucgccacgcagcucaaggggcugaaggcgaucuccgugcuggacguccccaucaucaccggcauccccgacgacaucgccggggcccugcgguacaucgaggagaaggaggacuuccacgugcagcucaccaucgaguacgccaugcugagcaaguacugcgacuacuacacccaguucuccgacaacagcggcuacucccagaccacguggcgcguguaccugcggagccacgacuucgaggcgugcauccucuaccccaaccagcacuucugccgcugcgucaagaacggcgagaagugcuccagcuccaacugggacuucgccaacgagaugaaggacuacuacagcgggaagcagaccaaguucgacaaggaccugaaccuggcccucaccgcccugcaccacgccuuccggggcaccagcuccgcguacaucgccacgaugcugagcaagaaguccaacgacgaccucaucgccuacaccaacaagaucaagaccaaguucccgggggacgcccugcugaaggccaucaucgacuacaucgcguacaugaagucccuccccggcauggccaacuucaaguacgacgaguucugggacgagcugcuguacaagcccaaccccgccaaggccagcaaccucgcccgcgggaaggagagcuccuacaacuucaagcuggcgaucagcuccaagagcaucaagaccugcaagaacgugaaggacguggccugccuguccccgcgcagcggcgccaucuacgccuccaucaucgcgugcggcgagcccaacgggcccagcgucuaccggaagcccuccggcgggguguuccagagcuccacggaccagagcaucuacugccuccuggacagccacugccuggaggaguucgaggccaucggccaggaggagcucgacgccgugaagaaguccaagugcugggagaucgaguacccggacgucaagcugauccaggagggcgacgggaccaagagcugccgcaugaaggacuccggcaacugcaacguggccaccaaccgguggcccgugauccagugcgagaacgacaaguucuacuacagcgagcugcagaaggacuacgacaagacccaggacaucgggcacuacugccucucccccggcugcacgaccguccgcuaccccaucaacccgaagcacaucagcaacugcaacuggcaggucucccggagcuccaucgccaagaucgacgugcacaacaucgaggacaucgagcaguacaagaaggcgaucacccagaagcugcagaccagccugucccucuucaaguacgccaagacgaagaaccugccccacaucaagcccaucuacaaguacaucaccaucgaggggaccgagaccgccgagggcaucgagagcgccuacaucgaguccgaggugccggcccuggcgggcacgagcaucggguucaagaucaacuccaaggagggcaagcaccuccuggacgugaucgccuacgucaagagcgccuccuacagcuccguguacaccaagcuguacagcaccgggcccaccagcggcaucaacacgaagcacgacgagcucugcaccgggcccugccccgccaacaucaaccaccaggugggcuggcugaccuucgcccgcgagcggaccuccagcuggggcugcgaggaguucgggugccuggcgguguccgacggcugcgucuucgggagcugccaggacaucaucaaggaggagcucuccguguaccgcaaggagacggaggaggugaccgacgucgagcugugccugaccuucagcgacaagaccuacugcacgaaccucaacccggugacccccaucaucaccgaccuguucgaggugcaguucaagaccgucgagacguacucccugccccggaucguggccgugcagaaccacgagaucaagaucggccagaucaacgaccucggggucuacagcaagggcugcggcaacgugcagaaggugaacgggaccaucuacggcaacggggucccccgcuucgacuaccugugccaccuggccucccggaaggaggugaucgugcgcaagugcuucgacaacgacuaccaggccugcaaguuccuccagagcccggcguccuaccggcuggaggaggacagcggcaccgucaccaucaucgacuacaagaagauccuggggaccaucaagaugaaggccauccucggcgacgugaaguacaagacguucgccgacuccguggacaucaccgccgagggcagcugcaccgggugcaucaacugcuucgagaacauccacugcgagcugacccugcacacgaccaucgaggccuccugccccaucaagagcuccugcaccgucuuccacgaccgcauccucgugacccccaacgagcacaaguacgcgcugaagauggugugcacggagaagcccggcaacacccugaccaucaaggucugcaacaccaagaucgaggccagcauggcccucguggacgccaagccgaucaucgagcuggcccccgucgaccagacggcguacauccgggagaaggacgagcgcugcaagaccuggaugugccgggugcgcgacgaggggcuccaggugauccuggagcccuucaagaaccuguucggcuccuacaucggcaucuucuacaccuucaucaucagcaucgucgcccugcucgugaucaucuacgugcugcugcccaucugcuucaagcuccgggacacccugcgcaagcacgaggacgccuacaagcgcgagaugaagauccgguga

SEQ ID NO: 12684 - RNA, 4326 nt, Artificial Sequence
  derived and/or modified CDS sequence (opt1) from LACV(LACV/mosquito/1978)__EF485037.1__GP
augauccgcauccuggugcucaucgccgucaccgccgcgagccccguguaccagcggugcuuccaggacggcgccaucgugaagcagaacccguccaaggaggccgucaccgaggugugccugaaggacgacgugagcaugaucaagacggaggcccgcuacguccggaacgccaccgggguguucuccaacaacguggcgauccgcaaguggcuggucagcgacuggcacgacugccggcccaagaagaucaucggcgggcacaucaacgugaucgagguguccgacgaccucagccugcacaccgaguccuacgucugcagcgccgacugcaccaucggcguggacaaggagacggcccaggugcgccugcagaccgacaccaccaaccacuucgagaucgccgggacgaccgucaaguccggcugguucaagagcaccaccuacaucacgcucgaccagaccugcgagcaccugaagguguccugcggccccaagagcgugcaguuccacgcgugcuucaaccagcacauguccugcguccgguuccugcaccgcaccauccuccccgggagcaucgccaacuccaucugccagaacaucgagaucaucauccuggugacccugacgcuccugaucuucauccugcucagcauccuguccaagaccuacaucugcuaccugcucaugccgaucuucauccccaucgccuacauguacggcaucaucuacaacaagagcugcaagaagugcaagcugugcgggcugguguaccaccccuucaccgagugcggcacccacugcgucugcggggcccgguacgacacguccgaccgcaugaagcuccaccgggccagcggccugugccccggcuacaagagccugcgcgcggcccgggugaugugcaaguccaaggggccggccagcauccucuccaucaucaccgccgugcugguccugaccuucgugacccccaucaacagcaugguccucggcgaguccaaggagacguucgagcuggaggagcugcccgacgacaugcucgagauggccagccgcaucaacuccuacuacuucacgugcauccugaacuacgcggugagcugggggcuggugaucaucggccuccugaccggccuccuguucaagaaguaccagcaccgguuccugaacaucuacgccauguacugcgaggagugcgacauguaccacgacaaguccgggcugaagcgccacggcgacuucaccaacaagugccggcagugcacgugcgggcaguacgaggacgccgccggccucauggcccaccgcaagaccuacaacugccugguccaguacaaggcgaaguggaugaugaacuuccugaucaucuacaucuuccucauccugaucaaggacagcgccaucguggugcaggccgccgggaccgacuucacgaccugccuggagaccgaguccaucgacuggaacugcaccggccccuuccucaaccugggcaacugccagaagcagcagaagaaggagccguacaccaacaucgccacccagcugaaggggcucaaggcgaucagcguccuggacauccccaucaucacccggauccccgacgacaucgccggcgcccugcgcuacaucgaggagcgggaggacuuccacgugcagcugaccaccgaguacgccaugcucuccaaguacugcgacuacuacacccaguucagcgacaacuccggguacagccagacgaccuggcgcguguaccugcgcucccacgacuucgaggcgugcauccuguaccccaaccagaacuucugccggugcgucaagaacggcgagaagugcagcuccagcaacugggacuucgccaacgagaugaaggacuacuacccggggaagcaggccaaguucgacaaggaccucaaccuggcccugaccgcccuccaccacgcguuccgcggcaccagcuccgccuacaucgccacgaugcugagcaagaaguccaacgacgaccugaucgccuacaccaacaagaucaagaccaaguuccccggcaacgcccuccugaaggcgaucaucgacuacaucgccuacaugaagucccugcccgggauggccaacuucaaguacgacgaguucugggacgagcuccuguacaagcccaacccggccaaggccuccaaccuggcgcggggcaaggagagcuccuacaacuucaagcucgccaucagcuccaagagcaucaagaccugcaagaacgugaaggacguggccugccugagcccccgcagcggggccaucuacgcguccaucaucgccugcggcgagcccaacgggcccagcgucuaccggaagccguccggcggcguguuccagagcuccacggaccgcagcaucuacugccugcucgacagccacugccuggaggaguucgaggccaucucccaggaggagcuggacgccgugaagaaguccaagugcugggagaucgaguacagcgacgucaagccccuccaggaggggaacggcaccaagagcugccggaugaaggacuccgggaacugcaacguggccaccaaccgcuggcccgugauccagugcgagaacgacaaguucuacuacagcgagcugcagaaggacuacgacaagacccaggacaucggccacuacugccugucccccggcugcacgaccguccgguacccgaucaaccccaagcacaucagcaacugcaacuggcaggucucccgcagcuccaucgcgaagaucgacgugcacaacaucgaggacaucgagcaguacaagaaggccaucacccagaagcuccagaccagccugucccuguucaaguacgccaagacgaagaaccucccccacaucaagccgaucuacaaguacaucaccaucgaggggaccgagaccgccgagggcaucgagagcgccuacaucgaguccgaggugcccgcgcuggccgggacgagcaucggcuucaagaucaacuccaaggaggggaagcaccuccuggacgugaucgccuacgucaagagcgccuccuacagcagcguguacgccaagcuguacuccaccggccccaccagcggcaucaacaccaagcacgacgagcugugcacggggcccugcccggcgaacaucaaccaccaggugggcuggcucaccuucgccaaggagcggaccuccagcugggggugcgaggaguucggcugccuggccguguccgacgggugcgucuucggcagcugccaggacaucaucaaggaggagcuguccguguaccgcaaggagaccgaggaggugacggacgucgagcucugccugaccuucagcgacaagaccuacugcaccaaccugaaccccgugacgcccaucaucaccgaccucuucgaggugcaguucaagaccgucgagaccuacucccugccccggaucguggccgugcagaaccacgagaucaagaucggccagaucaacgaccugggggucuacagcaagggcugcgggaacgugcagaaggugaacggcacggucuacgggaacggcgugccgcgcuucgacuaccucugccaccuggcgucccggaaggaggugaucguccgcaagugcuucgacaacgacuaccaggccugcaaguuccugcagagccccgccuccuaccggcucgaggaggacagcggcaccgugaccaucaucgacuacaagaagauccuggggaccaucaagaugaaggccauccugggcgacgugaaguacaagaccuucgccgacuccgucgacaucacggcggaggggagcugcaccggcugcaucaacugcuucgagaacauccacugcgagcucacccugcacaccacgaucgaggccuccugccccaucaagagcuccugcaccguguuccacgaccgcauccuggugacccccaacgagcacaaguacgcccucaagauggucugcaccgagaagccggggaacacgcugaccaucaaggugugcaacaccaagaucgaggccagcauggcccugguggacgcgaagcccaucaucgagcucgcccccgucgaccagaccgccuacauccgggagaaggacgagcgcugcaagacguggaugugccgcgugcgggacgagggccugcaggucauccuggagcccuucaagaaccucuucggcagcuacaucgggaucuucuacaccuucaucaucuccaucguggcccugcuggccaucaucuacgugcuccugccgaucugcuucaagcugcgcgacacccuccggaagcacgaggacgcguacaagcgcgagaugaagauccgguga

SEQ ID NO: 12685 - RNA, 4326 nt, Artificial Sequence; identical to SEQ ID NO: 12654
  derived and/or modified CDS sequence (opt1) from LACV__KP271111.1__GP

SEQ ID NO: 12686 - RNA, 4263 nt, Artificial Sequence
  derived and/or modified CDS sequence (opt1) from OROV(BeAn19992)__NC_005775.1__GP
auggccaaccugaucaucaucagcauggugcucggcgucgccuacgggcacccccuguccaccagccagaucggcgaccgcugcuucgccgggggcaaccuguucaaggagaugaaccucuccguggggcugggcgagaucugcgugaaggacgacaucagcaucgucaaguccaccacgguguucagcaagaacaagccggcgcuggaggccaccaccaaguucuaccgguccuucaucgugaaggacuggagcgagugcaaccccguccucgacaaguucggcaacuucauggugcuguccguggacgacaacgggcacaucauccccaagauguacacgugccgcgccgccugcgacauccggcugaacaaggacaacgcggagaucauccucagcuccaccaagcugaaccacuucgagaucgucggcaccaccagcaccuccgggugguucaagaacacgaucaccaacaaccuggagcacacgugcgagcacgugaccgugaacugcggccagaaguccgucaaguuccacgccugcuuccgccagcaccgggggugcauccgcuucuucaagggcaccuacaugcccuacagcaugaucgaggccaugugcgugaacaucgagcucaucauccugacccuguacaucuucgccgcgaucaucuucgcccucaucaucaccaagagcuacguggccuaccugcugcucccgcuguucuaccccgucaccugguucuacggcaagguguacaagaagaucaacuccugccccaacugccugcucgccagccaccccuucacguccugcccgaaguucugcaucugcgggagccgguucagcugcaccgaggcccugaaggugcaccgcaugggcaaggacugccugggguacaagucccucagcaaggcgcggcagaugugcaaguccaagagcugguccuucaccgccgccauccugaccggccugauccucauggaguucaucagccccaucgccggcgagcgcauguacaagcuggaggagcuggccgacgaguucaucaagcucacggagcaggucaacauccuggagcgggagauggaggugcugaagcaguccaucaucgugauguucgcgaucauccucguccugcugcuguucgagaacaugaucuucaaccgccuguuccggaucuucuaccgcagcugcuccaugugcgggcugauccacuaccggcccggccucaagaucgaccugaccaagaccaaccgcugcgggagcugcaucugcggcuucgacgagcagcaguccagcggguucgaguacgagaucuuccugaaggacaugcacgugcagaaggaguccugcaaguucagcccccgggugaaccacuuccgcaacaucaaggcccuccuguucgcccuggucaucugcgccaccaucuacacgguguacgccgacgaggacugccucuccaaggacaucaagaucaccuaccaggagcugcacaacugcaucggcccgaagaucaugggcgacacgugcgucagcaaguccgagcuguacagcgaccucuucuccaagaaccuggugaccgaguacgacaagaaguacuucgagcccgacaccgugaacgaccaguucaacaagaucgaguucgcgcaggacgcccaccggaugauccugcuggagcgcauccucuacaagaccgagugcgagaugcugagccugaagaagaacagcgggcccuacaacgucgccuggcggaccuaccucaagaaccacaacaucgaccugugcucccgccacaacuacaagaugaucugccagugcaucaacacccacagcaugugcaacaacacggacaucgacuacaacaaggagaucgagaccuacuacaaguccaacgccgccgcguaccgcgccgaccugaacaccaucauggacacccucaagacggccuuccggggccugaccaaggugcugaucgagaacuacaucgagaaggacgacagcgacgcccucaaggcgcuguucuccaacaucaccgacagcgugcaggacaacuaccagaugaucgggauccugaaguucgccuccaagcuccuggacaucaaccugggccgcagcacccgguccgcccaccacagcaucaugaccaacgagauccccaaguccaacccguucacggacuacagcuacuccaaccucaacaucaaggagugcaugagccccgagucccugaagugcuucaagaagcgcgggagcacgccccacaccaaccaccuccucugcaagaucgacaacaaguacaaggccuucgacuggcccgagaucgagaccauccagaagggccagaagcugugccugggcgacucccacugcaaccucgaguucaccgccaucaccgcggacaagaucaugagccugaccaacugcuacaaggagagcuucaccgcccagccggccgacaugcaggccgggaucaagaagugcuccgccgacgagaucggcgagugcacgacccuggaggacaagaccuggcccaucaucuucugcgggggcaaguacuacuacagcgacuccaaggagcacgcgaaggacgggagcaucaacaacuacugccucaccaacaagugcuccgagcagcgguuccccauccacgagaacugguucaagaagugcaacugggacaagacgcacaaggaguucagcaccaugcgccagaucaacuacaacgacaucaccuccuaccggaaggccaucgagagcgagaucggcaccgaccugaugacgcaccacuacaagcccaccaagaaccugccgcacgucgugccccgcuaccacuccaucgacgugcagggcaccgagagcaccgaggggaucaucaacggcuucauccagaacacgauccccgccaucuccgggcucggcgucggcuaccaccugaacuuccagagcaaccagcuguucgacaucgugaucuucgugaagaaggccgucuacaaggcccaguaccagaaggcguacaccaccgggcccuccaucagcaucaacaucgagcacaacgagcggugcaccggccacugcccggagaagauccccgccaaggagggguggcucacguucuccaaggagcacaccagcuccuggggcugcgaggaguacgggugccuggccaucgacaccggcugccuguacggcagcugccaggacgugauccgccccgagcucgacguguacaagaagaucggguccgaggucagccugaucgagaucugcaucacccugccgcacgagacguacugcaacgacauggacauccucgagcccaucaucggcgacaagcugagcgccuccuuccagaacacccagaccaaccagcugcccacccucaucgcguacaagaaggggaagaucuacacgggccagaucaacgacaucgggaacaccgcccugcagugcggcagcauccaggugaucaacggcuccaccaucgggaccggcagccccaaguucgacuacaucugccacgccaugcggcgcaaggacgugaucguccggaagugcuucaacgacaacuaccaguccugcacgcgccuggagaagcggaacgaccucaucccguaccgcaagggggacgugaucgaggugagcaagaccggcuccaacauggggcagaugaccuucaagaucgagcugggcgacaucaacuacaagaucuucaccaagagcaucgaccugcagauguccggcaucugcgccgggugcaucgacugcgccgagggcaucagcugcuccaucaacgcggagguccccgccgagaccgugugccacugcaagacgaacugcgaggacuucaucaacaacaucguguucagcccccagaucaagaacuacaacaucaagguccacugcaaguccaagguggagaagaucaccgcccacaucugcgggcgggacaucgaccuccagcugaccaucaagcccuacaaccagaagaucgaccugagccagcucgacgaguccaacuacauccgcgaggaggaccugcagugcggcaccuggcugugcaaggugcagaaggaggggaucgacaucaucuucaagggccucuucagcggccuggggcgguacuggacgauccugaucuacuccaucaucggcgucgugaucaucgugauccucgucuacauccugcugccgaucgggcgccuccugaaggccuuccugauccgccacgagaucgaguacgccauggagcagaagaucaaguga

SEQ ID NO: 12687 - RNA, 4263 nt, Artificial Sequence
  derived and/or modified CDS sequence (opt1) from OROV(BeH759021)__KP691607.1__GP
auggccaaccugaucaucaucagcauggugcucuccgucgccuacggccacccccugagcaccucccagaucggggaccgcugcuucgcgggcgggaaccuguucaaggagaugaaccucagcgugggccugggggagaucugcgugaaggacgacaucuccaucgucaagagcaccacgguguucuccaagaaccggccggcccuggaggccaccaccaaguucuaccgcagcuucaucgugaaggacugguccgagugcaaccccguccucgacaaguucggcaacuucauggugcugagcguggacgacaacggccacaucaugcccaagauguacacgugccgggccgccugcgacauccgccugaacaaggacaacgcggagaucauccucuccagcaccaagcugaaccacuucgagaucgucgggaccaccuccaccagcggcugguucaagaacacgaucaccaacaaccuggagcacacgugcgagcacgugaccgugaacugcgggcagaaguccgucaaguuccacgccugcuuccggcagcaccgcggcugcauccgguucuucaaggggaccuacaugcccuacagcaugaucgaggccaugugcgugaacaucgagcucaucauccugacccuguacaucuucgccgcgaucaucuucgcccucaucaucaccaaguccuacguggccuaccugcugcucccgcuguucuaccccgucaccugguucuacggcaagguguacaagaagaucaacagcugccccaacugccugcucgccucccaccccuucacgagcugcccgaagaucugcaucugcggcagccgcuucuccugcaccgaggcccugaaggugcaccggauggggaaggacugccugggcuacaagagccucuccaaggcgcgccagaugugcaagagcaaguccuggagcuucaccgccgccauccugaccgggcugauccucauggaguucaucucccccaucgccggcgagcggauguacaagcuggaggagcuggccgacgaguucaucaagcucacggagcaggucaacauccuggagcgcgagauggaggugcugaagcagagcaucaucgugauguucgcgaucauccucguccugcugcuguucgagaacaugaucuucaaccggcuguucuccaucuucuaccgcagcugcuccaugugcggccugauccacuaccggcccgggcucaagaucgaccugaccaagaccaacaagugcggcagcugcaucugcggguucaacgagcagcaguccagcggcuucgaguacgagaucuuccugaaggacaugcacauccagaaggaguccugcaaguucagcccccgcgugaaccacuuccggaacaucaaggcccuccuguucgcccuggugaucugcgccaccaucuacacggucuacgccgacgaggacugccucuccaaggacaucaagaucaccuaccaggagcugcacaacugcaucgggccgaagaucaugggcaacacgugcgugagcaagaacgagcuguacuccgaccucuucagcaagaaccuggucaccgaguacgacaagaaguacuucgagcccgacaccgugaacgaccaguucaacaagaucgaguucgcgcaggacgcccaccgcaugauccugcuggagcggauccucuacaagaccgagugcgagaugcugagccugaagaagaacuccggccccuacaacguggccuggcgcaccuaccucaagaaccacaacaucgaccugugcagccggcacaacuacaagaugaucugccagugcaucaacacccacuccaugugcaagaacacggacaucgacuacaacaaggagaucgagaccuacuacaagagcaacgccgccgcguaccgcgccgaccugaacaccaucauggacacccucaagacggccuuccgcgggcugaccaagguccugaucgagaacuacaucgagaaggacgacuccgacgcccucaaggcgcuguucagcaacaucaccgacuccgugcaggacaacuaccagaugaucggcauccugaaguucgccagcaagcuccuggacaucaaccuggggcgguccacccgcagcgcccaccacuccaucaugaccaacgagauccccaagagcaacccguucacggacuacuccuacagcaacgugaacaucaaggagugcaugucccccgagagccucaagugcuucaagaagcgggacuccacgccccacaccaaccaccuccugugcaagaucgacagcaaguacaaggccuucgacuggcccgagaucgagaccauccagaagggccagaagcucugccugggggacagccacugcaaccuggaguucaccgccaucaccgcggacaagaucaugucccucaccaacugcuacaaggagagcuucaccgcccagccggccgacaugcagacgggcaucaagaagugcuccgccgacgagaucggcgagugcaccacccuggaggacaagaccuggcccaucgucuucugcgggggcaaguacuacuacagcgacuccaaggagcacgccaaggacgggagcaucaacaacuacugccugacgaacaagugcuccgagcagcgcuuccccauccacgagaacugguucaagaagugcaacugggacaagacccacaaggaguucagcaccaugcggcagaucaacuacaacgacaucaccuccuaccgcaaggcgaucgagagcgagaucggcuccgaccucaugacgcaccacuacaagcccaccaagaaccugccgcacguggugccccgguaccacagcaucgacguccaggggaccgaguccaccgagggcaucaucaacggcuucauccagaacacgauccccgccaucagcgggcugggcgugggguaccaccucaacuucaagggcaaccagcuguucgacaucgugaucuucgucaagaaggccguguacaaggcccaguaccagaaggccuacaccaccggccccuccaucagcaucaacaucgagcacaacgagcgcugcaccgggcacugcccggagaagauccccgcgaaggagggcuggcugacguucuccaaggagcacaccagcuccugggggugcgaggaguacggcugccucgccaucgacaccgggugccuguacggcagcugccaggacgugauccggcccgagcuggacgucuacaagaagaucggcagcgaggugucccucaucgagaucugcaucacccugccgcacgagacguacugcaacgacauggacauccuggagcccaucaucggggacaagcucagcgccuccuuccagaacacccagaccaaccagcugcccacccugaucgccuacaagaagggcaagaucuacacggggcagaucaacgacaucggcaacaccgcgcuccagugcgggagcauccaggugaucaacggcuccaccaucggcaccgggagccccaaguucgacuacaucugccacgccaugcgccggaaggacgucaucgugcgcaagugcuucaacgacaacuaccaguccugcacgcggcuggagaagcgcaacgaccugaucccguaccggaagggcgacgugaucgaggucagcaagaccggguccaacaugggccagaugaccuucaagaucgagcucggggacgugaacuacaagaucuucaccaagagcaucgaccugcagauguccggcaucugcgccggcugcaucgacugcgccgaggggaucagcugcuccaucaacgccgaggugcccgcggagaccgucugccacugcaagacgaacugcgaggacuucaucaacaacaucguguucagcccccagaucaagaacuacaacaucaaggugcacugcaaguccaaggucgagaagaucaucgcccacaucugcggccgcgacaucgaccugcagcucaccgugaagcccuacaaccagaagaucgaccugagccagcuggacgaguccaacuacauccgggaggaggaccuccagugcgggaccuggcugugcaaggugcagaaggagggcgucgacaucaucuucaaggggcuguucagcggccucggccgcuacuggaccauccugaucuacuccaucaucgggguggugaucaucgucauccugguguacauccuccugccgaucggccggcugcucaaggccuuccugauccgccacgagaucgaguacgccauggagcagaagaucaaguga

SEQ ID NO: 12688 - RNA, 4263 nt, Artificial Sequence
  derived and/or modified CDS sequence (opt1) from OROV(BeH759022)__KP691610.1__GP
auggccaaccugaucaucaucagcauggcccucuccguggcguacggccacccccugagcaccucccagaucggggaccgcugcuucgccggcgggaaccuguucaaggagaugaaccucagcgucggccugggggagaucugcgugaaggacgacaucuccaucgucaagagcaccacgguguucuccaagaaccggccggcccuggaggccaccaccaaguucuaccgcagcuucaucgugaaggacugguccgagugcaaccccgugcucgacaaguucggcaacuucaugguccugagcguggacgacaacggccacaucaugcccaagauguacacgugccgggccgcgugcgacauccgccugaacaaggacaacgccgagaucauccucuccagcaccaagcugaaccacuucgagaucguggggaccaccuccaccagcggcugguucaagaacacgaucaccaacaaccuggagcacacgugcgagcacgucaccgugaacugcgggcagaaguccgugaaguuccacgccugcuuccggcagcaccgcggcugcauccgguucuucaaggggaccuacaugcccuacagcaugaucgaggccaugugcgucaacaucgagcucaucauccugacccuguacaucuucgcggccaucaucuucgcccucaucaucaccaaguccuacguggccuaccugcugcucccgcuguucuaccccgugaccugguucuacggcaaggucuacaagaagaucaacagcugccccaacugccugcucgccucccaccccuucacgagcugcccgaagaucugcaucugcggcagccgcuucuccugcaccgaggcgcugaaggugcaccggauggggaaggacugccugggcuacaagagccucuccaaggcccgccagaugugcaagagcaaguccuggagcuucaccgccgccauccugaccgggcugauccucauggaguucaucucccccaucgccggcgagcggauguacaagcuggaggagcuggcggacgaguucaucaagcucacggagcaggucaacauccuggagcgcgagauggaggugcugaagcagagcaucaucgugauguucgccaucauccucgugcugcugcuguucgagaacaugaucuucaaccggcuguucuccaucuucuaccgcagcugcuccaugugcggccugauccacuaccggcccgggcucaagaucgaccugaccaagaccaacaagugcggcagcugcaucugcggguucaacgagcagcaguccagcggcuucgaguacgagaucuuccugaaggacaugcacauccagaaggaguccugcaaguucagcccccgcgucaaccacuuccggaacaucaaggcccuccuguucgcccuggugaucugcgccaccaucuacacgguguacgcggacgaggacugccucuccaaggacaucaagaucaccuaccaggagcugcacaacugcaucgggccgaagaucaugggcaacacgugcgucagcaagaacgagcuguacuccgaccucuucagcaagaaccuggugaccgaguacgacaagaaguacuucgagcccgacaccgucaacgaccaguucaacaagaucgaguucgcccaggacgcccaccgcaugauccugcuggagcggauccucuacaagaccgagugcgagaugcugagccugaagaagaacuccggccccuacaacguggccuggcgcaccuaccucaagaaccacaacaucgaccugugcagccggcacaacuacaagaugaucugccagugcaucaacacccacuccaugugcaagaacacggacaucgacuacaacaaggagaucgagaccuacuacaagagcaacgccgcggccuaccgcgccgaccugaacaccaucauggacacccucaagacggccuuccgcgggcugaccaaggugcugaucgagaacuacaucgagaaggacgacuccgacgcgcucaaggcccuguucagcaacaucaccgacuccguccaggacaacuaccagaugaucggcauccugaaguucgccagcaagcuccuggacaucaaccuggggcgguccacccgcagcgcccaccacuccaucaugaccaacgagauccccaagagcaacccguucacggacuacuccuacagcaacgugaacaucaaggagugcaugucccccgagagccucaagugcuucaagaagcgggacuccacgccccacaccaaccaccuccugugcaagaucgacagcaaguacaaggccuucgacuggcccgagaucgagaccauccagaagggccagaagcucugccugggggacagccacugcaaccuggaguucaccgcgaucaccgccgacaagaucaugucccucaccaacugcuacaaggagagcuucaccgcccagccggccgacaugcagacgggcaucaagaagugcuccgccgacgagaucggcgagugcaccacccuggaggacaagaccuggcccaucguguucugcgggggcaaguacuacuacagcgacuccaaggagcacgcgaaggacgggagcaucaacaacuacugccugacgaacaagugcuccgagcagcgcuuccccauccacgagaacugguucaagaagugcaacugggacaagacccacaaggaguucagcaccaugcggcagaucaacuacaacgacaucaccuccuaccgcaaggccaucgagagcgagaucggcuccgaccucaugacgcaccacuacaagcccaccaagaaccugccgcacgucgugccccgguaccacagcaucgacgugcaggggaccgaguccaccgagggcaucaucaacggcuucauccagaacacgauccccgccaucagcgggcugggcgucggguaccaccucaacuucaagggcaaccagcuguucgacaucgugaucuucgugaagaaggccgucuacaaggcccaguaccagaaggcguacaccaccggccccuccaucagcaucaacaucgagcacaacgagcgcugcaccgggcacugcccggagaagauccccgccaaggagggcuggcugacguucuccaaggagcacaccagcuccugggggugcgaggaguacggcugccucgccaucgacaccgggugccuguacggcagcugccaggacgugauccggcccgagcuggacguguacaagaagaucggcagcgaggucucccucaucgagaucugcaucacccugccgcacgagacguacugcaacgacauggacauccuggagcccaucaucggggacaagcucagcgccuccuuccagaacacccagaccaaccagcugcccacccugaucgcguacaagaagggcaagaucuacacggggcagaucaacgacaucggcaacaccgcccuccagugcgggagcauccaggugaucaacggcuccaccaucggcaccgggagccccaaguucgacuacaucugccacgccaugcgccggaaggacgugaucguccgcaagugcuucaacgacaacuaccaguccugcacgcggcuggagaagcgcaacgaccugaucccguaccggaagggcgacgugaucgaggugagcaagaccggguccaacaugggccagaugaccuucaagaucgagcucggggacgucaacuacaagaucuucaccaagagcaucgaccugcagauguccggcaucugcgccggcugcaucgacugcgccgaggggaucagcugcuccaucaacgcggaggugcccgccgagaccgugugccacugcaagacgaacugcgaggacuucaucaacaacaucgucuucagcccccagaucaagaacuacaacaucaaggugcacugcaaguccaagguggagaagaucaucgcccacaucugcggccgcgacaucgaccugcagcucaccgucaagcccuacaaccagaagaucgaccugagccagcuggacgaguccaacuacauccgggaggaggaccuccagugcgggaccuggcugugcaaggugcagaaggagggcguggacaucaucuucaaggggcuguucagcggccucggccgcuacuggaccauccugaucuacuccaucaucggggucgugaucaucgugauccuggucuacauccuccugccgaucggccggcugcucaaggccuuccugauccgccacgagaucgaguacgccauggagcagaagaucaaguga

SEQ ID NO: 12689 - RNA, 4263 nt, Artificial Sequence
  derived and/or modified CDS sequence (opt1) from OROV(BeH759040)__KP691616.1__GP
auggccaaccugaucaucaucagcaugauccucuccguggccuacggccacccccugagcaccucccagaucggggaccgcugcuucgcgggcgggaaccuguucaaggagaugaaccucagcgucggccugggggagaucugcgugaaggacgacaucuccaucgucaagagcaccacgguguucuccaagaaccggccggcccuggaggccaccaccaaguucuaccgcagcuucaucgugaaggacugguccgagugcaaccccgugcucgacaaguucggcaacuucaugguccugagcguggacgacaacggccacaucaugcccaagauguacacgugccgggccgccugcgacauccgccugaacaaggacaacgcggagaucauccucuccagcaccaagcugaaccacuucgagaucguggggaccaccuccaccagcggcugguucaagaacacgaucaccaacaaccuggagcacacgugcgagcacgucaccgugaacugcgggcagaaguccgugaaguuccacgccugcuuccggcagcaccgcggcugcauccgguucuucaaggggaccuacaugcccuacagcaugaucgaggccaugugcgucaacaucgagcucaucauccugacccuguacaucuucgccgcgaucaucuucgcccucaucaucaccaaguccuacguggccuaccugcugcucccgcuguucuaccccgugaccugguucuacggcaaggucuacaagaagaucaacagcugccccaacugccugcucgccucccaccccuucacgagcugcccgaagaucugcaucugcggcagccgcuucuccugcaccgaggcccugaaggugcaccggauggggaaggacugccugggcuacaagagccucuccaaggcgcgccagaugugcaagagcaaguccuggagcuucaccgccgccauccugaccgggcugauccucauggaguucaucucccccaucgccggcgagcggauguacaagcuggaggagcuggccgacgaguucaucaagcucacggagcaggucaacauccuggagcgcgagauggaggugcugaagcagagcaucaucgugauguucgcgaucauccucgugcugcugcuguucgagaacaugaucuucaaccggcuguucuccaucuucuaccgcagcugcuccaugugcggccugauccacuaccggcccgggcucaagaucgaccugaccaagaccaacaagugcggcagcugcaucugcggguucaacgagcagcaguccagcggcuucgaguacgagaucuuccugaaggacaugcacauccagaaggaguccugcaaguucagcccccgcgucaaccacuuccggaacaucaaggcccuccuguucgcccuggugaucugcgccaccaucuacacgguguacgccgacgaggacugccucuccaaggacaucaagaucaccuaccaggagcugcacaacugcaucgggccgaagaucaugggcaacacgugcgucagcaagaacgagcuguacuccgaccucuucagcaagaaccuggugaccgaguacgacaagaaguacuucgagcccgacaccgucaacgaccaguucaacaagaucgaguucgcgcaggacgcccaccgcaugauccugcuggagcggauccucuacaagaccgagugcgagaugcugagccugaagaagaacuccggccccuacaacguggccuggcgcaccuaccucaagaaccacaacaucgaccugugcagccggcacaacuacaagaugaucugccagugcaucaacacccacuccaugugcaagaacacggacaucgacuacaacaaggagaucgagaccuacuacaagagcaacgccgccgcguaccgcgccgaccugaacaccaucauggacacccucaagacggccuuccgcgggcugaccaaggugcugaucgagaacuacaucgagaaggacgacuccgacgcccucaaggcgcuguucagcaacaucaccgacuccguccaggacaacuaccagaugaucggcauccugaaguucgccagcaagcuccuggacaucaaccuggggcgguccacccgcagcgcccaccacuccaucaugaccaacgagauccccaagagcaacccguucacggacuacuccuacagcaacgugaacaucaaggagugcaugucccccgagagccucaagugcuucaagaagcgggacuccacgccccacaccaaccaccuccugugcaagaucgacagcaaguacaaggccuucgacuggcccgagaucgagaccauccagaagggccagaagcucugccugggggacagccacugcaaccuggaguucaccgccaucaccgcggacaagaucaugucccucaccaacugcuacaaggagagcuucaccgcccagccggccgacaugcagacgggcaucaagaagugcuccgccgacgagaucggcgagugcaccacccuggaggacaagaccuggcccaucguguucugcgggggcaaguacuacuacagcgacuccaaggagcacgccaaggacgggagcaucaacaacuacugccugacgaacaagugcuccgagcagcgcuuccccauccacgagaacugguucaagaagugcaacugggacaagacccacaaggaguucagcaccaugcggcagaucaacuacaacgacaucaccuccuaccgcaaggcgaucgagagcgagaucggcuccgaccucaugacgcaccacuacaagcccaccaagaaccugccgcacgucgugccccgguaccacagcaucgacgugcaggggaccgaguccaccgagggcaucaucaacggcuucauccagaacacgauccccgccaucagcgggcugggcgucggguaccaccucaacuucaagggcaaccagcuguucgacaucgugaucuucgugaagaaggccgucuacaaggcccaguaccagaaggccuacaccaccggccccuccaucagcaucaacaucgagcacaacgagcgcugcaccgggcacugcccggagaagauccccgcgaaggagggcuggcugacguucuccaaggagcacaccagcuccugggggugcgaggaguacggcugccucgccaucgacaccgggugccuguacggcagcugccaggacgugauccggcccgagcuggacguguacaagaagaucggcagcgaggucucccucaucgagaucugcaucacccugccgcacgagacguacugcaacgacauggacauccuggagcccaucaucggggacaagcucagcgccuccuuccagaacacccagaccaaccagcugcccacccugaucgccuacaagaagggcaagaucuacacggggcagaucaacgacaucggcaacaccgcgcuccagugcgggagcauccaggugaucaacggcuccaccaucggcaccgggagccccaaguucgacuacaucugccacgccaugcgccggaaggacgugaucguccgcaagugcuucaacgacaacuaccaguccugcacgcggcuggagaagcgcaacgaccugaucccguaccggaagggcgacgugaucgaggugagcaagaccggguccaacaugggccagaugaccuucaagaucgagcucggggacgucaacuacaagaucuucaccaagagcaucgaccugcagauguccggcaucugcgccggcugcaucgacugcgccgaggggaucagcugcuccaucaacgccgaggugcccgcggagaccgugugccacugcaagacgaacugcgaggacuucaucaacaacaucgucuucagcccccagaucaagaacuacaacaucaaggugcacugcaaguccaagguggagaagaucaucgcccacaucugcggccgcgacaucgaccugcagcucaccgucaagcccuacaaccagaagaucgaccugagccagcuggacgaguccaacuacauccgggaggaggaccuccagugcgggaccuggcugugcaaggugcagaaggagggcguggacaucaucuucaaggggcuguucagcggccucggccgcuacuggaccauccugaucuacuccaucaucggggucgugaucaucgugauccuggucuacauccuccugccgaucggccggcugcucaaggccuuccugauccgccacgagaucgaguacgccauggagcagaagaucaaguga

SEQ ID NO: 12690 - RNA, 4263 nt, Artificial Sequence
  derived and/or modified CDS sequence (opt1) from OROV(BeH759146)__KP691631.1__GP
auggccaaccugaucaucaucagcauggugcucuccgucgccuacggccacccccugagcaccucccagaucggggaccgcugcuucgcgggcgggaaccuguucaaggagaugaaccucagcgugggccugggggagaucugcgugaaggacgacaucuccaucgucaagagcaccacgguguucuccaagaaccggccggcccuggaggccaccaccaaguucuaccgcagcuucaucgugaaggacugguccgagugcaaccccguccucgacaaguucggcaacuucauggugcugagcguggacgacaacggccacaucaugcccaagauguacacgugccgggccgccugcgacauccgccugaacaaggacaacgcggagaucauccucuccagcaccaagcugaaccacuucgagaucgucgggaccaccuccaccagcggcugguucaagaacacgaucaccaacaaccuggagcacacgugcgagcacgugaccgugaacugcugccagaaguccgucaaguuccacgccugcuuccggcagcaccgcgggugcauccgguucuucaagggcaccuacaugcccuacagcaugaucgaggccaugugcgugaacaucgagcucaucauccugacccuguacaucuucgccgcgaucaucuucgcccucaucaucaccaaguccuacguggccuaccugcugcucccgcuguucuaccccgucaccugguucuacgggaagguguacaagaagaucaacagcugccccaacugccugcucgccucccaccccuucacgagcugcccgaagaucugcaucugcggcagccgcuucuccugcaccgaggcccugaaggugcaccggaugggcaaggacugccugggguacaagagccucuccaaggcgcgccagaugugcaagagcaaguccuggagcuucaccgccgccauccugaccggccugauccucauggaguucaucucccccaucgccggggagcggauguacaagcuggaggagcuggccgacgaguucaucaagcucacggagcaggucaacauccuggagcgcgagauggaggugcugaagcagagcaucaucgugauguucgcgaucauccucguccugcugcuguucgagaacaugaucuucaaccggcuguucuccaucuucuaccgcagcugcuccaugugcggccugauccacuaccggcccggccucaagaucgaccugaccaagaccaacaagugcgggagcugcaucugcggcuucaacgagcagcaguccagcggguucgaguacgagaucuuccugaaggacaugcacauccagaaggaguccugcaaguucagcccccgcgugaaccacuuccggaacaucaaggcccuccuguucgcccuggugaucugcgccaccaucuacacggucuacgccgacgaggacugccucuccaaggacaucaagaucaccuaccaggagcugcacaacugcaucggcccgaagaucauggggaacacgugcgugagcaagaacgagcuguacuccgaccucuucagcaagaaccuggucaccgaguacgacaagaaguacuucgagcccgacaccgugaacgaccaguucaacaagaucgaguucgcgcaggacgcccaccgcaugauccugcuggagcggauccucuacaagaccgagugcgagaugcugagccugaagaagaacuccggccccuacaacguggccuggcgcaccuaccucaagaaccacaacaucgaccugugcagccggcacaacuacaagaugaucugccagugcaucaacacccacuccaugugcaagaacacggacaucgacuacaacaaggagaucgagaccuacuacaagagcaacgccgccgcguaccgcgccgaccugaacaucaucauggacacccucaagaccgccuuccgcggccugacgaagguccugaucgagaacuacaucgagaaggacgacuccgacgcccucaaggcgcuguucagcaacaucaccgacuccgugcaggacaacuaccagaugaucgggauccugaaguucgccagcaagcuccuggacaucaaccugggccgguccacccgcagcgcccaccacuccaucaugaccaacgagauccccaagagcaacccguucaccgacuacuccuacagcaacgugaacaucaaggagugcaugucccccgagagccucaagugcuucaagaagcgggacuccacgccccacaccaaccaccuccugugcaagaucgacagcaaguacaaggccuucgacuggcccgagaucgagaccauccagaaggggcagaagcucugccugggcgacagccacugcaaccuggaguucaccgccaucacggcggacaagaucaugucccucaccaacugcuacaaggagagcuucaccgcccagccggccgacaugcagaccgggaucaagaagugcuccgccgacgagaucggcgagugcacgacccuggaggacaagaccuggcccaucgucuucugcggcgggaaguacuacuacagcgacuccaaggagcacgccaaggacggcagcaucaacaacuacugccugaccaacaagugcuccgagcagcgcuuccccauccacgagaacugguucaagaagugcaacugggacaagacgcacaaggaguucagcaccaugcggcagaucaacuacaacgacaucaccuccuaccgcaaggcgaucgagagcgagaucggguccgaccucaugacccaccacuacaagcccacgaagaaccugccgcacguggugccccgguaccacagcaucgacguccagggcaccgaguccaccgaggggaucaucaacggcuucauccagaacaccauccccgccaucagcggccugggggugggcuaccaccucaacuucaaggggaaccagcuguucgacaucgugaucuucgucaagaaggccguguacaaggcccaguaccagaaggccuacacgaccggccccuccaucagcaucaacaucgagcacaacgagcgcugcaccggccacugcccggagaagauccccgcgaaggagggguggcugaccuucuccaaggagcacacgagcuccuggggcugcgaggaguacgugugccucgccaucgacaccgggugccuguacggcagcugccaggacgucauccggcccgagcuggacguguacaagaagaucgggagcgaggugucccucaucgagaucugcaucacccugccgcacgagaccuacugcaacgacauggacauccuggagcccaucaucggcgacaagcucagcgccuccuuccagaacacgcagaccaaccagcugcccacccugaucgccuacaagaagggcaagaucuacaccgggcagaucaacgacaucggcaacacggcgcuccagugcgggagcauccaggucaucaacggcuccaccaucgggaccggcagccccaaguucgacuacaucugccacgccaugcgccggaaggacgugaucgugcgcaagugcuucaacgacaacuaccaguccugcacccggcuggagaagcgcaacgaccugaucccguaccggaagggcgacgucaucgaggugagcaagacgggguccaacaugggccagaugaccuucaagaucgagcucggggacgugaacuacaagaucuucaccaagagcaucgaccugcagauguccggcaucugcgccgggugcaucgacugcgccgagggcaucagcugcuccaucaacgccgagguccccgcggagaccgugugccacugcaagaccaacugcgaggacuucaucaacaacaucguguucagcccccagaucaagaacuacaacaucaagguccacugcaaguccaagguggagaagaucaucgcccacaucugcggccgcgacaucgaccugcagcucacggugaagcccuacaaccagaagaucgaccugagccagcuggacgaguccaacuacauccgggaggaggaccuccagugcgggaccuggcugugcaagguccagaaggagggcguggacaucaucuucaaggggcuguucagcggccucgggcgcuacuggaccauccugaucuacuccaucaucggcguggucaucaucgugauccugguguacauccuccugccgaucggccggcugcucaaggccuuccugauccgccacgagaucgaguacgccauggagcagaagaucaaguga

SEQ ID NO: 12691 - RNA, 4263 nt, Artificial Sequence
  derived and/or modified CDS sequence (opt1) from OROV(BeH759620)__KP691622.1__GP
auggccaaccugaucaucaucagcauggugcucuccgucgccuacggccacccccugagcaccucccagaucggggaccgcugcuucgcgggcgggaaccuguucaaggagaugaaccucagcgugggccugggggagaucugcgugaaggacgacaucuccaucgucaagagcaccacgguguucuccaagaaccggccggcccuggaggccaccaccaaguucuaccgcagcuucaucgugaaggacugguccgagugcaaccccguccucgacaaguucggcaacuucauggugcugagcguggacgacaacggccacaucaugcccaagauguacacgugccgggccgccugcgacauccgccugaacaaggacaacgcggagaucauccucuccagcaccaagcugaaccacuucgagaucgucgggaccaccuccaccagcggcugguucaagaacacgaucaccaacaaccuggagcacacgugcgagcacgugaccgugaacugcgggcagaaguccaucaaguuccacgccugcuuccggcagcaccgcggcugcauccgguucuucaaggggaccuacaugcccuacagcaugaucgaggccaugugcgucaacaucgagcucaucauccugacccuguacaucuucgccgcgaucaucuucgcccucaucaucaccaaguccuacguggccuaccugcugcucccgcuguucuaccccgugaccugguucuacggcaaggucuacaagaagaucaacagcugccccaacugccugcucgccucccaccccuucacgagcugcccgaagaucugcaucugcggcagccgcuucuccugcaccgaggcccugaaggugcaccggauggggaaggacugccugggcuacaagagccucuccaaggcgcgccagaugugcaagagcaaguccuggagcuucaccgccgccauccugaccgggcugauccucauggaguucaucucccccaucgccggcgagcggauguacaagcuggaggagcuggccgacgaguucaucaagcucacggagcaggucaacauccuggagcgcgagauggaggugcugaagcagagcaucaucgugauguucgcgaucauccucgugcugcugcuguucgagaacaugaucuucaaccggcuguucuccaucuucuaccgcagcugcuccaugugcggccugauccacuaccggcccgggcucaagaucgaccugaccaagaccaacaagugcggcagcugcaucugcggguucaacgagcagcaguccagcggcuucgaguacgagaucuuccugaaggacaugcacauccagaaggaguccugcaaguucagcccccgcgucaaccacuuccggaacaucaaggcccuccuguucgcccuggugaucugcgccaccaucuacacgguguacgccgacgaggacugccucuccaaggacaucaagaucaccuaccaggagcugcacaacugcaucgggccgaagaucaugggcaacacgugcgucagcaagaacgagcuguacuccgaccucuucagcaagaaccuggugaccgaguacgacaagaaguacuucgagcccgacaccgucaacgaccaguucaacaagaucgaguucgcgcaggacagccaccgcaugauccugcuggagcggauccucuacaagaccgagugcgagaugcugucccugaagaagaacagcggccccuacaacguggccuggcgcaccuaccucaagaaccacaacaucgaccugugcucccggcacaacuacaagaugaucugccagugcaucaacacccacagcaugugcaagaacacggacaucgacuacaacaaggagaucgagaccuacuacaaguccaacgccgccgccuaccgcgcggaccugaacaccaucauggacacccucaagacggccuuccgcgggcugaccaaggugcugaucgagaacuacaucgagaaggacgacagcgacgcccucaaggcccuguucuccaacaucaccgacagcguccaggacaacuaccagaugaucggcauccugaaguucgcguccaagcuccuggacaucaaccuggggcggagcacccgcuccgcccaccacagcaucaugaccaacgagauccccaaguccaacccguucacggacuacagcuacuccaacgugaacaucaaggagugcaugagccccgagucccucaagugcuucaagaagcgggacagcacgccccacaccaaccaccuccugugcaagaucgacagcaaguacaaggccuucgacuggcccgagaucgagaccauccagaagggccagaagcucugccugggggacucccacugcaaccuggaguucaccgccaucaccgccgacaagaucaugagccucaccaacugcuacaaggaguccuucaccgcgcagccggccgacaugcagacgggcaucaagaagugcagcgccgacgagaucggcgagugcaccacccuggaggacaagaccuggcccaucguguucugcgggggcaaguacuacuacuccgacagcaaggagcacgccaaggacggguccaucaacaacuacugccugacgaacaagugcagcgagcagcgcuuccccauccacgagaacugguucaagaagugcaacugggacaagacccacaaggaguucuccaccaugcggcagaucaacuacaacgacaucaccagcuaccgcaaggccaucgaguccgagaucggcagcgaccucaugacgcaccacuacaagcccaccaagaaccugccgcacgucgugccccgguaccacuccaucgacgugcaggggaccgagagcaccgagggcaucaucaacggcuucauccagaacacgauccccgcgaucuccgggcugggcgucggguaccaccucaacuucaagggcaaccagcuguucgacaucgugaucuucgugaagaaggccgucuacaaggcccaguaccagaaggccuacaccaccggccccagcaucuccaucaacaucgagcacaacgagcgcugcaccgggcacugcccggagaagauccccgccaaggagggcuggcugacguucagcaaggagcacaccuccagcugggggugcgaggaguacggcugccucgcgaucgacaccgggugccuguacggcagcugccaggacgugauccggcccgagcuggacguguacaagaagaucggcuccgaggucagccucaucgagaucugcaucacccugccgcacgagacguacugcaacgacauggacauccuggagcccaucaucggggacaagcucuccgccagcuuccagaacacccagaccaaccagcugcccacccugaucgccuacaagaagggcaagaucuacacggggcagaucaacgacaucggcaacaccgcccuccagugcggguccauccaggugaucaacggcagcaccaucggcaccgggucccccaaguucgacuacaucugccacgcgaugcgccggaaggacgugaucguccgcaagugcuucaacgacaacuaccagagcugcacgcggcuggagaagcgcaacgaccugaucccguaccggaagggcgacgugaucgagguguccaagaccgggagcaacaugggccagaugaccuucaagaucgagcucggggacgucaacuacaagaucuucaccaaguccaucgaccugcagaugagcggcaucugcgccggcugcaucgacugcgccgaggggaucuccugcagcaucaacgccgaggugcccgccgagaccgugugccacugcaagacgaacugcgaggacuucaucaacaacaucgucuucagcccccagaucaagaacuacaacaucaaggugcacugcaaguccaagguggagaagaucaucgcgcacaucugcggccgcgacaucgaccugcagcucaccgucaagcccuacaaccagaagaucgaccugucccagcuggacgagagcaacuacauccgggaggaggaccuccagugcgggaccuggcugugcaaggugcagaaggagggcguggacaucaucuucaaggggcuguucuccggccucggccgcuacuggaccauccugaucuacagcaucaucggggucgugaucaucgugauccuggucuacauccuccugccgaucggccggcugcucaaggccuuccugauccgccacgagaucgaguacgccauggagcagaagaucaaguga

SEQ ID NO: 12692 - RNA, 4263 nt, Artificial Sequence
  derived and/or modified CDS sequence (opt1) from OROV(BeAn19991)__KP052851.1__GP
auggccaaccugaucaucaucagcauggugcucggcgucgccuacgggcacccccuguccaccagccagaucggcgaccgcugcuucgccgggggcaaccuguucaaggagaugaaccucuccguggggcugggcgagaucugcgugaaggacgacaucagcaucgucaaguccaccacgguguucagcaagaacaagccggcgcuggaggccaccaccaaguucuaccgguccuucaucgugaaggacuggagcgagugcaaccccguccucgacaaguucggcaacuucauggugcuguccguggacgacaacgggcacaucauccccaagauguacacgugccgcgccgccugcgacauccggcugaacaaggacaacgcggagaucauccucagcuccaccaagcugaaccacuucgagaucgucggcaccaccagcaccuccgggugguucaagaacacgaucaccaacaaccuggagcacacgugcgagcacgugaccgugaacugcggccagaaguccgucaaguuccacgccugcuuccgccagcaccgggggugcauccgcuucuucaagggcaccuacaugcccuacuccaugaucgaggccaugugcgugaacaucgagcucaucauccugacccuguacaucuucgccgcgaucaucuucgcccucaucaucaccaagagcuacguggccuaccugcugcucccgcuguucuaccccgucaccugguucuacggcaagguguacaagaagaucaacuccugccccaacugccugcucgccagccaccccuucacguccugcccgaagaucugcaucugcgggagccgguucagcugcaccgaggcccugaaggugcaccgcaugggcaaggacugccugggguacaagucccucagcaaggcgcggcagaugugcaaguccaagagcugguccuucaccgccgccauccugaccggccugauccucauggaguucaucagccccaucgccggcgagcgcauguacaagcuggaggagcuggccgacgaguucaucaagcucacggagcaggucaacauccuggagcgggagauggaggugcugaagcaguccaucaucgugauguucgcgaucauccucguccugcugcuguucgagaacaugaucuucaaccgccuguuccggaucuucuaccgcagcugcuccaugugcgggcugauccacuaccggcccggccucaagaucgaccugaccaagaccaaccgcugcgggagcugcaucugcggcuucgacgagcagcaguccagcggguucgaguacgagaucuuccugaaggacaugcacgugcagaaggaguccugcaaguucagcccccgggugaaccacuuccgcaacaucaaggcccuccuguucgcccuggucaucugcgccaccaucuacacgguguacgccgacgaggacugccucuccaaggacaucaagaucaccuaccaggagcugcacaacugcaucggcccgaagaucaugggcgacacgugcgucagcaaguccgagcuguacagcgaccucuucuccaagaaccuggugaccgaguacgacaagaaguacuucgagcccgacaccgugaacgaccaguucaacaagaucgaguucgcgcaggacgcccaccggaugauccugcuggagcgcauccucuacaagaccgagugcgagaugcugagccugaagaagaacagcgggcccuacaacgucgccuggcggaccuacuucaagaaccacaacaucgaccucugcucccgccacaacuacaagaugaucugccagugcaucaacacccacagcaugugcaagaacacggacaucgacuacaacaaggagaucgagaccuacuacaaguccaacgccgccgcguaccgcgccgaccugaacaccaucauggacacccugaagacggccuuccggggccucaccaaggugcugaucgagaacuacaucgagaaggacgacagcgacgcccugaaggcccucuucuccaacaucaccgacagcgugcaggacaacuaccagaugaucgggauccugaaguucgcguccaagcugcucgacaucaaccugggccgcagcacccgguccgcccaccacagcaucaugaccaacgagauccccaaguccaacccguucacggacuacagcuacuccaaccugaacaucaaggagugcaugagccccgagucccucaagugcuucaagaagcgcgacagcacgccccacaccaaccaccuccugugcaagaucgacaacaaguacaaggccuucgacuggcccgagaucgagaccauccagaaggggcagaagcucugccugggcgacucccacugcaaccuggaguucaccgccaucaccgcggacaagaucaugagccucaccaacugcuacaaggagagcuucaccgcccagccggccgacaugcaggccggcaucaagaagugcuccgccgacgagaucggggagugcacgacccuggaggacaagaccuggcccaucaucuucugcggcgggaaguacuacuacagcgacuccaaggagcacgcgaaggacggcagcaucaacaacuacugccugaccaacaagugcuccgagcagcgguuccccauccacgagaacugguucaagaagugcaacugggacaagacgcacaaggaguucagcaccaugcgccagaucaacuacaacgacaucaccuccuaccggaaggccaucgagagcgagaucgggaccgaccucaugacgcaccacuacaagcccaccaagaaccugccgcacgucgugccccgcuaccacuccaucgacgugcagggcaccgagagcaccgagggcaucaucaacggguucauccagaacacgauccccgccaucuccggccugggggucggcuaccaccucaacuucaagggcaaccagcuguucgacaucgugaucuucgugaagaaggccgucuacaaggcccaguaccagaaggcguacaccaccgggcccagcaucuccaucaacaucgagcacaacgagcggugcaccggccacugcccggagaagauccccgccaaggagggguggcugacguucagcaaggagcacaccuccagcuggggcugcgaggaguacgggugccucgccaucgacaccggcugccuguacggcuccugccaggacgugauccgccccgagcuggacguguacaagaagaucgggagcgaggucucccucaucgagaucugcaucacccugccgcacgagacguacugcaacgacauggacauccuggagcccaucaucggcgacaagcucagcgccagcuuccagaacacccagaccaaccagcugcccacccugaucgcguacaagaaggggaagaucuacacgggccagaucaacgacaucgggaacaccgcccuccagugcggcuccauccaggugaucaacggcagcaccaucgggaccggcucccccaaguucgacuacaucugccacgccaugcggcgcaaggacgugaucguccggaagugcuucaacgacaacuaccagagcugcacgcgccuggagaagcggaacgaccugaucccguaccgcaagggggacgugaucgagguguccaagaccggcagcaacauggggcagaugaccuucaagaucgagcucggcgacaucaacuacaagaucuucaccaaguccaucgaccugcagaugagcggcaucugcgccgggugcaucgacugcgccgagggcaucuccugcagcaucaacgcggagguccccgccgagaccgugugccacugcaagacgaacugcgaggacuucaucaacaacaucguguucagcccccagaucaagaacuacaacaucaagguccacugcaagagcaagguggagaagaucaccgcccacaucugcgggcgggacaucgaccugcagcucaccaucaagcccuacaaccagaagaucgaccugucccagcuggacgagagcaacuacauccgcgaggaggaccuccagugcggcaccuggcugugcaaggugcagaaggaggggaucgacaucaucuucaagggccuguucuccggccucgggcgguacuggacgauccugaucuacagcaucaucggcgucgugaucaucgugauccuggucuacauccuccugccgaucgggcgccugcucaaggccuuccugauccgccacgagaucgaguacgccauggagcagaagaucaaguga

SEQ ID NO: 12693 - RNA, 4263 nt, Artificial Sequence
  derived and/or modified CDS sequence (opt1) from OROV(Tr9760)__AF312381.2__GP
auggccaaccugaucaucaucagcauggugcucuccaucgccuacggccacccccugagcaccucccagaucggggaccgcugcuucgcgggcgggaaccuguucaaggagaugaaccucagcgucggccugggggagaucugcgugaaggacgacaucuccaucgugaaguccaccacggucuucuccaagaacaagcuggcccucgaggccaccaccaaguucuaccggagcuucaucgugaaggacugguccgagugcaacccggugcuggacaaguucggcaacuucaugguccugagcguggacgacaacggccacaccauccccaagauguacacgugccgcgccgccugcgacauccggcucaacaaggacaacgcggagaucauccuguccagcaccaagcugaaccacuucgagaucguggggaccaccuccacgagcggcugguucaagaacaccaucaccaacaaccucgagcacacgugcgagcacgucacggugaacugcgggcagaaguccgugaaguuccacgccugcuuccgccagcaccggggcugcguccgcuucuucaaggggaccuacaugccccacagcaugaucgaggccaugugcgugaacaucgagcugaucauccugacccucuacaucuucgccgcgaucaucuucgcccugaucaucaccaaguccuacguggccuaccugcuccugccccuguucuacccggccacgugguucuacggcaaggucuacaagaagaucaacagcugccccaacugccuccuggccucccaccccuucaccagcugccccaagaucugcaucugcggcagccgguucuccugcaccgaggcgcugaaggugcaccgcauggggaaggacugccucggcuacaagagccuguccaaggcccggcagaugugcaagagcaaguccuggagcuucaccgccgccauccugacggggcucauccugauggaguucaucuccccgaucgccggcgagcgcauguacaagcuggaggagcucgcggacgaguucaucaagcugaccgagcaggucaacauccuggagcgggagauggaggugcucaagcagagcaucaucgugauguucgccaucauccuggugcugcuccuguucgagaacaugaucuucaaccgccuguuccggaucuucuaccgcuccugcagcaugugcggccucauccacuaccggcccgggcugaagaucgaccugaccaagaccaaccgcugcggcuccugcaucugcggguucgacgagcagcagagcuccggcuucgaguacgagaucuuccucacggacaugcacguccagaaggagagcugcaaguucagcccccgggugaaccacuuccgcaacaccaaggcccugcuguucgcccucgugaucugcgccaccaucuacaccgucuacgcggacgaggacugccugagcaaggacaucaagaucacguaccaggagcugcacaacugcaucgggcccaagaucaugggcgacacgugcguguccaagagcgagcucuacuccgaccuguucagcaagaaccuggucaccgaguacgacaagaaguacuucgagccggacaccgugaacgaccaguucaacaagaucgaguucgcccaggacgcccaccggaugauccugcucgagcgcauccuguacaagaccgagugcgagaugcugagccucaagaagaacuccggccccuacaacguggccuggcggacccaccugaagaaccacaacaucgaccugugcagccgccacaacuacaagaugaucugccagugcaucaacgcccacuccaugugcaagaacaccgacaucgacuacaacaaggagaucgagaccuacuacaagagcaacgcggccgccuaccgcgccgggcucaacacgaucauggacacccugaagaccgcguuccggggccugaccaagguccucaucgagaacuacaucgagaaggacgacuccgacgcccugaaggcccuguucagcaacaucaccgacuccgugcaggacaacuaccagaugaucgggauccucaaguucgccagcaagcugcuggacaucaaccucggccgcuccacgcggagcgcccaccacuccaucaugaccaacgagauccccaagagcaaccccuucaccgacuacuccuacagcaacgugaacaucaaggagugcauguccccggagagccugaagugcuucaagaagcgcgacuccacgccccacaccaaccaccuccugugcaagaucgacaacaaguacaaggcguucgacuggcccgagaucgagaccauccagaaggggcagaagcugugccugggcgacagccacugcaaccucgaguucaccgccaucaccgccgaccggaucaugagccugacgaacugcuacaaggaguccuucaccgcccagcccgccgacaugcaggcgggcaucaagaagugcagcgccgacgagaucggggagugcaccacccuggaggacaagacguggccgaucgucuucugcuccggcaaguacuacuacagcgacuccaaggagcacgccaaggacgggagcaucaacaacuacugccucaccaacaagugcuccgagcagcgcuuccccauccacgagaacugguucaagaagugcaacugggacaagacccacaaggaguuccggcccuacgagaccaacaacuacaacgacaucacgagcuaccgcaaggccaucgaguccgagaucggcaccgaccugaugacccaccacuacaagcccaccaagaaccugccgcacguggugccccgguaccacagcaucgacguccaggggacggaguccaccgagggcaucaucaacggcuucauccagaacaccauccccgccaucagcgggcucgacgugggcuaccaccugaacuucaaggggaaccagcuguucgacaucgugaucuucgucaagaaggcgguguacaaggcccaguaccagaaggccuacaccacgggccccuccaucagcaucaacaucgagcacaacgagcgcugcaccggccacugcccggagaagauccccgccaaggagggguggcucaccuucuccaaggagcacaccagcuccuggggcugcgaggaguacgggugccuggcgaucgacacgggcugccuguacgggagcugccaggacgugauccggcccgagcucgacgucuacaagaagaucggcuccgaggccagccugaucgagaucugcaucacccugccgcacgagaccuacugcaacgacauggacauccucgagcccaucaucggcgacaagcugagcgccuccuuccagaacacccagacgaaccagcugcccacccucaucgccuacaagaaggggaagaucuacaccggccagaucaacgacaucgggaacaccgcccugcagugcggcagcauccaggugaucaacggguccacgaucggcaccggcagccccaaguucgacuacaucugccacgcgaugcgccggaaggacgugaucguccgcaagugcuucaacgacaacuaccaguccugcacccggcuggagaagcgcaacgaccucaucccguaccggaagggggacgugaucgaggugagcaagaccggcuccaacauggggcagaugaccuucaagaucgagcugggcgacaucaacuacaagaucuucaccaagagcgucgaccugcagauguccgggaucugcgccggcugcaucgacugcgccgagggcaucagcugcuccaucaacgccgaggugcccgccgagaccgugugccacugcaagaccaacugcgaggacuucaucaacaacaucgucuucagcccccagaucaagaacuacaacaucaaggugcacugcaaguccaagguggagaagaucaccgcgcacaucugcgggcgcgacaucgaccuccagcugacggucaagcccuacaaccagaagaucgaccugagccagcucgacgaguccaacuacauccgggaggaggaccugcagugcggcaccuggcugugcaaggugcagaaggaggggaucgacaucauguucaagggccucuucagcgggcugggccgcuacuggaccauccugaucuacuccaucaucggcguggucaucaucgugauccucguguacauccugcugccgaucgggcgccuccugaaggccuuccugauccggcacgagaucgaguacgccauggagcagaagaucaaguga

SEQ ID NO: 12694 - RNA, 4263 nt, Artificial Sequence
  derived and/or modified CDS sequence (opt1) from OROV(TRVL-9760)__KC759123.1__GP
auggccaaccugaucaucaucagcauggugcucuccaucgccuacggccacccccugagcaccucccagaucggggaccgcugcuucgcgggcgggaaccuguucaaggagaugaaccucagcgucggccugggggagaucugcgugaaggacgacaucuccaucgugaaguccaccacggucuucuccaagaacaagcuggcccucgaggccaccaccaaguucuaccggagcuucaucgugaaggacugguccgagugcaacccggugcuggacaaguucggcaacuucaugguccugagcguggacgacaacggccacaucauccccaagauguacacgugccgcgccgccugcgacauccggcucaacaaggacaacgcggagaucauccuguccagcaccaagcugaaccacuucgagaucguggggaccaccuccaccagcggcugguucaagaacacgaucaccaacaaccucgagcacacgugcgagcacgucaccgugaacugcgggcagaaguccgugaaguuccacgccugcuuccgccagcaccggggcugcauccgcuucuucaaggggaccuacaugcccuacagcaugaucgaggccaugugcgucaacaucgagcugaucauccugacccucuacaucuucgccgcgaucaucuucgcccugaucaucaccaaguccuacguggccuaccugcuccugccccuguucuacccggccaccugguucuacggcaagguguacaagaagaucaacagcugccccaacugccuccuggccucccaccccuucacgagcugccccaagaucugcaucugcggcagccgguucuccugcaccgaggcgcugaagguccaccgcauggggaaggacugccucggcuacaagagccuguccaaggcccggcagaugugcaagagcaaguccuggagcuucaccgccgccauccugaccgggcucauccugauggaguucaucuccccgaucgccggcgagcgcauguacaagcuggaggagcucgcggccgaguucaucaagcugacggagcaggucaacauccuggagcgggagauggaggugcucaagcagagcaucaucgugauguucgccaucauccuggugcugcuccuguucgagaacaugaucuucaaccgccuguuccggaucuucuaccgcuccugcagcaugugcggccucauccacuaccggcccgggcugaagaucgaccugaccaagaccaaccgcugcggcuccugcaucugcggguucgacgagcagcagagcuccggcuucgaguacgagaucuuccucaaggacaugcacgugcagaaggagagcugcaaguucagcccccgggucaaccacuuccgcaacaccaaggcccugcuguucgcccucgugaucugcgcgacgaucuacaccguguacgccgacgaggacugccugagcaaggacaucaagaucaccuaccaggagcugcacaacugcaucgggcccaagaucaugggcgacacgugcgucuccaagagcgagcucuacuccgaccuguucagcaagaaccuggugaccgaguacgacaagaaguacuucgagccggacaccgucaacgaccaguucaacaagaucgaguucgcccaggacgcccaccggaugauccugcucgagcgcauccuguacaagaccgagugcgagaugcugagccucaagaagaacuccggccccuacaacguggccuggcggaccuaccugaagaaccacaacaucgaccugugcagccgccacaacuacaagaugaucugccagugcaucaacgcgcacuccaugugcaagaacacggacaucgacuacaacaaggagaucgagaccuacuacaagagcaacgccgccgccuaccgcgcggaccucaacaccaucauggacacccugaagacggccuuccgggggcugaccaaggugcucaucgagaacuacaucgagaaggacgacuccgacgcccugaaggcccuguucagcaacaucaccgacuccguccaggacaacuaccagaugaucggcauccucaaguucgccagcaagcugcuggacaucaaccucgggcgcuccacccggagcgcgcaccacuccaucaugaccaacgagauccccaagagcaaccccuucacggacuacuccuacagcaacgugaacaucaaggagugcauguccccggagagccugaagugcuucaagaagcgcgacuccacgccccacaccaaccaccuccugugcaagaucgacaacaaguacaaggccuucgacuggcccgagaucgagaccauccagaagggccagaagcugugccugggggacagccacugcaaccucgaguucaccgccaucaccgccgaccggaucaugagccugaccaacugcuacaaggaguccuucaccgcccagcccgcggacaugcaggccggcaucaagaagugcagcgccgacgagaucggcgagugcacgacccuggaggacaagaccuggccgaucguguucugcuccgggaaguacuacuacagcgacuccaaggagcacgccaaggacggcagcaucaacaacuacugccucaccaacaagugcuccgagcagcgcuuccccauccacgagaacugguucaagaagugcaacugggacaagacgcacaaggaguucagcaccaugcggcagaucaacuacaacgacaucaccuccuaccgcaaggccaucgagagcgagaucgggaccgaccugaugacgcaccacuacaagcccaccaagaaccugccccacgucgugccgcgguaccacuccaucgacgugcagggcaccgagagcaccgaggggaucaucaacggcuucauccagaacacgauccccgcgaucuccggccucggggucggcuaccaccugaacuucaaggggaaccagcuguucgacaucgugaucuucgugaagaaggccgucuacaaggcccaguaccagaaggccuacaccaccggccccagcaucuccaucaacaucgagcacaacgagcgcugcaccggccacugccccgagaagaucccggcgaaggagggguggcucacguucagcaaggagcacaccuccagcuggggcugcgaggaguacgggugccuggccaucgacaccggcugccuguacggguccugccaggacgugauccggcccgagcucgacguguacaagaagaucggcagcgaggccagccugaucgagaucugcaucacccugccccacgagacguacugcaacgacauggacauccucgagccgaucaucggcgacaagcuguccgccagcuuccagaacacccagaccaaccagcugcccacccucaucgccuacaagaaggggaagaucuacacgggccagaucaacgacaucgggaacaccgcgcugcagugcggcuccauccaggucaucaacgggagcaccaucggcaccggcucccccaaguucgacuacaucugccacgccaugcgccggaaggacgugaucgugcgcaagugcuucaacgacaacuaccagagcugcacgcggcuggagaagcgcaacgaccucauccccuaccggaagggggacgucaucgagguguccaagaccggcagcaacauggggcagaugaccuucaagaucgagcugggcgacaucaacuacaagaucuucaccaaguccguggaccugcagaugagcgggaucugcgccggcugcaucgacugcgccgagggcaucuccugcagcaucaacgccgaggucccggcggagaccgugugccacugcaagacgaacugcgaggacuucaucaacaacaucguguucagcccccagaucaagaacuacaacaucaagguccacugcaaguccaagguggagaagaucaccgcccacaucugcgggcgcgacaucgaccuccagcugaccgugaagcccuacaaccagaagaucgaccugucccagcucgacgagagcaacuacauccgggaggaggaccugcagugcggcaccuggcugugcaagguccagaaggaggggaucgacaucauguucaagggccucuucuccgggcugggccgcuacuggacgauccugaucuacagcaucaucggcguggugaucaucgucauccucguguacauccugcugcccaucgggcgccuccugaaggccuuccugauccggcacgagaucgaguacgccauggagcagaagaucaaguga

SEQ ID NO: 12695 - RNA, 4263 nt, Artificial Sequence
  derived and/or modified CDS sequence (opt1) from OROV(TVP-19244/DEI-216)__KP795073.1__GP
auggccaaccugaucaucaucagcaugauccucggcaucgccuacgggcacccccuguccaccagccagaucggcgaccgcugcuucgccgggggcauccuguucaaggagaugaaccucuccguggggcugggcgagaucugcgucaaggacgacaucagcaucgugaaguccaccacggccuucagcaagaacgcccuggcccucgaggccaccaccaaguucuaccgguccuucaucgugaaggacuggagcgagugcaacccgguccuggacaaguucggcaacuucauggugcugaacguggacgacaacgggcaccucguccccaagauguacacgugccgcgcggccugcgacauccggcugaacaaggacaacgccgagaucauccuguccagcaccaagcucaaccacuucgagaucgugggcaccaccuccaccagcgggugguucaagaacacgaucaccaacaaccuggagcacacgugcgagcacgugaccgucaacugcggccagaaguccgugaaguuccacgccugcuuccgccagcaccgggggugcauccgcuucuucaagggcaccuacaugcccuacagcaugaucgaggcgaugugcgugaacaucgagcugaucauccucacccuguacaucuucgccgccaucaucuucgcccugaucaucaccaaguccuacaucgccuaccuccugcugccccucuucuacccggucaccuggcuguacggcaagguguacaagcggaucaacagcugccccaacugccugcucgcgucccaccccuucacgagcugccccaagaucugcaucugcgggucccgcuucagcugcaccgaggcccugaaggugcaccggaugggcaaggacugccugggguacaagagccucuccaaggcccgccagaugugcaagagcaaguccuggagcuucaccgccgccauccugaccggccugauccucauggaguucgucuccccgaucgcgggcgagcggauguacaagcuggaggagcuggccgacgacuacaucgagcucacggagcaggucaacauccuggggaaggagaucaagauccugaagcagagcaucaucgugaugcucgccaucauccugauccugcuccuguccgagaacaucaucuucaacuaccuguucagcacccucuaccgcuccugcagcaugugcggccugauccacuaccggcccgggcugaagguggacuccaccaagaccaacaagugcggcagcugcaucugcggguucgacgagcagcaguccagcggcuucgaguacgagguguuccucaaggacaugcacgugcagcgcgaguccugcaaguucggcccccgggucaaccacuuccgcaacacgaagauccugcuguucaccguggccaucugcaccagcuucuacaccguguacgccgacgaggacugccucuccaagaacauccggaucacguaccaggagcugcacaacugcaucgggccccacaucaugggcgacacgugcaugagcaaguccgagcuguacagcgaccugcucagcaagaaccugaucaccgaguacgacaagaaguacuucgagccggacaccgucaacgaccaguucaacaagaucgaguucgcgcaggacgcccaccgcaugauccugcucgagcggauccuguacaagaccgagugcgagaugcugucccucaagaagaacagcgggcccuacaacguggccuggcgcaccuaccugaagaaccacaacaucgaccugugcucccggcacaacuacaagaugaucugccagugcaucaacacccacagcaugugcaagaacaccgacaucgacuucaacaaggagaucgagacguacuacaaggccaacgccgcggccuaccgcuccgacuucaacaccaucaucgacacccucaagaccgccuuccgcggccugaccaagguccugaucgagaacuacaucgagaaggacgacagcgacgcccucaaggcgcuguucuccaacaucacggacagcgugcaggacaacuaccagaugguggggguccugaaguucgccuccaagcuccugaacaucagccugggccggaccacccgcuccgcccagcacagcaucaugaccaacgagauccccaaguccaaccccuucacggacuacagcuacuccagcgugaacaucaaggagugcauguccccggagagccucaagugcuucaagaagcgggacagcgcgccccacaugaaccaccuccugugcaagauggacaacaaguacaaggccuucgacuggcccgagaucgagaccgugcagaagggccagaagcugugccugggggacucccacugcaaccuggaguucaccgcgaucaccgccgacaagaucaugagccucacgaacugcuacaaggaguccuucaccgcccagcccgccgacaugcagaccggcaucaagaagugcagcgccgacgagaucggggagugcaucacccuggaggacaaguccuggccgaucgucuucugcggcgacaaguacuacuacagcgacgggaaggagcacgcgaaggacggcuccaucaacaacuacugccuggccaacaagugcagcgagcagcgcuuccccauccacaagaacugguucaagaagugcaacugggacaagacgcacaaggaguucaccaccaugcggcagaucaacuacaacgacaucaccuccuaccgcaaggccaucgagagcgagaucggcacggaccucaugacccaccacuacaagcccaccaagaaccugccccacguggugccgcgguaccacuccaucgacguccaggggaccgagagcacggagggcaucaucaacggguucauccagaacaccauccccgccaucuccggccugggcgugggguaccaccucggcuucaaggggaaccagcuguucgacaucgugaucuucgucaagaaggccguguacaaggcgcaguaccagaagguguacaccaccggccccagcaucuccaucaacaucgagcacaacgagaagugcacggggcacugccccgagaagaucccggccaaggagggcuggcugaccuucagcaaggagcacaccuccagcuggggcugcgaggaguacgggugccucgccaucgacaccggcugccuguacggguccugccaggacgucauccgccccgagcuggacaucuacaagaagaucggcagcgaggccagccucaucgagaucugcaucacgcugccccacgagaccuacugcaacgacauggacauccuggagccgaucaucggggacaagcucuccgcgagcuuccagaacacccagaccaaccagcugcccaaccugauggccuacaagaagggcaagguguacacgggccagaucaacgacguggggaacaccgcccuccagugcggcuccauccaggucgugaacgggagcaccaucggcuccgggaaccccaaguucgacuacaucugccacgccaugcggcgcaaggacgugaucguccggaagugcuucaacgacaacuaccagagcugcacccgccugaacccccggaacgaccugaucccguaccgcaagggcgacaucaucgagaucuccaagacgggcagcaacauggggcagaugaccuucaagaucgagcucggcgacaucaacuacaagaucuucaccaaguccguggaccugcagaugagcgggaucugcgccggcugcaucgacugcgcggaggggaucuccugcagcaucaacgccgacguguccgccgagaccgucugccacugcaagaccaacugcgaggacuucaucagcaacaucgugaucagcccccagaucaagacguacaacaucaaggugcacugcaaguccaaggucaagaagaucaccgccaacaucugcggccggaacaucgaccugcagcucaccgugaagcccuacaaccagaagaucgaccugucccagcuggacgagagcaacuacaucaaggaggaggaccuccagugcggcaccuggcugugcaaggugcagaaggaggggaucgacaucgucuucaagggccuguucuccgggcucggcaaguacugggccauccugaucuacagcaucaucggcaucaucguggugauccugcucaucuacguccugcugcccaucgggcgccuccugaaggcguuccugaucaagaacgagaucgaguacacgauggagcagaagaucaaguga

SEQ ID NO: 12696 - RNA, 4263 nt, Artificial Sequence
  derived and/or modified CDS sequence (opt1) from OROV(TVP-19249/GML-444672)__KP795076.1__GP
auggccaaccugaucaucuucagcaucauccucggcaucgccuacgggcacccccuguccaccagccagaucggcgaccgcugcuucgccgggggcucccuguucaaggagaugaaccucagcguggggcugggcgagaucugcgucaaggacgacaucuccaucgucaagagcaccacggcguucuccaagaacacccuggcccucgaggccaccaccaaguucuaccggagcuucaucgugaaggacugguccgagugcaacccggugcuggacaagcugggcaacuucauggugcucaacguggacgacaacgggcaccuggucccccgcauguacacgugccgggccgcgugcgacauccgccugaacaaggacaacgccgagaucauccucagcuccaccaagcugaaccacuucgagaucgugggcaccaccagcacguccgggugguucaagaacaccaucaccaacaaccuggagcacacgugcgagcacgugaccgucaacugcggccagaaguccgugaaguuccacgccugcuuccggcagcaccgcgggugcauccgguucuucaagggcaccuacaugcccuacuccaugaucgaggccaugugcaucaacaucgagcucaucauccugacccuguacaucuucgcggccaucaucuucgcccucaucaucaccaagagcuacaucgccuaccugcugcucccccuguucuacccggugacguggcuguacggcaaggucuacaagcgcaucaacuccugcagcaacugccuccuggccucccaccccuucaccagcugccccaagaucugcaucugcgggagccgguucuccugcaccgaggcgcugaaggugcaccgcaugggcaaggacugccucggguacaagagccuguccaaggcccggcagaugugcaagagcaaguccuggagcuucaccgccgccauccugacgggccucauccugauggaguucgugucccccaucgccggcgagcgcauguacaagcuggaggagcucgcggacgacuacaucgagauggccgagcgggucgggaugcuggagaaggagaucaaggugcugaagcaguucaccaucgugaugcucgucaucauccugauccugcuccuguucgagaacaccaucuucaacuaccuguucaacacccucuaccgcagcugcuccaugugcggccugauccacuaccggccggggcugaagguggaccucacgaagaccaacaagugcggcagcugcaucugcggguucgacgagcagcaguccagcggcuucgaguacgagguguuccugaaggacaugcacauccagcgcgaguccugcaaguucggcccccgggucaaccacuuccgcaacaccaagauccugcuguucaccaucgccaucugcacgagcuucuacaccguguacgccgacgaggacugccuguccaagaacaucaagaucaccuaccaggagcugcacaacugcaucgggcccuacaucaugggcgacacgugcgugagcaaguccgagcuguacagcgaccuccuguccaagaaccugaucaccgaguacgacaagaaguacuucgagcccgacaccgucaacgaccaguucaacaagaucgaguucgcccaggacgcgcaccggaugauccuccuggagcgcauccuguacaagaccgagugcgagaugcucagccugaagaagaacagcgggccguacaacguggccuggcggaccuaccugaagaaccacaacaucgaccucugcucccgccacaacuacaagaugaucugccagugcaucaacaugcacagcaugugcaagaacacggacaucgacuucaacaacgagaucgagaccuacuacaaggccaacgccgccgcguaccgcuccgacuucuacaccaucaucgacacccugaagaccgccuuccggggccugacgaagguccucaucgagaacuacaucgagaaggacgacagcgacgcccugaaggcccuguucuccaacaucaccaacagcgugcaggacaacuaccagaugguggggguccucaaguucgcguccaagcugcugaacaucagccucggccgcuccacccggagcgcccagcacuccaucaugaccaacgagauccccaagagcaaccccuucacggacuacuccuacagcuccgugaacaucaaggagugcaugagccccgagucccugaagugcuucaagaagcgcgacagcgugccgcacaccaaccaccuccucugcaagauggacaacaaguacaaggccuucgacuggcccgagaucgagaccguccagaagggccagaagcugugccugggggacagccacugcaaccucgaguucaccgccaucacggccgacaagaucaugucccugaccaacugcuacaaggagagcuucaccgcgcagcccgccgacaugcagaccggcaucaagaagugcuccgccgacgagaucggggagugcaucacgcuggaggacaaggccuggcccaucguggugugcggcgacaaguacuacuacagcgacgggaaggagcacgccaaggacggcuccaucaacaacuacugccucgcgaacaagugcagcgagcagcgguucccgauccacaagaacugguucaagaagugcaacugggacaagacccacaaggaguucaccaccaugcgccagaucaacuacaacgacaucacguccuaccggaaggccaucgagagcgagaucggcaccgaccugaugacccaccacuacaagcccaccaagaaccugccccacgucgugccccgcuaccacuccaucgacgugcaggggacggagagcaccgagggcaucaucaacggguucauccagaacaccaucccggccaucuccggccucggcgucggguaccaccugggcuuccgggggaaccagcuguucgacaucgugaucuucgugaagaaggccgucuacaaggcccaguaccagaagguguacaccacgggccccagcaucuccaucaacaucgagcacaacgagaagugcaccgggcacugccccgagaagauccccgcgaaggagggcuggcucaccuucagcaaggagcacaccuccagcuggggcugcgaggaguacgggugccuggccaucgacacgggcugccuguacggguccugccaggacgugauccgcccggagcucgacaucuacaagaagaucggcagcgaggccucccugaucgagaucugcaucacccugccccacgagaccuacugcaacgacauggacauccucgagcccaucaucggggacaagcugagcgccagcuuccagaacacccagacgaaccagcugccgguccucauggcguacaagaagggcaagguguacaccggccagaucaacgacguggggaacaccgcccugcagugcggcuccauccaggucgugaacgggagcaccaucggcuccgggaaccccaaguucgacuacaucugccacgccaugcggcgcaaggacgugaucguccggaagugcuucaacgacaacuaccagagcugcacgcgccuggacgcccggaacgaccucauccccuaccgcaagggcgacaucaucgagaucuccaagaccggcagcaacauggggcagaugaccuucaagaucgagcugggcgacaucaacuacaagaucuucaccaaguccguggaccugcagaugagcgggaucugcgccggcugcaucgacugcgcggaggggaucuccugcagcaucaacgccgacguguccgccgagaccgucugccacugcaagacgaacugcgaggacuucaucagcaacaucgugaucagcccccagaucaagaccuacaacaucaaggugcacugcaagagcaaggucgagaagaucaccgccaacaucugcggccggaacaucgaccuccagcugaccgugaagccguacaaccagaagaucgaccugucccagcucgacgagagcaacuacaucaaggaggaggaccugcagugcggcacguggcugugcaaggugcagaaggaggggaucgacaucgucuucaagggccucuucuccgggcugggcaaguacuggaccauccugaucuacagcaucaucggcaucaucgugaucgugcuccugaucuacguccugcuccccaucgggcgccugcugaaggccuuccucaucaagaacgagaucgaguacaccauggagcagaagaucaaguga

SEQ ID NO: 12697 - RNA, 4263 nt, Artificial Sequence
  derived and/or modified CDS sequence (opt1) from OROV(TVP-19254/GML-480914)__KP795082.1__GP
auggccaaccugaucaucaucagcauggugcucuccgucgccuacggccacccccugagcaccucccagaucggggaccgcugcuucgcgggcgggaaccuguucaaggagaugaaccucagcgugggccugggggagaucugcgugaaggacgacaucuccaucgucaagagcaccacggccuucuccaagaacaagccggcccuggaggccaccaccaaguucuaccggagcuucaucgugaaggacugguccgagugcaaccccgugcucgacaaguucggcaacuucaugguccugagcguggacgacaacggccacaucauccccaagauguacacgugccgcgccgcgugcgacauccggcugaacaaggacaacgccgagaucauccucuccagcaccaagcugaaccacuucgagaucguggggaccaccuccaccagcggcugguucaagaacacgaucaccaacaaccuggagcacacgugcgagcacgucaccgugaacugcgggcagaaguccgugaaguuccacgccugcuuccgccagcaccggggcugcauccgcuucuucaaggggaccuacaugcccuacagcaugaucgaggccaugugcgucaacaucgagcucaucauccugacccuguacaucuucgcggccaucaucuucgcccucaucaucaccaaguccuacguggccuaccugcugcucccgcuguucuaccccgugaccugguucuacggcaaggucuacaagaagaucaacagcugccccaacugccugcucgccucccaccccuucacgagcugcccgaagaucugcaucugcggcagccgguucuccugcaccgaggcgcugaaggugcaccgcauggggaaggacugccugggcuacaagagccucuccaaggcccggcagaugugcaagagcaaguccuggagcuucaccgccgccauccugaccgggcugauccucauggaguucaucucccccaucgccggcgagcgcauguacaagcuggaggagcuggcggacgaguucaucaagcucacggagcaggucaacauccuggagcgggagauggaggugcugaagcagagcgugaucgugaugcucgccaucauccugguccugcuccuguucgagaacaugaucuucaaccgccuguuccggaucuucuaccgcuccugcagcaugugcggccucauccacuaccggcccgggcugaagaucgaccugaccaagaccaaccgcugcggcuccugcaucugcggguucgacgagcagcagagcuccggcuucgaguacgagaucuuccucaaggacaugcacauccagaaggagagcugcaaguucagcccccgggugaaccacuuccgcaacaucaaggcccugcuguucgcccucgugaucugcgccaccaucuacacggucuacgcggacgaggacugccuguccaagaacaucaagaucaccuaccaggagcugcacaacugcaucgggccgaagaucaugggcgacacgugcguguccaagagcgagcucuacuccgaccuguucagcaagaaccuggucaccgaguacgacaagaaguacuucgagcccgacaccaucaacgaccaguucaacaagaucgaguucgcccaggacgcccaccggaugauccugcucgagcgcauccuguacaagaccgagugcgagaugcugagccucaagaagaacuccggccccuacaacguggccuggcggaccuaccugaagaaccacaacaucgaccugugcagccgccacaacuacaagaugaucugccagugcaucaacacccacuccaugugcaagaacacggacaucgacuacaacaaggagaucgagaccuacuacaagagcaacgccgcggccuaccgcgccgaccucaacaccaucaucgacacccugaagacggccuuccgggggcugaccaaggugcucaucgagaacuacaucgagaaggacgacuccgacgcgcugaaggcccuguucagcaacaucaccgacuccguccaggacaacuaccagaugaucggcauccucaaguucgccagcaagcugcuggacaucaaccucgggcgcuccacccggagcgcccaccacuccaucaugaccaacgagauccccaagagcaacccguucacggacuacuccuacagcaacgugaacaucaaggagugcaugucccccgagagccugaagugcuucaagaagcgcgacuccacgccccacaccaaccaccuccucugcaagaucgacaacaaguacaaggccuucgacuggcccgagaucgagaccauccagaagggccagaagcugugccugggggacagccacugcaaccucgaguucaccgcgaucaccgccgacaagaucaugagccugaccaacugcuacaaggaguccuucaccgcccagccggccgacaugcaggccggcaucaagaagugcagcgcggacgagaucggcgagugcacgacccuggaggacaagaccuggcccaucguguucugcgggggcaaguacuacuacuccgacagcaaggagcacgccaaggacggguccaucaacaacuacugccucaccaacaagugcagcgagcagcgguuccccauccacgagaacugguucaagaagugcaacugggacaagacgcacaaggaguucuccaccaugaagcagaucaacuacaacgacaucaccagcuaccgcaaggccaucgaguccgagaucggcaccgaccugaugacgcaccacuacaagcccaccaagaaccugccgcacgucgugccccgguaccacagcaucgacgugcaggggaccgaguccaccgagggccucaucaacggcuucauccagaacacgauccccgccaucagcgggcugggcgucggguaccaccugaacuucaagggcaaccagcuguucgacaucgugaucuucgugaagaaggccgucuacaaggcgcaguaccagaaggccuacaccaccggccccuccaucagcaucaacaucgagcacaacgagcgcugcaccgggcacugcccggagaagauccccgccaaggagggcuggcugacguucuccaaggagcacaccagcuccugggggugcgaggaguacggcugccuggccaucgacaccgggugccucuacggcagcugccaggacgugauccggcccgagcuggacguguacaagaagaucggcuccgaggucagccugaucgagaucugcaucacccucccgcacgagacguacugcaacgacauggacauccuggagcccaucaucggggacaagcugagcgcguccuuccagaacacccagaccaaccagcuccccacccugaucgccuacaagaagggcaagaucuacacggggcagaucaacgacaucggcaacaccgcccugcagugcgggagcauccaggugaucaacggcuccaccaucggcaccgggagccccaaguucgacuacaucugccacgccaugcgccggaaggacgugaucguccgcaagugcuucaacgacaacuaccaguccugcacgcggcucgagaagcgcaacgaccugaucccguaccggaagggcgacgugaucgaggugagcaagaccggguccaacaugggccagaugaccuucaagaucgagcugggggacaucaacuacaagaucuucaccaagagcaucgaccuccagauguccggcaucugcgccggcugcaucgacugcgcggaggggaucagcugcuccaucaacgccgaggucagcgccgagaccgugugccacugcaagacgaacugcgaggacuucaucaacaacaucguguucagcccccagaucaagaacuacaacaucaagguccacugcaaguccaagguggagaagaucaucgcccacaucugcggcaaggacaucgaccugcagcugaccgugaagcccuacaaccagaagaucgaccucucccagcuggacgagagcaacuacauccgcgaggaggaccugcagugcgggaccuggcucugcaagguccagaaggagggcaucgacaucaucuucaaggggcuguucuccggccugggccgguacuggaccauccucaucuacagcaucaucgggguggugaucaucgucauccugguguacauccugcuccccaucggccgccugcugaaggccuuccucauccggcacgagaucgaguacgcgauggagcagaagaucaaguga

SEQ ID NO: 12698 - RNA, 4263 nt, Artificial Sequence
  derived and/or modified CDS sequence (opt1) from OROV(TVP-19256/IQE-7894)__KP795085.1__GP
auggccaaccugaucaucaucagcaugauccucggcaucgccuacgggcacccccuguccaccagccagaucggcgaccgcugcuucgccgggggcucccuguucaaggagaugaaccucagcguggggcugggcgagaucugcgucaaggacgacaucuccaucgucaagagcaccacggcguucuccaagaacgcccuggcccucgaggccaccaccaaguucuaccggagcuucaucgugaaggacugguccgagugcaacccggugcuggacaaguucggcaacuucauggugcugaacguggacgacaacgggcaccucguccccaagauguacacgugccgcgcggccugcgacauccggcugaacaaggacaacgccgaggugauccugagcuccaccaagcucaaccacuucgagaucgugggcaccaccagcaccuccgggugguucaagaacacgaucaccaacaaccuggagcacacgugcgagcacgucaccgugaacugcggccagaaguccgugaaguuccacgccugcuuccgccagcaccgggggugcauccgcuucuucaagggcgcguacaugcccuacagcaugaucgaggccaugugcgucaacaucgagcugaucauccucacccuguacaucuucgccgccaucaucuucgcccugaucaucaccaagagcuacaucgcguaccuccugcugccccucuucuacccggugaccuggcuguacggcaagguguacaagcggaucaacuccugccccaacugccugcucgccagccaccccuucaccuccugccccaagaucugcaucugcgggagccgcuucagcugcacggaggcccugaagguccaccggaugggcaaggacugccugggguacaagucccucagcaaggcccgccagaugugcaaguccaagagcugguccuucaccgccgcgauccugaccggccugauccucauggaguucgugagcccgaucgccggcgagcggauguacaagcuggaggagcuggccgacgacuacaucgagcucgccgagcaggucaacauccuggggaaggagaucaagauccugaagcaguccaucaucgugaugcucgccaucauccugauccugcuccugagcgagaacaucaucuucaacuaccuguucaagacccucuaccgcuccugcagcaugugcggccugauccacuaccggcccgggcugaagguggaccucacgaagaccaacaagugcggcuccugcaucugcggguucgacgagcagcagagcuccggcuucgaguacgagguguuccugaaggacaugcacguccagcgcgagagcugcaaguucggcccccgggugaaccacuuccgcaacaccaagauccuccucuucaccaucgcgaucugcacguccuucuacaccguguacgccgacgaggacugccugagcaagaacauccggaucaccuaccaggagcugcacaacugcaucgggccccacaucaugggcgacacgugcauguccaagagcgagcuguacuccgaccuccugagcaagaaccugaucaccgaguacgacaagaaguacuucgagccggacaccgucaacgaccaguucaacaagaucgaguucgcccaggacgcccaccgcaugauccuccuggagcggauccuguacaagaccgagugcgagaugcucagccugaagaagaacuccgggcccuacaacguggccuggcgcaccuaccugaagaaccacaacaucgaccucugcagccggcacaacuacaagaugaucugccagugcaucaacacgcacuccaugugcaagaacaccgacaucgacuucaacaaggagaucgagaccuacuacaaggcgaacgccgccgccuaccgcagcgacuucaacaccaucaucgacacgcugaagaccgcguuccgcggccugaccaagguccucaucgagaacuacaucgagaaggacgacuccgacgcccugaaggcccuguucagcaacaucaccgacuccgugcaggacaacuaccagaugguggggguccucaaguucgccagcaagcugcugaacaucucccucggccggaccacgcgcagcgcccagcacuccaucaugaccaacgagauccccaagagcaaccccuucaccgacuacuccuacagcuccgugaacaucaaggagugcaugagcccggagucccugaagugcuucaagaagcgggacagcgugccccacaccaaccaccuccugugcaagauggacaacaaguacaaggucuucgacuggcccgagaucgagacggugcagaagggccagaagcugugccugggggacagccacugcaaccucgaguucaccgcgaucaccgccgacaagaucaugucccugaccaacugcuacaaggagagcuucacggcccagcccgccgacaugcagaccggcaucaagaagugcuccgccgacgagaucggggagugcaucacccuggaggacaagagcuggccgaucguguucugcggcgacaaguacuacuacuccgaggggaaggagcacgcgaaggacggcagcaucaacaacuacugccucgccaacaagugcuccgagcagcgcuuccccauccacaagaacuggcugaagaagugcaacugggacaagacccacaaggaguucacgaccaugcggcgcaucaacuacaacgacaucaccagcuaccggaaggccaucgaguccgagaucggcaccgaccugaugacgcaccacuacaagcccaccaagaaccucccccacgucgugccgcgcuaccacagcaucgacgugcaggggaccgaguccaccgagggcaucaucaacggguucauccagaacacgauccccgccaucagcggccugggcgucggguaccaccugggcuucaaggggaaccagcuguucgacaucgugaucuucgugaagaaggccgucuacaaggcgcaguaccagaagguguacaccaccggccccuccaucagcaucaacaucgagcacaacgagaagugcaccgggcacugccccgagaagaucccggccaaggagggcuggcugacguucuccaaggagcacaccagcuccuggggcugcgaggaguacgggugccuggccaucgacaccggcugccucuacgggagcugccaggacgugauccggcccgagcuggacaucuacaagaagaucggcuccgaggccagccugaucgagaucugcaucacccucccccacgagacguacugcaacgacauggacauccuggagccgaucaucggggacaagcugagcgcguccuuccagaacacccagaccaaccagcuccccaaccugauggccuacaagaagggcaaggucuacaccggccagaucaacgacguggggaacacggcccugcagugcggcagcauccagguggucaacggguccaccaucggcagcgggaaccccaaguucgacuacaucugccacgccaugcgccggaaggacgugaucgugcgcaagugcuucaacgacaacuaccaguccugcacccggcucgacccccgcaacgaccugaucccguaccggaagggcgacaucgucgagaucagcaagaccggcuccaacauggggcagaugacguucaagaucgagcugggcgacaucaacuacaagaucuucaccaagagcguggaccuccagauguccgggaucugcgccggcugcaucgacugcgcggaggggaucagcugcuccaucaacgccgacgccagcgccgagaccgugugccacugcaagaccaacugcgaggacuucaucuccaacaucgucaucagcccccagaucaagaccuacaacaucaaggugcacugcaaguccaagguggagaagaucacggccaacaucugcggccgcaacaucgaccugcagcugaccgucaagcccuacaaccagaagaucgaccucagccagcuggacgaguccaacuacaucaaggaggaggaccugcagugcggcaccuggcucugcaaggugcagaaggaggggaucgacaucguguucaagggccuguucagcgggcugggcaaguacugggcgauccucaucuacuccaucaucggcgucaucguggugauccugcugaucuacguccuccugcccaucgggcggcugcucaaggccuuccugaucaagaacgagaucgaguacaccauggagcagaagaucaaguga

SEQ ID NO: 12699 - RNA, 4263 nt, Artificial Sequence
  derived and/or modified CDS sequence (opt1) from OROV(TVP-19257/IQT-1690)__KP795088.1__GP
auggccaaccugaucaucauccccaugauccucggcaucgccuacgggcacccgcugagcaccucccagaucggcgaccgcugcuucgccgggggcagccuguucaaggagaugaaccucuccguggggcugggcgagaucugcgucaaggacgacaucagcaucgugaaguccaccacggccuucagcaagaacgcccuggcccucgaggccaccaccaaguucuaccgguccuucaucgugaaggacuggagcgagugcaaccccguccuggacaaguucggcaacuucauggugcugaacguggacgacaacgggcaccucguccccaagauguacacgugccgcgcggccugcgacauccggcugaacaaggacaacgccgagaucauccuguccagcaccaagcucaaccacuucgagaucgugggcaccaccuccaccagcgggugguucaagaacacgaucaccaacaaccuggagcacacgugcgagcacgugaccgucaacugcggccagcgcuccgugaaguuccacgccugcuuccggcagcaccgcgggugcauccgguucuucaagggcaccuacaugcccuacagcaugaucgaggcgaugugcgugaacaucgagcugaucauccucacccuguacaucuucgccgccaucaucuucgcccugaucaucaccaaguccuacaucgccuaccuccugcugccccucuucuaccccgucaccuggcuguacggcaagguguacaagcgcaucaacagcugccccaacugccugcucgcgucccaccccuucacgagcugcccgaagaucugcaucugcgggucccgguucagcugcaccgaggcccugaaggugcaccgcaugggcaaggacugccugggguacaagagccucuccaaggcccggcagaugugcaagagcaaguccuggagcuucaccgccgccauccugaccggccugauccucauggaguucgucucccccaucgcgggcgagcgcauguacaagcuggaggagcuggccgacgacuacaucgagcucgccgagcaggucaacauccuggggaaggagaucaagauccugaagcagagcaucaucgugaugcucgccaucauccugauccugcuccuguccgagaacaucaucuucaacuaccuguucaacacgcucuaccggagcugcuccaugugcggccugauccacuaccgccccgggcugaagguggaccucaccaagaccaacaagugcggcagcugcaucugcggguucgacgagcagcaguccagcggcuucgaguacgagguguuccugaaggacaugcacgugcagcgggaguccugcaaguucggcccccgcgucaaccacuuccggaacaccaagauccugcuguucaucaucgccaucugcacgagcuucuacaccguguacgcggacgaggacugccuguccaagaacauccgcaucaccuaccaggagcugcacaacugcaucgggccgcacaucaugggcgacacgugcaugagcaaguccgagcuguacagcgaccuccuguccaagaaccugaucaccgaguacgacaagaaguacuucgagcccgacaccgugaacgaccaguucaacaagaucgaguucgcccaggacgcccaccggaugauccuccuggagcgcauccuguacaagaccgagugcgagaugcucagccugaagaagaacagcgggcccuacaacgucgccuggcggaccuaccugaagaaccacaacaucgaccucugcucccgccacaacuacaagaugaucugccagugcaucaacacgcacagcaugugcaagaacaccgacaucgacuucaacaaggagaucgagaccuacuacaaggccaacgcggccgccuaccgcuccgacuucaacaccaucaucgacacgcugaagaccgccuuccggggccugaccaaggugcucaucgagaacuacaucgagaaggacgacagcgacgcgcugaaggcccuguucuccaacaucaccgacagcguccaggacaacuaccagauggugggggugcucaaguucgccuccaagcugcugaacaucagccucggccgcaccacgcgguccgcccagcacagcaucaugaccaacgagauccccaaguccaacccguucaccgacuacagcuacuccagcgucaacaucaaggagugcaugucccccgagagccugaagugcuucaagaagcgcgacuccgcgccccacaccaaccaccuccucugcaagauggacaacaaguacaaggcguucgacuggcccgagaucgagacggugcagaagggccagaagcugugccugggggacagccacugcaaccucgaguucaccgccaucaccgccgacaagaucaugagccugaccaacugcuacaaggaguccuucacggcccagccggccgacaugcagaccggcgugaagaagugcagcgcggacgagaucggggagugcaucacccuggaggacaaguccuggcccaucgucuucugcggcgacaaguacuacuacagcgacgggaaggagcacgccaaggacggcuccaucaacaacuacugccucgccaacaagugcagcgagcagcgguuccccauccacaagaacugguucaagaagugcaacugggacaagacccacaaggaguucacgaccaugcgccagaucaacuacaacgacaucaccuccuaccggaaggccaucgagagcgagaucggcaccgaccugaugacgcaccacuacaagcccaccaagaaccugccgcacguggugccccgcuaccacuccaucgacguccaggggaccgagagcaccgagggcaucaucaacggguucauccagaacacgauccccgccaucuccggccucggcgugggguaccaccugggcuucaaggggaaccagcuguucgacaucgugaucuucgucaagaaggcgguguacaaggcccaguaccagaagguguacaccaccggccccagcaucuccaucaacaucgagcacaacgagaagugcaccgggcacugcccggagaagauccccgccaaggagggcuggcucacguucagcaaggagcacaccuccagcuggggcugcgaggaguacgggugccuggccaucgacaccggcugccuguacggguccugccaggacgucauccggcccgagcucgacaucuacaagaagaucggcagcgaggcgucccugcuggagaucugcaucacccucccgcacgagacguacugcaacgacauggacauccuggagcccaucaucggggacaagcugagcgccagcuuccagaacacccagaccaaccagcuccccaaccugauggccuacaagaagggcaagguguacaccggccagaucaacgacguggggaacacggcccugcagugcggcuccauccaggucgugaacgggagcaccaucggcuccgggaaccccaaguucgacuacaucugccacgccaugcgccggaaggacgugaucguccgcaagugcuucaacgacaacuaccagagcugcacccggcucgacccgcgcaacgaccugauccccuaccggaagggcgacaucaucgagaucuccaagaccggcagcaacauggggcagaugacguucaagaucgagcugggcgacaucaacuacaagaucuucaccaaguccguggaccuccagaugagcgggaucugcgcgggcugcaucgacugcgccgaggggaucuccugcagcaucaacgccgacguguccgccgagaccgucugccacugcaagaccaacugcgaggacuucaucagcaacaucgugaucuccccgcagaucaagaccuacaacaucaaggugcacugcaagagcaaggucgagaagaucacggccaacaucugcggccgcaacaucgaccugcagcugaccgugaagcccuacaaccagaagaucgaccucucccagcuggacgagagcaacuacaucaaggaggaggaccugcagugcggcaccuggcucugcaaggugcagaaggaggggaucgacaucgucuucaagggccuguucuccgggcugggcaaguacugggcgauccucaucuacagcaucaucggcaucaucguggugauccugcugaucuacguccuccugccgaucgggcggcugcucaaggccuuccugaucaagaacgagaucgaguacaccauggagcagaagaucaaguga

SEQ ID NO: 12700 - RNA, 4263 nt, Artificial Sequence
  derived and/or modified CDS sequence (opt1) from OROV(TVP-19258/IQT-4083)__KP795091.1__GP
auggccaaccugaucaucaucagcaugauccucggcaucgccuacgggcacccccuguccaccagccagaucggcgaccgcugcuucgccgggggcucccuguucaaggagaugaaccucagcguggggcugggcgagaucugcgucaaggacgacaucuccaucgucaagagcaccacggcguucuccaagaacgcccuggcccucgaggccaccaccaaguucuaccggagcuucaucgugaaggacugguccgagugcaacccggugcuggacaaguucggcaacuucauggugcugaacguggacaacaacgggcaccucguccccaagauguacacgugccgcgcggccugcgacauccggcugaacaaggacaacgccgagaucauccugagcuccaccaagcucaaccacuucgagaucgugggcaccaccagcaccuccgggugguucaagaacacgaucaccaacaaccuggagcacacgugcgagcacgugaccgucaacugcggccagaaguccgugaaguuccacgccugcuuccgccagcaccgggcgugcauccgcuucuucaaggggaccuacaugcccuacuccaugaucgaggccaugugcgugaacaucgagcugaucauccucacccuguacaucuucgccgccaucaucuucgcccugaucaucaccaagagcuacaucgcguaccuccugcugccccucuucuacccggccaccuggcuguacggcaaggucuacaagcggaucaacuccugccccaacugccugcucgccagccaccccuucacguccugccccaagaucugcaucugcggcagccgcuucagcugcaccgaggcccugaaggugcaccggauggggaaggacugccugggcuacaagucccucagcaaggcccgccagaugugcaaguccaagagcugguccuucaccgcggccauccugaccgggcugauccucauggaguucgugagcccgaucgccggcgagcggauguacaagcuggaggagcuggccgacgacuacaucgagcucacggagcaggucaacauccugggcaaggagaucaagauccugaagcaguccaucaucgugaugcucgccaucauccugauccugcuccugagcgagaacaucaucuucaacuaccuguucaacacccucuaccgcuccugcagcaugugcgggcugauccacuaccggcccggccugaagguggaccucaccaagaccaacaagugcggguccugcaucugcggcuucgacgagcagcagagcuccggguucgaguacgaggucuuccugaaggacaugcacgugcagcgcgagagcugcaaguucggcccccgggugaaccacuuccgcaacacgaagauccugcuguucaccaucgcgaucugcaccuccuucuacaccgucuacgccgacgaggacugccugagcaagaacauccggaucacguaccaggagcugcacaacugcaucggcccccacaucaugggggacacgugcaugccgaaguccgagcuguacagcgaccuccuguccaagaaccugaucaccgaguacgacaagaaguacuucgagcccgacaccgugaacgaccaguucaacaagaucgaguucgcccaggacgcccaccgcaugauccuccuggagcggauccuguacaagaccgagugcgagaugcucagccugaagaagaacagcggccccuacaacguggccuggcgcaccuaccugaagaaccacaacaucgaccucugcucccggcacaacuacaagaugaucugccagugcaucaacacccacagcaugugcaagaacaccgacaucgacuucaacaaggagaucgagacguacuacaaggcgaacgccgccgccuaccgcuccgacuucaacaccaucaucgacacccugaagaccgcguuccgcgggcugaccaagguccucaucgagaacuacaucgagaaggacgacagcgacgcccugaaggcccuguucuccaacaucacggacagcgugcaggacaacuaccagauggucggcgugcucaaguucgccuccaagcugcugaacaucagccucgggcggaccacccgcuccgcccagcacagcaucaugaccaacgagauccccaaguccaacccguucacggacuacagcuacuccagcaucaacaucaaggagugcaugucccccgagagccugaagugcuucaagaagcgggacuccgcgccccacaccaaccaccuccucugcaagaucgacaacaaguacaaggccuucgacuggcccgagaucgagaccgugcagaagggccagaagcugugccugggcgacagccacugcaaccucgaguucaccgccaucacggccgacaagaucaugagccugaccaacugcuacaaggaguccuucaccgcccagccggcggacaugcagaccgggaucaagaagugcagcgccgacgagaucggcgagugcaucacgcuggaggacaaguccuggcccaucaucuucugcggggacaaguacuacuacagcgacggcaaggagcacgccaaggacggguccaucaacaacuacugccucgccaacaagugcagcgagcagcgcuuccccauccacaagaacugguucaagaagugcaacugggacaagacccacaaggaguucaccaccaugcggcagaucaacuacaacgacaucacguccuaccgcaaggccaucgagagcgagaucggcaccgaccugaugacccaccacuacaagcccaccaagaaccugccgcacgucgugccccgguaccacuccaucgacgugcagggcacggagagcaccgaggggaucaucaacggcuucauccagaacaccauccccgcgaucuccgggcucggcgucggcuaccaccugggguucaagggcaaccagcuguucgacaucgugaucuucgugaagaaggccgucuacaaggcccaguaccagaagguguacaccacggggcccagcaucuccaucaacaucgagcacaacgagaagugcaccggccacugcccggagaagauccccgccaaggagggguggcucaccuucagcaaggagcacaccuccagcuggggcugcgaggaguacggcugccuggcgaucgacacggggugccuguacggcuccugccaggacgugauccgccccgagcucgacaucuacaagaagaucgggagcgaggccucccugaucgagaucugcaucacccugccgcacgagaccuacugcaacgacauggacauccucgagcccaucaucggcgacaagcugagcgccagcuuccagaacacccagacgaaccagcugcccaaccucauggccuacaagaaggggaaggucuacaccggccagaucaacgacgugggcaacaccgcccugcagugcggguccauccagguggucaacggcagcaccaucggguccggcaaccccaaguucgacuacaucugccacgcgaugcggcgcaaggacgugaucgugcggaagugcuucaacgacaacuaccagagcugcacgcgccuggacccgcggaacgaccucauccccuaccgcaagggggacaucaucgagaucuccaagaccggcagcaacaugggccagaugaccuucaagaucgagcugggggacaucaacuacaagaucuucaccaaguccgucgaccugcagaugagcggcaucugcgccgggugcaucgacugcgccgagggcaucuccugcagcaucaacgccgacguguccgccgagaccgugugccacugcaagacgaacugcgaggacuucaucagcaacaucgucaucagcccccagaucaagaccuacaacaucaaggugcacugcaagagcaagguggagaagaucaccgcgaacaucugcgagcggaacaucgaccuccagcugaccgucaagcccuacaaccagaagaucgaccugucccagcucgacgagagcaacuacaucaaggaggaggaccugcagugcgggacguggcugugcaaggugcagaaggagggcaucgacaucguguucaagggccucuucuccgggcugggcaaguacugggccauccugaucuacagcaucaucgggaucaucgucgugauccuccugaucuacgugcugcucccgaucggccgccugcugcgggccuuccucaucaagaacgagaucgaguacaccauggagcagaagaucaaguga

SEQ ID NO: 12701 - RNA, 4263 nt, Artificial Sequence
  derived and/or modified CDS sequence (opt1) from OROV(TVP-19259/IQT-7085)__KP795094.1__GP
auggccaaccugaucaucaucagcaugauccucggcaucgccuacgggcacccccuguccaucagccagaucggcgaccgcugcuucgccgggggcucccuguucaaggagaugaaccucagcguggggcugggcgagaucugcgucaaggacgacaucuccaucgucaagagcaccaccgccuucuccaagaacgcccuggcccucgaggccacgaccaaguucuaccggagcuucaucgugaaggacugguccgagugcaacccggugcuggacaaguucggcaacuucauggugcugaacguggacgacaacgggcaccucguccccaagauguacacgugccgcgcggccugcgacauccggcugaacaaggacaacgccgagaucauccugagcuccaccaagcucaaccacuucgagaucgugggcaccaccagcaccuccgggugguucaagaacaccaucacgaacaaccuggagcacacgugcgagcacgugaccgucaacugcggccagaaguccgugaaguuccacgccugcuuccgccagcaccgggggugcauccgcuucuucaagggcaccuacaugcccuacagcaugaucgaggcgaugugcgugaacaucgagcugaucauccucacccuguacaucuucgccgccaucaucuucgcccugaucaucaccaagagcuacaucgccuaccuccugcugccccucuucuacccggucaccuggcuguacggcaagguguacaagcggaucaacuccugccccaacugccugcucgcgagccaccccuucaccuccugccccaagaucugcaucugcgggagccgcuucagcugcacggaggcccugaaggugcaccggaugggcaaggacugccugggguacaagucccucagcaaggcccgccagaugugcaaguccaagagcugguccuucaccgccgccauccugaccggccugauccucauggaguucgucagcccgaucgcgggcgagcggauguacaagcuggaggagcuggccgacgacuacaucgagcucgccgagcaggucaacauccuggggaaggagaucaagauccugaagcaguccaucguggugaugcucgccaucauccugauccugcuccugagcgagaacaucaucuucaacuaccuguucaacacccucuaccgcuccugcagcaugugcggccugauccacuaccggcccgggcugaagguggaccucacgaagaccaacaagugcggcuccugcaucugcggguucgacgagcagcagagcuccggcuucgaguacgagguguuccugaaggacaugcacguccagcgcgagagcugcaaguucggcccccgggugaaccacuuccgcaacaccaagauccugcuguucaccaucgccaucugcacguccuucuacaccguguacgcggacgaggacugccugagcaagaacauccggaucaccuaccaggagcugcacaacugcaucgggccccacaucaugggcgacacgugcauguccaagagcgagcuguacuccgaccuccugagcaagaaccugaucaccgaguacgacaagaaguacuucgagccggacaccgucaacgaccaguucaacaagaucgaguucgcccaggacgcccaccgcaugauccuccuggagcggauccuguacaagaccgagugcgagaugcucagccugaagaagaacuccgggcccuacaacguggccuggcgcaccuaccugaagaaccacaacaucgaccucugcagccggcacaacuacaagaugaucugccagugcaucaacacgcacuccaugugcaagaacaccgacaucgacuucaacaaggagaucgagaccuacuacaaggccaacgcggccgccuaccgcagcgacuucaacaccaucaucgacacgcugaagaccgccuuccgcggccugaccaagguccucaucgagaacuacaucgagaaggacgacuccgacgcgcugaaggcccuguucagcaacaucaccgacuccgugcaggacaacuaccagaugguggggguccucaaguucgccagcaagcugcugaacaucucccucggccggaccacgcgcagcgcccagcacuccaucaugaccaacgagauccccaagagcaaccccuucaccgacuacuccuacagcuccgugaacaucaaggagugcaugagcccggagucccugaagugcuucaagaagcgggacagcgcgccccacaccaaccaccuccucugcaagauggacaacaaguacaaggcguucgacuggcccgagaucgagacggugcagaagggccagaagcugugccugggggacagccacugcaaccucgaguucaccgccaucaccgccgacaagaucaugucccugaccaacugcuacaaggagagcuucacggcccagcccgccgacaugcagaccggcaucaagaagugcuccgcggacgagaucggggagugcaucacccuggaggacaagagcuggccgaucgucuucugcggcgacaaguacuacuacuccgacgggaaggagcacgccaaggacggcagcaucaacaacuacugccucgccaacaagugcuccgagcagcgcuuccccauccacaagaacugguucaagaagugcaacugggacaagacccacaaggaguucacgaccaugcggcagaucaacuacaacgacaucaccagcuaccgcaaggccaucgaguccgagaucggcaccgaccugaugacgcaccacuacaagcccaccaagaaccugccccacguggugccgcgguaccacagcaucgacguccaggggaccgaguccaccgagggcaucaucaacggguucauccagaacacgauccccgccaucagcggccucggcgugggguaccaccugggcuucaaggggaaccagcuguucgacaucgugaucuucgucaagaaggcgguguacaaggcccaguaccagaagguguacaccaccggccccuccaucagcaucaacaucgagcacaacgagaagugcaccgggcacugccccgagaagaucccggccaaggagggcuggcucacguucuccaaggagcacaccagcuccuggggcugcgaggaguacgggugccuggccaucgacaccggcugccuguacgggagcugccaggacgucauccgccccgagcucgacaucuacaagaagaucggcuccgaggcgagccugaucgagaucugcaucacccugccccacgagacguacugcaacgacauggacauccucgagccgaucaucggggacaagcugagcgccuccuuccagaacacccagaccaaccagcugcccaaccucauggccuacaagaagggcaagguguacaccggccagaucaacgacguggggaacacggcccugcagugcggcagcauccaggucgugaacggguccaccaucggcagcgggaaccccaaguucgacuacaucugccacgccaugcggcgcaaggacgugaucguccggaagugcuucaacgacaacuaccaguccugcacccgccuggacccccggaacgaccucaucccguaccgcaagggcgacaucaucgagaucagcaagaccggcuccaacauggggcagaugacguucaagaucgagcugggcgacaucaacuacaagaucuucaccaagagcguggaccugcagauguccgggaucugcgcgggcugcaucgacugcgccgaggggaucagcugcuccaucaacgccgacgugagcgccgagaccgucugccacugcaagaccaacugcgaggacuucaucuccaacaucgugaucagcccccagaucaagaccuacaacaucaaggugcacugcaaguccaaggucgagaagaucacggccaacaucugcggccggaacaucgaccuccagcugaccgugaagcccuacaaccagaagaucgaccugagccagcucgacgaguccaacuacaucaaggaggaggaccugcagugcggcaccuggcugugcaaggugcagaaggaggggaucgacaucgucuucaagggccucuucagcgggcugggcaaguacugggcgauccugaucuacuccaucaucggcgugaucguggucauccuccugaucuacgugcugcuccccaucgggcgccugcugaaggccuuccucaucaagaacgagaucgaguacaccauggagcagaagaucaaguga

SEQ ID NO: 12702 - RNA, 4263 nt, Artificial Sequence
  derived and/or modified CDS sequence (opt1) from OROV(TVP-19262/OBS-9478)__KP795100.1__GP
auggccaaccugaucaucaucagcaugauccucggcaucgccuacgggcacccccuguccaccagccagaucggcgaccgcugcuucgccgggggcucccuguucaaggagaugaaccucagcguggggcugggcgagaucugcgucaaggacgacaucuccaucgucaagagcaccacggccuucuccaagaacgcccuggcccucgaggccaccaccaaguucuaccggagcuucaucgugaaggacugguccgagugcaacccggugcuggacaaguucggcaacuucauggugcugaacguggacaacaacgggcaccucauccccaagauguacacgugccgcgcggccugcgacauccggcugaacaaggacaacgccgagaucauccugagcuccaccaagcucaaccacuucgagaucaucggcaccaccagcaccuccgggugguucaagaacacgaucaccaacaaccuggagcacacgugcgagcacgucaccgugaacugcggccagaaguccgugaaguuccacgccugcuuccgccagcaccgggggugcauccgcuucuucaagggcaccuacaugcccuacuccaugaucgaggcgaugugcgucaacaucgagcugaucauccucacccuguacaucuucgccgccaucaucuucgcccugaucaucaccaagagcuacaucgccuaccuccugcugccccucuucuacccggcgaccuggcuguacggcaagguguacaagcggaucaacuccugccccaacugccugcucgccagccaccccuucacguccugccccaagaucugcaucugcgggagccgcuucagcugcaccgaggcccugaaggugcaccggaugggcaaggacugccugggguacaagucccucagcaaggcccgccagaugugcaaguccaagagcugguccuucaccgccgcgauccugaccggccugauccucauggaguucgucagcccgaucgccggcgagcggauguacaagcuggaggagcuggccgacgacuacaucgagcucacggagcaggucaacauccuggggaaggagaucaagauccugaagcaguccaucaucgugaugcucgccaucauccugauccugcuccugagcgagaacaucaucuucaacuaccuguucaacacccucuaccgcuccugcagcaugugcggccugauccacuaccggcccgggcugaagguggaccucaccaagaccaacaagugcggcuccugcaucugcggguucgacgagcagcagagcuccggcuucgaguacgagguguuccugaaggacaugcacgugcagcgcgagagcugcaaguucggcccccgggucaaccacuuccgcaacacgaagauccugcuguucaccaucgccaucugcaccuccuucuacaccguguacgcggacgaggacugccugagcaagaacauccggaucacguaccaggagcugcacaacugcaucgggccccacaucaugggcgacacgugcaugccgaaguccgagcuguacagcgaccuccuguccaagaaccugaucaccgaguacgacaagaaguacuucgagcccgggaccgugaacgaccaguucaacaagaucgaguucgcccaggacgcccaccgcaugauccuccuggagcggauccuguacaagaccgagugcgagaugcucagccugaagaagaacagcggccccuacaacgucgccuggcgcaccuaccugaagaaccacaacaucgaccucugcucccggcacaacuacaagaugaucugccagugcaucaacacccacagcaugugcaagaacaccgacaucgacuucaacaaggagaucgagacguacuacaaggccaacgcggccgccuaccgcuccgacuucaacaccaucaucgacacccugaagaccgccuuccgcgggcugaccaaggugcucaucgagaacuacaucgagaaggacgacagcgacgcgcugaaggcccuguucuccaacaucacggacagcgugcaggacaacuaccagauggucggcgugcucaaguucgccuccaagcugcugaacaucagccucggccggaccacccgcuccgcccagcacagcaucaugaccaacgagauccccaaguccaacccguucacggacuacagcuacuccagcaucaacaucaaggagugcaugucccccgagagccugaagugcuucaagaagcgggacuccgcgccccacaccaaccaccuccucugcaagaucgacaacaaguacaaggcguucgacuggcccgagaucgagaccguccagaaggggcagaagcugugccugggcgacagccacugcaaccucgaguucaccgccaucacggccgacaagaucaugagccugaccaacugcuacaaggaguccuucaccgcccagccggccgacaugcagaccgggaucaagaagugcagcgcggacgagaucggcgagugcaucacgcuggaggacaaguccuggcccaucaucuucugcggggacaaguacuacuacagcgacggcaaggagcacgccaaggacggcuccaucaacaacuacugccucgccaacaagugcagcgagcagcgcuuccccauccacaagaacugguucaagaagugcaacugggacaagacccacaaggaguucaccaucaugcggcagaucaacuacaacgacaucaccuccuaccgcaaggccaucgagagcgagaucgggacggaccugaugacccaccacuacaagcccaccaagaaccugccgcacguggugccccgguaccacuccaucgacguccagggcaccgagagcacggaggggaucaucaacggcuucauccagaacaccauccccgccaucuccggccucggggugggcuaccaccugggguucaagggcaaccagcuguucgacaucgugaucuucgucaagaaggcgguguacaaggcccaguaccagcgcguguacaccaccgggcccagcaucuccaucaacaucgagcacaacgagaagugcacgggccacugcccggagaagauccccgccaaggagggcuggcucaccuucagcaaggagcacaccuccagcugggggugcgaggaguacggcugccuggccaucgacaccgggugccuguacggcuccugccaggacgucauccggcccgagcucgacaucuacaagaagaucgggagcgaggcgucccugaucgagaucugcaucacgcugccgcacgagaccuacugcaacgacauggacauccucgagcccaucaucggcgacaagcugagcgccagcuuccagaacacccagaccaaccagcugcccaaccucauggccuacaagaagggcaagguguacacggggcagaucaacgacgugggcaacaccgcccugcagugcggguccauccaggucgugaacggcagcaucaucggguccggcaaccccaaguucgacuacaucugccacgccaugcgccggaaggacgugaucguccgcaagugcuucaacgacaacuaccagagcugcacccggcuggacccgcgcaacgaccucauccccuaccggaagggcgacaucaucgagaucuccaagaccgggagcaacaugggccagaugacguucaagaucgagcugggggacaucaacuacaagaucuucaccaaguccguggaccugcagaugagcggcaucugcgcggggugcaucgacugcgccgagggcaucuccugcagcaucaacgccgacguguccgccgagaccgucugccacugcaagaccaacugcgaggacuucaucagcaacaucgugaucagcccccagaucaagaccuacaacaucaaggugcacugcaagagcaaggucgagaagaucacggccaacaucugcgagcgcaacaucgaccuccagcugaccgugaagcccuacaaccagaagaucgaccugucccagcucgacgagagcaacuacaucaaggaggaggaccugcagugcggcaccuggcugugcaaggugcagaaggaggggaucgacaucgucuucaagggccucuucuccgggcugggcaaguacugggcgauccugaucuacagcaucaucggcaucaucguggugauccuccugaucuacguccugcucccgaucgggcggcugcugcgcgccuuccucaucaagaacgagaucgaguacaccauggagcagaagaucaaguga

SEQ ID NO: 12703 - RNA, 4299 nt, Artificial Sequence
  derived and/or modified CDS sequence (opt1) from OROV/FPV(Aus Ch 16129)__KF697137.1__GP
augaaguucgugagcauccugcucuucgucuccuggcugggcgccaccuaccagaaccccgugagccaccgccagaucggggagcggugcuucgccggcgggucccugaucaagaccgugaaccagacgagcggcgucuccgaggugugcgugcgcgacgacaucagcaugaucaaguccaucguccacaccaccaaggcgagcgacaccgccgugaacaacuacauccgguucuaccgcguguucaucgucaaggaguggcacgacugcaacccguuccccgaccccaaggggacguucauggugcucgacguguccagcaccaaccaccuggagcccaucaccuacaccugccggacgccgugcgagaucacccuggacaaggacuccgccgaggucacccucagcucccagaagaugaaccacuacgagaucagcggcuccaccaucaacaacggcugguucaagaacagcaucuccgugagccuggagcacacgugcgagcacaucaccguguccugcgggcagaagaccguccgcuuccacgccugcuuccggcagcaccgcagcugcacccgguucuucaagaacagcaugaugcccgcccgcaugacggaguccaucugccagaaccuggagaucauccuccugaccugcuucagcuucgugugcuucaucuuccugugcaucaucaccaagaccuacguggcguacguccucauccccguguucuaccccuucacguacaucuacggccggcuguacgacaaguacuucaagcugugcgagaacugccuccuggccgugcacccguucacccccugcgagaccgucugcgugugcgggucccaguacgccaacaccgagcagcugcgcacgcaccggaugaccaacaacugcaagggcuacaagagccucuccaagagccgcgccaugugcaaguccaaggggugcagcuucguggucgcgaucuucugcuccaucaucuucuucagcuucaucacccccaucaacucccaggaguacaagcugagcgaccugcccgacgaguucacccggcucgaggaggagaacacgaugcugaagauccgccugcucgugaucaagaucaccaucuccgucaucagcgugaccaucaccgugacgucccugaccgagcggaaggucuuccaggagcuguucaacgccaucuaccgccacugcccguucugcggcaugauccaccggcgccggggccuccgcguggugaacagcaccaccaacaagugcgggacgugcaucugcggcuacaaggaggagaccgagcacggggucgaguacgagaucuuccugaagaccaugcaccaggagaacgugaacugcauguucaagcccucccagcgccacuuccggaacuucaagauccugaucgccuuccucgccaugugcaugaucaucaccagcguguccgccgacgagaagcacugccugaaguacaaggagcccgucaagcugagcaaccucaccgagugccacagccuguggcugaacaucacggagugccagaucaaccaguccacccucuucgagacccugaagggcgagcagcuggugaccgacuucgacaagcccgacuucacgaucaugggccagaaguacgacaucgcgauggagcgcaucgagaacgcccagaaccuccaccacaugauccugcuggaguaccuccacgccaagagcaacugccugaaguacaagcagcugaaguccaacagcgggccguacaacauccccuggcggaccuacauccacggccacgggcucgacgugugcggccaguacuccuacaagcugaucugcaagugcaucagcaccgggaugcacugcgagaacaccgcccuggacaucuacaacgagaugcgccaguucuacacgaacaaccaggagaacuacaaccucgaccugaacaccgucaucaaggccaucggccuggcgaugcggggcaucgggcagaugaucaucgaggaguucuucggcgagucccagaucgaggagcugagcaacuuccucaacaugaccuccaagaaccuggggaccaacaagcagcugaucggccucaucaacuucgggcugaugcugcucgacaucaaccagacgaagaccccccagaucgaccccaagccgcgcacccugcaggcccggagcuccauccccaccggcacggagaucaccgacuggaccaagggccagagcaagaucaagaccugcgccgaguacuccacgcugaccugccagagcuggcgcaagaccgugaacaccaaguccuuccucaugugcaaggugagcuccaaguggcacgucuacaacuggcccgagauccccacgguggugcggaacagcaagcugugccugggggacuaccacugcaacauggaguucaccccgaucgacgccgacgaggcccucaagcagcugcgcugcuacaagaccgaguucguccccagccccgacggcauggacgaguccaucaagaagugcacccuggagaaguucgggggcugcacgaccgcgaacgggcacagcuggaccaucauggugugcaacggccgguacuaccagaccaacacgcgcgagcacgccaaggacggccuccugaacuccuacugcuucgagcccaagugccagagcgggcggcacccgauccacaaguccuuccugaacaacugcaucuggaaggagagcucccgccagaucaucgagacccggaccaucgaguacaacaacaucgaggacuacaagaagagcguggaguccgacaucaagagcgaccucaccauccaccacuucaagcccacgaagaaccugccccuggucaccccgaccuacaucuccgugguggccgacggcaccauggucagcgacgggauccagaacgccuacgugaagggcaccauccccggcaucuccgggguggccacgggccuccacgucaagacccccgacgggauccugcugauggacaucaucguguacgugcgcaaggcgcucuacaaggccaacuacgagaagaucuacagcaccggccccaccaucgggaucaacgucaagcacaacgagaagugcacgggcaccugcccggagcacauccccaaggacgagggcuggcugaccuucuccaaggagcacaccagcaacugggggugcgaggaguacggcugcuucgccaucaacuccgggugccuguacggcagcugccaggacaucauccggcccgagcucgacaucuacaagcagcagggggaggagcagacgcugcuggagcucugcaucacccugccccacgagaccuucugcaacgaccuggacgugcucgagccggugaucaccgacaagcugcagcuggacuuccagacgacccaguccgaccaccuccccgagcuggucgcccugaagaagggccucauccugaccggccagcugaacgaccucgggaacaccgcggccaugugcggcagcgugcagcuggugaacaagacgaucuacgggcagggcaaccccaaguucgacuucaucugccacgccaugcgccggaaggacgucaucgugcgccgcugcuacgacaaccacuacagcaccugcgcccugcucaagcagcggaacgaccugcugcacaaggaggugaacgaccagauguccaucaccgucaacgggaagaaccucggccugaucaacuuccgccugaaccucggcgaccugaacuacaagcuguucgugaacgagcccaacuucgagcucaccgggcagugcgccggcugcaucagcugcgcggacgagaucuccugccagcugaacaucaucgccgaccacgaguucacgugcaaggugagcuccagcugcaaccuguacaucuccaacaugaugaucaccccggccaaccacaucuacaaccucaaggucagcugccgggagcacguguccaacaucgaccuggccgugugcgggcgcagcuucucccugcacgccacccucaagcagcacagccagaagcuggaccuguccgcgcucgacgagaccaacuucgucaaggaggaggaccugcggugcggcacguggcugugcaaggugaaggacgaggggcucagcuuccugacccgcuccaucuucggcagccugggcaccuacugguccuacuucaucuacgggcucaucuucaugauccugcuguucaucgccaucuacuuccucuacccccugugcaagcggcugaagggccuccuggaggagaacgagcgcgaguaccugaucgagagcaagaugaaguga

SEQ ID NO: 12704 - RNA, 4257 nt, Artificial Sequence
  derived and/or modified CDS sequence (opt1) from OROV/IQTV(IQT9924)__KF697143.1__GP
auggacugcaucaucuucuaccugagcuucuucgccguggucaccgcccaccccgugucccaccaccaggugggcgaccgcugcuucgccgggggcaaccucaucaaggaccugaacaagaccgucaacaucggggaggugugcgugcgggacgacaucagcaucaucaaguccacgaccgccauccagaagucccuggaccaccucagcacccgcaccaaguucuaccgggucuacaucgugaaggagugggccgagugcaacccgaucaucgacuacgccggcaacuucaucgugaugaacaucgacgacaacgggcaccuggucccccgcaugcacacgugccgggccagcugcgacauccgccugaacaagaacgacgcggagaucauccucuccagccagaagaccaaccacuacgagaucaucggcaccaccacgguguccggcugguucaagaacaccaucaaccugccccuggagcacacgugcgagcacaucaccgugaacugcgggcagaagucccuccgguuccacgccugcuuccgcaugcaccggggcugcacccgcuucuucaagaacaccuacaugcccagcaccaugaucgagcacaugugcgucaaccuggagcugaucaucuucacccucuacaucuucacggcccugguguucgccuacaucaucaccaagagcuacaucgcguacauccugcucccgcuguucuacccccugaccuacguguucgggaucaucuacuccaagcucaagcagugcaagaccugcaugcuggccgcccaccccuucacgaacugccccaagcggugcgucugcggcagccgcuucaacugcaccgaggcccugcgggugcaccgccucgggcgggacugccagggcuacaagucccugagcaaggcccgccagaugugcaaguccaagagcugguccuucaucaucgcgaucuucaccggccugauccucauggaguucaucaccccgauccacggggagcggacguacaagcugagcgagcuggccgacgaguucaucgccaugaagaccgaggugaccgucaugcagcgcagcaucuacaaccagaagauccucaacaucgcccugcugacccucguggugcugaucauccugcucgagacguacaucuucaagauccuguucucccugcucuaccggagcugcuccaugugcggccugauccacuacaaggucgggcugaagaucaaccuccugaccaccaacaagugcgggaccugcaucugcggcuucagcgagcagcaguccagcggguucgaguacgagguguuccugaaggacaugcacaagcagcgcgaguccugcaaguacuuccccaugcucaaccacuuccggaaccugaagauccugacgaccauccuccugcugauccuccuggccaccagcguguccagcgagugccugcagaagccccugaagaucaagcucgaggaccugcacgagugcaucggcgucaacuuccuggacaagcagugcuacaaccgcaagaaccucuacgagucccugcgcagcaagaaccugaucuccgagguggacaagaaguacuucgagaacgcggaccucgaggggcaguucaagcggaucgaguacgcccaggacgcccaccgcaugauccugcuggagcggauccucuacagcaccgagugcgagaugcacacgauccugaccaacggcggggccuacaacauccccuggcgcaccuaccugaagaaccacaaccucaaccugugcggcaagcacguccacaagauggugugccagugcgugaacacccacacccagugccuguccacgggcaucgacuaccaggacgagaucaccaaguucuaccaggccgacggggacagcuaccgguccgaccucagcaucauccuggagaccaucuccaccgcguuccgcggccugacgaagguccucaucgagaccuacaucgagcaggacaacagcgagagcaugaucaagcugcugaacaccauccaggggaaggugccgaacaacuaccagaugcucggcauccugaaguucgccaucaagaucaugaacaucaaccagacccggggcgugcgcuccgcccggcacacgaucgucagcaacgacauccccauguccgagcccuucagcaacuucgagguguccaacaucaacaucaagcagugccuggagccccucacccugaagugcuucaccaagcgcggcgacagcccgcacuccaaccaccuccugugcaaggagcagagcaaguacaagguguucgaguggcccgaggucgagaccgugacgaagaacaacaagcugugccugggcgacacccacugcaaccucaaguucaccgccaccacguccgacgagaucaucaagcugcugaacugcuucagcgacaccuacaagcccaaccccggggagauggagaucggccucaagaagugcaacgccgagaagaucggggagugcgugacccuggagaacuccccguggcccaucgucuacugcgagaacaaguacuacuacagcgaggcgaaggagcacgccaaggacggcuccgugaacagcuacugccugaccaacaagugcacggaggaccggcuccccaucaaccccgccugguucaaguccugcaacugggagaagaacaucaaggagaccgccaccaucaaggaguucguguacaacgacaucaagagcuaccgcaagucccuggagagcgagaucaacaccgaccugaugauccaccacuaccggccgacgaagaaccucccccacaucaagcccaucuacaagagccuguccauccaggggagcgagaccgucgacggccugcagaacuccuucaucgagggcgagaugcccgcgaucagcgggcucgccaacggcuaccaccugauguacaaggggacccagcuguucgacaucgugaucuucauccgcaaggccguguacaaggccaacuacuacaagaucuacaccacgggcccguccaucgccaucaacauggagcacaacgagcagugcaccggccacugccccagcaagauccccuccaaggagaacuggcucaccuucagccgggagcacaccuccagcugggggugcgaggaguacggcugccuggcgaucgacacggggugccuguacggcuccugccaggacgucauccgcccggagaucgacguguacaagaaguccgggaccgagcagagccucaucgagcugugcaucaccagcgcccacgagaccuucugcaacgaccuggacauccucgagcccaucaucggcgagaagaucuccgccagcuuccaguccacgcagagcaaccagcugcccaacaucaucgccuuccggaagggccagauccugaccggggccaucaacgaccucggcaacaccgggucccagugcggcagcauccagcuggugaacaacacccugcucggggagggcaacgucaaguucgacuacaucugccacgcgaugcgccggaaggacgugaucauccgccgcugcuacaacgaccacuucaccagcugcaaccugcugcagaagcgguccgaccucaucggcaacaucaacgggaaggagcugcagaucagcauguccggccgcagcaugggguccaugaaguucaagaucgagcugggcgacaucaacuacaagcucuacacggagaacgccgacaucaccauccgcggggagugcggcggcugcaucgggugcgccgaggccgugagcugcucccuggaggucgagagcgccuccgagauccugugcaagguggagugcaacugccagcccuacaucgagaacauccucaucaagccgcagaccaagaccuacagcuucaaggcgacgugccuggagaaguccaacacccuggacaucaagaucugcggcaagcagaucaucgcgccccucaccaucaagagcuacaaccagaagaucgaccuguccaagcuggacgagagcaacuacgugaaggaggaggaccucgccugcaacaccuggcugugcaagguccagacggagggguucaacuucguguucuccggccuguucgccggguucggccgguacuggaccaucgcgaucuacauccucaucgccguggucaucauccugauccugaucuacauccucaugcccaucuuccggcugauccgcaccuuccugaucaagaacgagaucgaguacaccacggagcagaagaugcgguga

SEQ ID NO: 12705 - RNA, 4257 nt, Artificial Sequence
  derived and/or modified CDS sequence (opt1) from OROV/IQTV(MIS-0397)__KJ866387.1__GP
auggacugcaucaucuucuaccugagcuucuucgccguggucaccgcccaccccgugucccaccaccaggugggcgaccgcugcuucgccgggggcaaccucaucaaggaccugaacaagaccgucaacaucggggaggugugcgugcgggacgacaucagcaucaucaaguccacgaccgccauccagaagucccuggaccaccucagcacccgcaccaaguucuaccgggucuacaucgugaaggagugggccgagugcaacccgaucaucgacuacgccggcaacuucaucgugaugaacaucgacgacaacgggcaccuggucccccgcaugcacacgugccgggccagcugcgacauccgccugaacaagaacgacgcggagaucauccucuccagccagaagaccaaccacuacgagaucaucggcaccaccacgguguccggcugguucaagaacaccaucaaccugccccuggagcacacgugcgagcacaucaccgugaacugcgggcagaagucccuccgguuccacgccugcuuccgcaugcaccggggcugcacccgcuucuucaagaacaccuacaugcccagcaccaugaucgagcacaugugcgccaaccuggagcugaucaucuucacccucuacaucuucacggcccuggucuucgcguacaucaucaccaagagcuacaucgccuacauccugcucccgcuguucuacccccugaccuacguguucgggaucaucuacuccaagcucaagcagugcaagaccugcaugcuggccgcccaccccuucacgaacugccccaagcggugcgugugcggcagccgcuucaacugcaccgaggcccugcggguccaccgccucgggcgggacugccagggcuacaagucccugagcaaggcgcgccagaugugcaaguccaagagcugguccuucaucaucgccaucuucaccggccugauccucauggaguucaucaccccgauccacggggagcggacguacaagcugagcgagcuggccgacgaguucaucgccaugaagaccgaggugaccgugaugcagcgcagcaucuacaaccagaagauccucaacaucgcccugcugacccucgucgugcugaucauccugcucgagacguacaucuucaagauccuguucucccugcucuaccggagcugcuccaugugcggccugauccacuacaagcuggggcucaagaucaaccugcugaccaccaacaagugcgggaccugcaucugcggcuucagcgagcagcaguccagcggguucgaguacgagguguuccucaaggacaugcacaagcagcgcgaguccugcaaguacuuccccaugcugaaccacuuccggaaccugaagauccucacgaccauccugcugcucauccugcuggcgaccagcgucuccagcgagugccugcagaagccccucaagaucaagcuggaggaccugcacgagugcaucggcgugaacuuccucgaccgccagugcuacaaccgcaaggaccuguacgagucccugcggagcaagaaccucaucuccgagguggacaagaaguacuucgagagcgccgaccugggcggccaguucaagcgcaucgaguacgcccaggacgcccaccggaugauccugcucgagcgcauccuguacuccaccgagugcgagaugcacacgauccugaccaacgggggcgccuacaacauccccuggcggaccuaccucaagaaccacaaccugaaccugugcggcaagcacguccacaagauggugugccagugcgucaacacccacacccagugccucagcacggggaucgacuaccaggacgagaucaccaaguucuaccaggcggacggcgacuccuaccgcagcgaccuguccaucauccuggagaccaucagcaccgccuuccgggggcucacgaaggugcugaucgagaccuacaucgagcaggacaacagcgaguccaugaucaagcugcucaacaccauccagggcaaggugccgaacaacuaccagaugcuggggauccugaaguucgccaucaagaucaugaacaucaaccagacccgcggcguccggagcgcccgccacacgaucguguccaacgacauccccaugagcgagcccuucuccaacuucgaggccagcaacaucaacaucaagcagugcuccgagccccucacccugaagugcuucaccaagcggggcgacagcccgcacuccaaccaccuccugugcaaggagcagagcaaguacaagguguucgaguggcccgagaucgagaccgucacgaagaacaacaagcugugccugggggacacccacugcaaccucaaguucaccgcgaccacguccgacgagaucaucaagcugcugaacugcuucagcgacaccuacaagcccaaccccggcgagauggagaucgggcucaagaagugcaacgccgagaagaucggcgagugcgugacccuggagaacuccccguggcccaucguguacugcgagaacaaguacuacuacagcgaggccaaggagcacgccaaggacggguccgucaacagcuacugccugaccaacaagugcacggaggaccgccuccccaucaaccccgcgugguucaaguccugcaacugggagaagaacaucaaggagaccgccaccaucaaggaguucguguacaacgacaucaagagcuaccgcaagagccuggaguccgagaucaacaccgaccugaugauccaccacuaccggccgacgaagaaccucccccacaucaagcccaucuacaagagccuguccauccagggcagcgagaccguggacggccugcagaacuccuucaucgagggggagaugcccgccaucagcggccucgccaacggguaccaccugaccuacaagggcacccagcuguucgacaucgucaucuucauccggaaggccguguacaaggcgaacuacuacaagaucuacacgaccggcccguccaucgccaucaacauggagcacaacgagcagugcaccgggcacugccccagcaagauccccuccaaggagaacuggcucaccuucagccgcgagcacacguccagcuggggcugcgaggaguacgggugccuggccaucgacaccggcugccuguacggguccugccaggacgugauccggccggagaucgacgucuacaagaaguccggcaacgagcagagccucaucgagcugugcaucaccagcgcccacgagaccuucugcaacgaccuggacauccucgagcccaucaucggcgagaagaucuccgccagcuuccaguccacgcagagcaaccagcugcccaacaucaucgcguuccgcaaggggcagauccugaccggcgccaucaacgaccucgggaacaccggcagccagugcggguccauccagcuggugaacaacacccugcucggcgagggcaacgugaaguucgacuacaucugccacgccaugcggcgcaaggacgucaucauccgccggugcuacaacgaccacuucaccagcugcaaccugcugcagaagcgcuccgaccucaucgggaacaucaacggcaaggagcugcagaucagcauguccgggcggagcaugggcuccaugaaguucaagaucgagcugggggacaucaacuacaagcucuacacggagaacgccgacaucaccauccgcggcgagugcggcgggugcaucggcugcgccgaggcggugagcugcucccuggagguggagagcuccagcgagauccugugcaaggucgagugcaacugccagcccuacaucgagaacauccucaucaagccgcagaccaagaccuacuccuucaaggccacgugccuggagcggagcaacacccuggacaucaagaucugcgggaagcagaucaucgcgccccucaccaucaaguccuacaaccagaagaucgaccugagcaagcuggacgaguccaacuacgugaaggaggaggaccucgccugcaacaccuggcugugcaaggugcagacggagggcuucaacuucgucuucagcgggcuguucgcgggcuucggccgcuacuggaccaucgccaucuacauccucaucgccguggugaucauccugauccugaucuacauccucaugcccaucuuccggcugauccgcaccuuccugaucaagaacgagaucgaguacaccacggagcagaagaugcgguga

SEQ ID NO: 12706 - RNA, 4257 nt, Artificial Sequence
  derived and/or modified CDS sequence (opt1) from OROV/MDDV(FMD 1303)__KF697145.1__GP
auggccuuccugcucaucuacgugguccuggccgcggccguggccagccacccccuguccaaccaccagaucggcgaccgcugcuucgccgggggcaaccucauccgggagcugaacaagaccgugaacaucggggagcugugcguccgcgacgacaucagcaugaucaaguccaccacggccauccagaaguccgugggccaccucagcacccggaccaaguucuaccgcguguacaucgucaaggagugggcggagugcaacccgaucaucgacuucgccgggaacuucaucaucaugaacaucgacgagaacggccaccuggugcccaagaugcacacgugccgggccagcugcgacauccgccugaacaaggacgacgccgagaucauccucuccagccagaagaccaaccacuacgagaucaucggcaccaccuccaucagcgggugguucaagaacaccaucaaccugccccuggagcacacgugcgagcacaucaccgugaacugcggccagaagucccuccgguuccacgcgugcuuccgcaugcaccgggggugcacccgcuucuucaagaacaccuacaugcccagcacgaugaucgagaccaugugcgucaaccuggagcugaucaucuucacccucuacaucuucuccgccgccguguucgccuacgugaucaccaagagcuacaucgccuacauccugcugccggucuucuaccccaucacguacauccucggcuccaucuacagccgguucaagcagugcaagaccugcaugcuggcggcccaccccuucaccuccugccccaagaagugcgugugcgggagccgcuucaacugcaccgaggcccugcgggugcaccgccucggcaaggacugccagggcuacaagucccugagcaaggcccggcagaugugcaagagcaaguccuggagcuucaucaucgccgucuucacggggcugauccucauggaguucaucaccccgaucuccggcgagcgcauguacaagcugagcgagcuggcggaggaguucaucgagaugaaggaggaggccuccgcccucaagaaggccaucaacaaccugaagcugcucaacgugcugcugagcgccaucgcgacccucguggucgugauggagaccuacaucuucaagucccuguucaaccugcucuaccggagcugcuccaugugcgggcugauccacuacaagaucggccugcgcgugaaccuccugacgaccaaccggugcgggaccugcaucugcggguucaacgagcagcagagcuccggcuucgaguacgagaucuuccugaaggacaugcacaagcagcgcgagagcugcaaguacuuccccaugcucaaccacuuccggaacgucaagauccugaccguguuccugcuccugacgaugcugaccgccuccgccagcuccgagugccuccagaagccccugaagaucaagcuggaggaccugcacgagugcaucggggugaacuuccucaaccgccagugcuacaacagccaggagcuguaccagucccucaagagcaagaaccuggucuccgagguggacaagaaguacuucgacaacaagaaccuggaggaccuguucaagcgcaucgaguacgcccaggacgcccaccggaugauccuccuggagcgcauccuguacagcaccgagugcgagaugcacaccauccucacgaacggcggggcguacaacauccccuggcggaccuaccugaagaaccacaaccugaaccucugcggcaagcacguccacaagauggugugccagugcaucaacacccacacccagugccugagcacgggcaucgacuaccaggacgagaucaccaaguucuaccaggccgacggggacuccuaccgcgccgaccugagcgugauccuccagaccaucgccaccgcguuccggggcaugaccaagguccugaucgagacguacaucgagcaggacaacuccgagagcaugaucaagcugcucaacaccaucaaggagaaggugccgaacaacuaccagaugcuggggauccugaacuucgccaucaagaucauguccgugaaccagacccgcggcguccggagcgcccgccacaccaucaucuccaacgacauccccaugagcgagacguucuccaacuucgaggugagcaacaucgacgugaagcagugcaccgacccccucacccugaagugcuucaccaagcggggcgacgcgccccacuccaaccaccuccugugcaaggagcagaacaaguacaaggucuucgaguggccggagaucgagacggugaugaagaacaacaagcugugccugggcgacacccacugcaaccucaaguucgccgccaucgccagcgacgaggugaucaagcugcugaacugcuucuccgacaccuacaagcccaaccccggcgagauggaggucggggccaagaagugcaacgccgacaagaucggcgagugcaucacccucgagaacaaccccuggccgaucguguacugcgagacgaaguacuacuacagcgacgccaaggagcacgcgaaggacgggaacgugaacuccuacugccugaccaacaagugcaacgaggaccgcuuccccaucaaccccaccugguucaagagcugcuccugggaccggaacgucaaggagaccacgaccaucaaggaguucgugcacaacgacaucagcgccuaccgcaagagccuggaguccgagaucagcaccgaccuccugauccaccacuaccggcccaccaagaaccugccgcacaucaugcccgccuacaagucccucacgauccagggcagcgagaccguggacgggcugcagaacuccuucaucgagggcgagaugcccgccaucagcggccuggccaacggguaccaccucaaguacaagggcaucgagcuguucgacaucgucaucuucauccgcaaggcgguguacaaggccaacuacuacaagaucuacaccaccgggcccuccguggccaucaacauggagcacaacgagcagugcacgggcagcugcccgaagaagauccccgccaaggagaacuggcugaccuucuccaaggagcacaccagcuccuggggcugcgaggaguacgggugccucgcgaucgacaccggcugccuguacgggagcugccaggacgucauccggcccgagguggacguguacaagaaggccuccgccgagcagagccugaucgagcucugcaucacguccgcccacgagaccuucugcaacgaccuggacauccuggagccgaucaucggcgacaagaucagcgccgcguuccaguccacccaggucaaccagcuccccaacaucaucgccuucaagaaggggcagaucuucaccggcgccaucaacgaccugggcaacacggggagccagugcggcuccauccagcugaucaacaacacccuccugggggagggcaacgugaaguucgacuacaucugccacgccaugaagcgcaaggacgugaucguccggcgcugcuacaacgaccacuucgccagcugcaaccugcuccagaagcggagcgaccugguggggacccugaacggcaaggagcuccagguguccaugagcggccgcuccauggggagcaugaaguucaaggucgagcugggcgacaucuccuacaagcuguacaccgagaacgcggacaucagcaucuccggggagugcggcgggugcaucaacugcgccgaggccaucagcugcgcccucgagaucgacuccagcacggaggugcugugcaagcuggagugcuccugccagcccuacauccagaacauccucaucaagccccaggugaagaaguacagcuucaaggcgaccugcuucgagaagcgcaacucccuggaggucaccgugugcaagaagcagcacaccaucccgcugaccaucaagagcuacaaccagaagaucgaccucucccggcuggacgagagcaacuacgugcgcgaggaggaccugacgugcaacaccuggcucugcaaggucgagaaggagggcaucggcgugauguucuccgggcuguucgccggcuucgggaaguacuggagcaucgccaucuacgcccugaucgcccucgugaucuuccugauccugaucuacauccucguccccaucuuccggcugauccgcaccuuccugaucaagaacgagguggaguacaccacggagcagaagaugcgguga

SEQ ID NO: 12707 - RNA, 4257 nt, Artificial Sequence
  derived and/or modified CDS sequence (opt1) from OROV/MDDV(INHRR 17a-10)__KJ866390.1__GP
auggccuuccugcucaucuacgugguccuggccgcgaccguggccagccacccccuguccaaccaccagaucggcgaccgcugcuucgccgggggcaaccucauccgggagcugaacaagaccgugaacaucggggagcugugcguccgcgacgacaucagcaugaucaaguccacgaccgccauccagaaguccgugggccaccucagcacccggaccaaguucuaccgcguguacaucgucaaggagugggccgagugcaacccgaucaucgacuucgcggggaacuucaucaucaugaacaucgacgagaacggccaccuggugcccaagaugcacacgugccgggccagcugcgacauccgccugaacaaggacgacgccgagaucauccucuccagccagaagaccaaccacuacgagaucaucggcaccaccuccaucagcgggugguucaagaacacgaucaaccugccccuggagcacacgugcgagcacaucaccgugaacugcggccagaagucccuccgguuccacgccugcuuccgcaugcaccgggggugcacccgcuucuucaagaacacguacaugcccagcaccaugaucgagaccaugugcgucaaccuggagcugaucaucuucacccucuacaucuucuccgcggccguguucgccuacgugaucaccaagagcuacaucgccuacauccugcugccggucuucuaccccaucaccuacauccucggcuccaucuacagccgguucaagcagugcaagaccugcaugcuggccgcgcaccccuucaccuccugccccaagaagugcgugugcgggagccgcuucaacugcacggaggcccugcgggugcaccgccucggcaaggacugccagggcuacaagucccugagcaaggcccggcagaugugcaagagcaaguccuggagcuucaucaucgccgucuucaccgggcugauccucauggaguucaucaccccgaucuccggcgagcgcauguacaagcugagcgagcuggccgaggaguucaucgagaugaaggaggaggcguccgcccucaagaaggccaucaacaaccugaagcugcucaacgugcugcugagcgccaucgccacccucguggucgugauggagacgugcaucuucaagucccuguucaaccugcucuaccggagcugcuccaugugcgggcugauccacuacaagaucggccugcgcgugaaccuccugaccaccaaccggugcgggaccugcaucugcggguucagcgagcagcaguccagcggcuucgaguacgagaucuuccugaaggacaugcacaagcagcgcgaguccugcaaguacuuccccaugcucaaccacuuccggaacgucaagauccugacgguguuccugcuccugaccaugcugaccgcgagcgccuccagcgagugccuccagaagccccugaagaucaagcuggaggaccugcacgagugcaucggggugaacuuccucaaccgccagugcuacaacucccaggagcuguaccagagccugaaguccaagaaccucgucagcgagguggacaagaaguacuucgacaacaagaaccuggaggaccuguucaagcgcaucgaguacgcccaggacgcccaccggaugauccuccuggagcgcauccuguacagcaccgagugcgagaugcacacgauccucaccaacggcggggccuacaacauccccuggcggaccuaccugaagaaccacaaccugaaccucugcggcaagcacguccacaagauggugugccagugcaucaacacccacacgcagugccuguccaccggcaucgacuaccaggacgagaucaccaaguucuaccaggcggacggggacagcuaccgcgccgaccuguccaucauccucgagaccaucgccaccgccuuccggggcaugacgaaggugcugaucgagaccuacaucgagcaggacaacagcgaguccaugaucaagcugcucaacaccaucaaggagaaggucccgaacaacuaccagaugcuggggauccugaacuucgcgaucaagaucaugagcgugaaccagacccgcggcgugcgguccgcccgccacacgaucaucagcaacgacauccccauguccgagaccuucaccaacuucgaggucagcaacaucgacgugaagcagugcaccgacccccucacgcugaagugcuucaccaagcggggcgacgcgccccacuccaaccaccuccugugcaaggagcagaacaaguacaagguguucgaguggccggagaucgagaccgucaugaagaacaacaagcugugccugggcgacacccacugcaaccucaaguucgccgccaucgccagcgacgaggugaucaagcugcugaacugcuucuccgacacguacaagcccaaccccggcgagauggagguggggaccaagaagugcaacgccgacaagaucggcgagugcaucacccucgagaacaaccccuggccgaucgucuacugcgagaccaaguacuacuacagcgacgccaaggagcacgccaaggacgggaacgugaacuccuacugccugacgaacaagugcaacgaggaccgcuuccccaucaaccccaccugguucaagagcugcuccugggaccggaacgugaaggagaccaccacgaucaaggaguucguccacaacgacaucagcgccuaccgcaagagccuggaguccgagaucagcaccgaccuccugauccaccacuaccggcccaccaagaaccugccgcacaucaugcccgcguacaagucccucaccauccagggcagcgagacgguggacgggcugcagaacuccuucaucgagggcgacaugcccgccaucagcggccuggccaacggguaccaccucaaguacaagggcaucgagcuguucgacaucgugaucuucaucaagaaggccgucuacaaggccaacuacuacaagaucuacaccaccgggcccuccguggcgaucaacauggagcacaacgagcagugcaccggcagcugcccgaagaagauccccgccaaggagaacuggcugacguucuccaaggagcacaccagcuccuggggcugcgaggaguacgggugccucgccaucgacaccggcugccuguacgggagcugccaggacgugauccgccccgagaucgacgucuacaagaaggccuccgcggagcagagccugaucgagcucugcaucaccuccgcccacgagacguucugcaacgaccuggacauccuggagccgaucaucggcgacaagaucagcgccgccuuccaguccacccaggugaaccagcuccccaacaucaucgccuucaagaaggggcagaucuucaccggcgcgaucaacgaccugggcaacaccgggagccagugcggcuccauccagcugaucaacaacacgcuccugggggagggcaacgugaaguucgacuacaucugccacgccaugaagcggaaggacgucaucgugcgccggugcuacaacgaccacuucgccagcugcaaccugcuccagaagcgcagcgaccugguggggacccugaacggcaaggagcuccaggucuccaugagcggccgguccauggggagcaugaaguucaagguggagcugggcgacaucuccuacaagcuguacaccgagaacgccgacaucagcaucuccggggagugcggcgggugcaucaacugcgccgaggcgaucagcugcgcccucgagaucgacuccagcaccgaggugcugugcaagcuggagugcuccugccagcccuacauccagaacauccucaucaagccccaggucaagaaguacagcuucaaggcgaccugcuucgagaagcgcaacucccuggaggugacggugugcaagaagcagcacaccaucccgcugaccaucaagagcuacaaccagaagaucgaccucucccgccuggacgagagcaacuacguccgggaggaggaccugaccugcaacacguggcucugcaagguggagaaggagggcaucggcgugauguucuccgggcuguucgccggcuucgggaaguacuggagcaucgccaucuacgcccugaucgcccucgucaucuuccugauccugaucuacauccucgugcccaucuuccgccugauccggaccuuccugaucaagaacgagguggaguacaccaccgagcagaagaugcgcuga

SEQ ID NO: 12708 - RNA, 4257 nt, Artificial Sequence
  derived and/or modified CDS sequence (opt1) from OROV/Perdoes virus(BeAn789726)__KP691625.1__GP
auguucauccaguucaaccuggccuucuucugccucagcaucgugugcggccacccccugaccaaggaccacaucggggaccgcugcuucgccggcgggaaccuguucaaggagaucacccagacgaccggccucuccgagaucugcaucaaggacgacaucagcaucaucaagucccaggucgagaucaagaagcagagcuccgaggugaccuacgcggugaaguucuaccgggucuaccuggugaaggaguggagcgagugcaacccgauccaggaccagcacggguccaucaugauccuggacgugaccaacacgggccucaucguccccaagauguacacgugccgcgccgccugcgacaucacccuggacaaggacaacgccgaggugguguucaucagccagaagaacaacaacuacgagcuggccggcaccaccgucaugcacgggugguucaagaacgugguguccaucaagcucgagcacacgugcgagcaccugaccgcgaccugcggccagaagaccgucaaguuccacgccugcuuccggcagcaccgcgccugcgcccgguuccugaagaccaccuacaugcccaucgugaugguggagagccucugcuccaaccuggagcuggucaucuucaucaccuacaucuucgugugccucgcguucgccuucaucaucacgcgcaccuacguggccuaccugcugauccccgucuucuacccguucaccuacgccuacgggaagauguaccucaagugcgugaagaccugccccaacugccugcuggccaugcaccccuucacgaacugcaccaaccucugcaucugcggcagccgguucuccaacaccgagagccugaaggugcaccgccuggggaacugcuacggcuacaaggcgcucuccggcgcccggagcaugugcaaguccaaggucagcuccuucaccacggccauguucuucgggaucaucauccugagcuucaucgcgccccugaacggcgagcgccucuacaagcugagcgagcugccggacgaguacaucgagauggaguccaccaucgaggggagcaagcagaaggagaccaucguggacaucaucaacuacaccgcccucgugcugauccugaucacgauccuccugcagggcauccuggagaacuacaucuuccggcucaaguuccgcuucugcuccuucugcgacaugauccacaugaagaagaaccugaagaucuucagcaacaugaccaacaagugcgggaccugcaucugcggcuucaaccaggagauccgguccggcuucgacuacgaggucuucaucaaggacaugcacgugagccgcgaguccugcaaguacaacuaccacaagaacuacagcuucuacaucaagaugcugcucgucgugcugcuggugccccucaucgggaccacggccgccgaggacaccaagugccugaaguacgaccugaacaagaacaucgaggaccucaaggacugcuacggccugaagcugaacaucgacaagcacgacaccgucgagaacgccuacaagaaccucguggaccagaagcugguguccgagcuggaccggcuggaccucaacaucaugcuggggagcaaggaguccaucuucgaggccaucgagaccagcaugaacauccaccagauggucuuccuggaguaccucgccuacaagacggaccccaagcuguccgagaucaagcagaacaccggccccuacaacaucgcguggcgcaccuucauccacggcaacagccuggaggugugcgggaacuacccguacaagcucaucugcuacugcaucaaccagaagacccacugcgagaacuccaccguggacuacggcauccagauccagcccuucuacaaccagcaccccaacagcuacaaguccgacauggaggcccugaucaagacgguccagaucgccuuccgggggaucaucaaggugcugauccaguacuacguggagaacaacaagaccagcgagcucuccaaccugcugaccgagcuccgcaacgucaugggcaacaacauccagaugaaggggauccugaaguaccuggagaccuaccucaagaagccccugcugauggcccggacgauccgcaucgccgcgaagguggacaccagcggcgacccguacaacaacuucagcaccuccaaggagaacaucaccaagugcaucaagauccagaagcuccggugcaucacgaagcugacccgcaucgagcacaacuacauccugugcggcgacagcgagaagaagcucuaccaguggcccgccaagcccaccaucguggacgacaacgacgccugccugggggacaagcacugccaccuccccuucaucccgaucggcaacgacgaggccaucaagaccgucaacugcuacguggagguguacgagcagaaccccggggacaugaacuccuaccagaagaagugcgacgcgaugaacgucggcacgugccucaccaucaagaacgagaacuggcccaucgugcagugcaagaccgggaaguacuacuacgccgacggccgcauccacgccaaggacggcaccaucaacacguacugcuucagcgagaagugcaacgccgaccgguaccccauccaccaggacuacaucaacuccugcaacuggcaggagaccaucaaggacuuccagcacgugcgcgaguucguccaccuggacaucgagagcuacaagaaggccaucgaguccgacaucaagaccgaccugguggugcacaaguuccggccggucaagaaccucccccacgugauccccaucuacaagagcaucaccgugcaggggacggagaccuccgacggcauccagaacgcguucauccaggggagcaugcccgccaucuccggccuggccaacggcuaccaccuguucaccccggacagcaagcagcuguucgacgucgugcuguuccugcgcaaggccuccuacaaggccgaguaccggaagaucuacagcaccgggcccacgaucggcaucaacguggagcacaacgagaagugcaccggguccugccccaagaccaucgacaagaaggacaacuggcucaccuucagcaaggagcacacgucccaguggggcugcgaggaguacgggugccuggcgaucaacaccggcugcgucuucggcagcugccaggacaucauccgcccggagaucgacguguacaagaugcacggggccgagcggagcguggucgagcugugcaucacccucccccacgagaccuacugcaacgaccuggacgugcuggagcccaucaucggcgacaagauccaggccgccuuccagacggugcaguccaaccacaugccccgccucauggccaucaagaacaacaaggcguucaccgggcagaucaacgaccugggcagcaccgccuccuacugcgggagcguccagaaguucaacgagaccaucaucggccagggcgacccgaaguucgacuacgugugccaccuccugaagcggaaggacaucaucgugcgccggugcuacuccaacaacuacgagagcugcaagcugcugacgccccgcgccgacaucaucgucgacaagaagggggagucccuccaggccagcaucgugggccugaaccuggggcagaugaacuucaagaucaugcucggcgacaucaacuacaagcaguacaccgaguccaacaaccuggaggcgaccgggcagugcgugggcugcgucgacugcagcgaggacaucgugugcaaccugaagaucgagucccagagcgaguccgugugcaacaucaagagcgacugcaaccucuaccuguccagcaugcugauccagcccaccgucggcgaguacaaccucaagauguccugcaacgccaagcuggacaaggugaacaucgagaucugcaagcagaaguucgugcugccccucaccaucaagagccacaaccagaagaucgaccuguccaagcuggacgagagcaacuacauccgggaggaggaccucaagugcgacacgaugaucugcaaggucaaggacgaggggcugagcuucaucaccaacucccuguucggcgggaucagcuacuucuggaagauccucaucuccagccugaucgugaucuuccugaucauccucuucuacuacgugggccugccgauccugcgccucaucaaggacuaccugaaggagaacgagcuggaguaccucgccgaggggaaguga

SEQ ID NO: 12709 - RNA, 4257 nt, Artificial Sequence
  derived and/or modified CDS sequence (opt1) from OROV/Perdoes virus(BeAn790177)__KP691628.1__GP
auguucauccaguucaaccuggccuucuucugccucagcaucgugugcggccacccccugaccaaggaccacaucggggaccgcugcuucgccggcgggaaccuguucaaggagaucacccagacgaccggccucuccgagaucugcaucaaggacgacaucagcaucaucaagucccaggucgagaucaagaagcagagcuccgaggugaccuacgcggugaaguucuaccgggucuaccuggugaaggaguggagcgagugcaacccgauccaggaccagcacggguccaucaugauccuggacgugaccaacacgggccucaucguccccaagauguacacgugccgcgccgccugcgacaucacccuggacaaggacaacgccgaggugguguucaucagccagaagaacaacaacuacgagcuggccggcaccaccgucaugcacgggugguucaagaacgugguguccaucaagcucgagcacacgugcgagcaccugaccgcgaccugcggccagaagaccgucaaguuccacgccugcuuccggcagcaccgcgccugcgcccgguuccugaagaccaccuacaugcccaucgugaugguggagagccucugcuccaaccuggagcuggucaucuucaucaccuacaucuucgugugccucgcguucgccuucaucaucacgcgcaccuacguggccuaccugcugauccccgucuucuacccguucaccuacgccuacgggaagauguaccucaagugcgugaagaccugccccaacugccugcuggccaugcaccccuucacgaacugcaccaaccucugcaucugcggcagccgguucuccaacaccgagagccugaaggugcaccgccuggggaacugcuacggcuacaaggcgcucuccggcgcccggagcaugugcaaguccaaggucagcuccuucaccacggccauguucuucgggaucaucauccugagcuucaucgcgccccugaacggcgagcgccucuacaagcugagcgagcugccggacgaguacaucgagauggaguccaccaucgaggggagcaagcagaaggagaccaucguggacaucaucaacuacaccgcccucgugcugauccugaucacgauccuccugcagggcauccuggagaacuacaucuuccggcucaaguuccgcuucugcuccuucugcgacaugauccacaugaagaagaaccugaagaucuucagcaacaugaccaacaagugcgggaccugcaucugcggcuucaaccaggagauccgguccggcuucgacuacgaggucuucaucaaggacaugcacgugagccgcgaguccugcaaguacaacuaccacaagaacuacagcuucuacaucaagaugcugcucgucgugcugcuggugccccucaucgggaccacggccgccgaggacaccaagugccugaaguacgaccugaacaagaacaucgaggaccucaaggacugcuacggccugaagcugaacaucgacaagcacgacaccgucgagaacgccuacaagaaccucguggaccagaagcugguguccgagcuggaccggcuggaccucaacaucaugcuggggagcaaggaguccaucuucgaggccaucgagaccagcaugaacauccaccagauggucuuccuggaguaccucgccuacaagacggaccccaagcuguccgagaucaagcagaacaccggccccuacaacaucgcguggcgcaccuucauccacggcaacagccuggaggugugcgggaacuacccguacaagcucaucugcuacugcaucaagcagaagacccacugcgagaacuccaccguggacuacggcauccagauccagcccuucuacaaccagcaccccaacagcuacaaguccgacauggaggcccugaucaagacgguccagaucgccuuccgggggaucaucaaggugcugauccaguacuacguggagaacaacaagaccagcgagcucuccaaccugcugaccgagcuccgcaacgucaugggcaacaacauccagaugaaggggauccugaaguaccuggagaccuaccucaagaagccccugcugauggcccggacgauccgcaucgccgcgaagguggacaccagcggcgacccguacaacaacuucagcaccuccaaggagaacaucaccaagugcaucaagauccagaagcuccggugcaucacgaagcugacccgcaucgagcacaacuacauccugugcggcgacagcgagaagaagcucuaccaguggcccgccaagcccaccaucguggacgacaacgacgccugccugggggacaagcacugccaccuccccuucaucccgaucggcaacgacgaggccaucaagaccgucaacugcuacguggagguguacgagcagaaccccggggacaugaacuccuaccagaagaagugcgacgcgaugaacgucggcacgugccucaccaucaagaacgagaacuggcccaucgugcagugcaagaccgggaaguacuacuacgccgacggccgcauccacgccaaggacggcaccaucaacacguacugcuucagcgagaagugcaacgccgaccgguaccccauccaccaggacuacaucaacuccugcaacuggcaggagaccaucaaggacuuccagcacgugcgcgaguucguccaccuggacaucgagagcuacaagaaggccaucgaguccgacaucaagaccgaccugguggugcacaaguuccggccggucaagaaccucccccacgugauccccaucuacaagagcaucaccgugcaggggacggagaccuccgacggcauccagaacgcguucauccaggggagcaugcccgccaucuccggccuggccaacggcuaccaccuguucaccccggacagcaagcagcuguucgacgucgugcuguuccugcgcaaggccuccuacaaggccgaguaccggaagaucuacagcaccgggcccacgaucggcaucaacguggagcacaacgagaagugcaccggguccugccccaagaccaucgacaagaaggacaacuggcucaccuucagcaaggagcacacgucccaguggggcugcgaggaguacgggugccuggcgaucaacaccggcugcgucuucggcagcugccaggacaucauccgcccggagaucgacguguacaagaugcacggggccgagcggagcguggucgagcugugcaucacccucccccacgagaccuacugcaacgaccuggacgugcuggagcccaucaucggcgacaagauccaggccgccuuccagacggugcaguccaaccacaugccccgccucauggccaucaagaacaacaaggcguucaccgggcagaucaacgaccugggcagcaccgccuccuacugcgggagcguccagaaguucaacgagaccaucaucggccagggcgacccgaaguucgacuacgugugccaccuccugaagcggaaggacaucaucgugcgccggugcuacuccaacaacuacgagagcugcaagcugcugacgccccgcgccgacaucaucgucgacaagaagggggagucccuccaggccagcaucgugggccugaaccuggggcagaugaacuucaagaucaugcucggcgacaucaacuacaagcaguacaccgaguccaacaaccuggaggcgaccgggcagugcgugggcugcgucgacugcagcgaggacaucgugugcaaccugaagaucgagucccagagcgaguccgugugcaacaucaagagcgacugcaaccucuaccuguccagcaugcugauccagcccaccgucggcgaguacaaccucaagauguccugcaacgccaagcuggacaaggugaacaucgagaucugcaagcagaaguucgugcugccccucaccaucaagagccacaaccagaagaucgaccuguccaagcuggacgagagcaacuacauccgggaggaggaccucaagugcgacacgaugaucugcaaggucaaggacgaggggcugagcuucaucaccaacucccuguucggcgggaucagcuacuucuggaagauccucaucuccagccugaucgugaucuuccugaucauccucuucuacuacgugggccugccgauccugcgccucaucaaggacuaccugaaggagaacgagcuggaguaccucgccgaggggaaguga

SEQ ID NO: 12710 - RNA, 4284 nt, Artificial Sequence
  derived and/or modified CDS sequence (opt1) from OROV/UTIV(BeAn84785)__KF697155.1__GP
auguuccugaucuucauccucauccagaucgccgccagcaccccgcuguccccgcagcaggucggcgaccgcugcuucaucgggggcagccugaucaaggagaucaaccaguccaccgggcucggcgaggugugcaucaaggacgacaucagcaucaucaaguccaucaacauccagaagaagaucagcaacgaccaggugcagaacacggugaaguucuacaagaccuacaucgcgcgggaguggcacgacugcaaccccaucuucgacgagcacggguccuucauggucuucgacaucagcaacaccggcuccaucauccccaagaugcacacgugccgcgcccagugcgagaucacccugaacaaggacaacgccgaggugaucuucaccagcgccaagaccaaccacuacgagguguccggcaccacgaccgucaacgggugguucaagcagaccaucagcgugucccuggagcacacgugcgagcacaucaucgccagcugcggccagaagucccucaaguuccacgcgugcuuccggcagcaccgcagcugcgugcgguucuuccgcaacuccuaccugcccuacaagaugaucgagagccugugcaucaacaucgagcucaucaucauccugugcuacgcccugcucugcuucaucuucgccuacaucaucaccaagaccuacaucgccuaccugcugaucccccucuucuaccccaucaccuacaucuacgggaagaucuacaacaaguacuucaagcggugcaaguccugccugcuggcgguccacccccucaccaacugcaacaagacgugcgugugcggcugccgcuucaacagcaccgaggcccugaaggugcaccggcuggggaaggacugcaacggcuucaaggcccucagcaaggcccgcuuccugugcaaguccaccggccccagcuucaccaucugcuuccugacggggaugcucauccuguccuucaucaccccgaucaacagcgagaagcuguacaagcucgaggagcugcccgacgacuacaucaaccuggagaaccagcucuccgagugcaacaacaacaagcagaucacccgggcccuggcggucgccugcauccugggcaacauccucuucgugcuguucuucaaguucaucuacaacaagcugaucaacaacaucuaccggaccugcaaccucugcaacauggugcaccaccgcaagaaccugaagaucuacagcgaguucacgaacaagugcgggaccugcgucugcggcuucaacgaggagauccgcuccggcuucgacuacgagguguucaucaaggacaugcacaucuuccgggacaacugccuguucaaguucuacagcaaguacuccaucaucuacaucugcaucaucauccucgugaucaaccugcagcuggggaugacccucgccgaggagaccgagacgaacugccugaaccugcccaucagcgcccagacccucgacaucgucaagugcuacggccugaaccugaacaucaccgagaacaagcagaaguccgaccucaucagcgagcugaagucccagaagaccaucacggaccacgacauccccgacuucaacaucaucgacaugaagaccgagagcgccuucgagaagaucgagaccgcggagaacauccaccgcauggccuuccuggaguacauccuguacaagauggaguccaagcucaacaccaucaagacgaacagcgggccguacaacguggccuggcggaccuacaucaaguaccacaaccuggacgccugcggcaaguacccccacaagaccaucugcacgugcaucaacgcccaccuguccugcagccagcccaccguggacuccaacagcgagaucaagaccuucuacagcaaccaccaguccgcguucaagaacgacaucaacguccucaucgagaccaucagcaucgccuuccgcgggaucaucaagguguccaucaaccugcugcucaagaacaacaagaucgacgagcugaaggagcugcucaccaacaucagcaagaagcuggacaccaacauccagaugaagggcauccuccucuucacggccgagcagcugaagacccaggagaccaccgugaaguccaugcagcagacgcggauggccaucaucgucaagccccuggagagcaugaccggcgacaaguucgacaacuucuccaccaccaaccgcaacaucacgaagugcaaggaggccaagagccucuccugcuacaugacccggaagaacagcaucaacaaguaccugcugugcaaccucgacggguacaagaucuucuccuggccggagaagcccacccugagcaucaacaacaacaucugcaucggcgacucccacugcaaccuguacuucaagcccauccucaacgacgaggcgaucaagaccaucaacugcuacaagggggacuucacgcccaacccgauggacaugggcagcgccaucaagaagugcgaggccaaggagaucggggacugccuggugggcgacaacaacauguggcccaucauccagugcuccaacgagaaguacuacuacgccgacggcaagaaccacgcgaaggagggggacaucaacagcuacugccuguccgagaagugcaacaccgaccgcuuccccauccacaacgagugguucaagagcugcaaguggaucagcaccaucaaggaguccaucagcgucaaggaguucgugcaccucgacaucgaguccuacaagaagggcaucgagagcgacauccgcaccgaccugaucauccacaaguuccggcccgugaagaaccugccgcacaucgcccccaaguacaaguccaucacgaucagcgggauccucgucgccgacggcauccagaacgccuucguguccggggagaugcccgccaucagcggccugggcaucggguacaaccuguacucccccgacggcaccaagcuguucgacaucgugcuguuccugcgcaaggcgaucuacaagagcuccuacaagcucaucuacaagaccgggccgaccaucggcaucaacgucgagcacaacgagcagugcacgggcagcugccccuccaccauccccaagcaggagggguggcugaccuucagcaaggagcacaccucccaguggggcugcgaggaguucgggugccuggccaucgacacgggcugccucuacgggagcugccaggacaucauccggccggagauguccaucuacaagaugcugggcgaggagaugaccagcaucgagaucugccugaccacccccaaggagacguacugcaacgaccucgaccugcuggagccccucaucggcgacaagaucgagguguccuuccagaccgugcagagcagccacaugcccaagaucaucgccgucaagaacaacaagguguacaccgggcagaucaacgacaucggcaacaccgccaacaucugcggguccgugcagaucaucaacaagacggucaucggccaggggaacccgaaguucgacuaccugugccacgccaugaagcgcaaggacgugaucgugcggaagugcuacgacaaccacuucgagaccugcaagcugcucgaggagcgcagcgagauccugaucaaccagcaguccgacaccaucgcggccagcauguccggcaagaaccugggcaucaugaacuucaaguucgcccucggggacaucgacuacaagaccuucaccgaggacgccagcuucgacaucaagggccagugcgucgggugcaucaacugcaucgaggagaucgugugcgagcugaacaucguguccacgagcuccauccugugcaccaucaagacccccugcgagaacuaccacaacagccucgagaucaaccccgccaccacgaaguaccacaucaagauguccugcccccacaacaucgacaagaugaagaucaccaucugcagcaaggaccuggagaugccgcugacccucaagcagcacgaccagaagaucgaccuguccaagcuggacgagagcaacuacaucaaggaggaggaccuccggugcuccaccuggcugugcaaggucaaggaggagggcaucggguucaucuucagcggcaucuucggcaacuucgggaaguacuggacgaucuuccugaucgugcucgugauccuggcgaccggccugcucgggaucuucgucaucuaccccugcugcaagcgccugcggggcuuccuggagaucaacgacaucgccuaccucgccgagcagaagaugaaguga

SEQ ID NO: 12711 - RNA, 3231 nt, Artificial Sequence
  derived and/or modified CDS sequence (opt1) from HRTV(TN)__KJ740147.1__GP
augaucgugcccaucguccuguuccucacccugugcccgagcgagcuguccgccuggggcagccccggggaccccaucgugugcggcgugcgcaccgagacgaacaaguccauccagaucgaguggaaggaggggcggagcgagaagcucugccagaucgaccgccugggccacgucaccuccuggcugcggaaccacagcuccuuccaggggcucgugggccaggugaagggccgccccagcgucuccuacuucccggagggggccagcuacccccggugguccggccugcugagccccugcgacgcggaguggcucgggaugaucgccguguccaaggccggcgacaccgacaugaucgugcccgggccgaccuacaagggcaagaucuucgucgagcgccccacguacaacggcuacaagggguggggcugcgccgacggcaagagccugucccacagcgggaccuacugcgagaccgacuccagcguguccagcggccugauccagggggaccgggugcucugggucggcgagguggugugccagcgcgggacccccguccccgaggacguguucagcgagcuggugucccugagccaguccgaguucccggacgucugcaagaucgacggcguggcccucaaccagugcgagcaggagagcaucccccagccccuggacguggcguggaucgacgucgggcggucccacaaggugcugaugcgcgagcacaagacgaagugggugcaggagagcuccgccaaggacuucgucugcuucaaggugggccagggccccugcagcaagcaggaggaggacgacugcauguccaaggggaacugccacggcgacgaggucuucugccggauggccgggugcagcgcccgcaugcaggacaaccaggagggcugccggugcgagcuccugcagaagccgggggagaucaucgugaacuacggcggcguguccguccgcccgaccugcuacggguucagccggaugauggcgacccuggaggugcacaagcccgaccgcgagcucaccggcugcacggggugccaccuggagugcaucgagggcggggugaagaucgucacccugaccuccgagcuccggagcgccaccgugugcgccucccacuucugcgccagcgccaagggcggcuccaagacgaccgacauccuguuccacaccggggcgcuggugggccccaacagcauccgcaucaccgggcagcuccuggacggcuccaaguucagcuucgacggccacugcaucuuccccgacgggugcauggcccuggacugcacguucugcaaggaguuccuccggaacccccagugcuaccccgucaagaaguggcuguuccuggugguggucaucaugugcugcuacugcgcccucaugcugcugaccaacauccuccgcgccaucggcgugugggggaccuggguguucgcccccaucaagcuggcgcuggcccucggccugcggcuggccaagcucagcaagaaggggcuggucgccguggugacccgcggccagaugaucgucaacgacgagcugcaccagauccgcguggagcggggcgagcagaacgaggggcgccagggcuacgggccgcggggccccauccgccacuggcucuacucccccgcccugauccugauccucacgaccagcaucugcuccgggugcgacgagcuggugcacgcggagagcaaguccaucacgugcaagagcgccuccggcaacgagaaggagugcagcgucaccggccgggcccugcugcccgccgugaacccggggcaggaggccugccuccacuucuccaugcccggcagccccgacuccaagugccugaagaucaaggucaagagcaucaaccugcgcugcaagcaggcguccagcuacuacgugccggaggccaaggcccggugcaccuccgugcgccggugccgcugggccggggacugccagagcggcugccccaccuacuucuccagcaacagcuucuccgacgacugggcgaaccggauggaccgcgccgggcucggcaugagcggcugcuccgacgggugcggcggggccgccugcggcugcuucaacgccgcgcccagcugcaucuucuggcggaaguggguggagaaccccuccaaccgcgucuggaaggugagcccgugcgccuccugggugcuggccgccaccaucgagcugacccuccccagcggggaggucaagacgcuggagcccgugaccggccaggccacccagauguucaagggcguggcgaucaccuaccugggguccagcaucgagaucgucggcaugacgcggcucugcgagaugaaggagauggggaccggcaucauggcccuggcccccugcaacgacccgggccacgccaucauggggaacgugggcgagauccagugcuccagcaucgaguccgccaagcacauccgcagcgacgggugcaucuggaacgcggaccuggugggcaucgagcuccgggucgacgacgccgugugcuucuccaagcugaccagcguggaggccgucgccaacuucuccaagauccccgcgaccaucagcggggugcgcuucgaccagggcaaccacggcgagucccggaucuacgggagcccccuggacaucacccgcgugagcggcgaguucuccgucagcuuccgcgggaugcggcucaagcuguccgagaucagcgccuccugcacgggcgagaucaccaacgugagcgggugcuacuccugcaugaccggcgccagcguguccaucaagcugcacagcuccaagaacaccacgggccaccucaagugcgacagcgacgagaccgccuucuccgucauggaggggacccacaccuaccgcccccacaugagcuucgacaaggccgugaucgacgaggagugcgugcugaacugcggcgggcacuccagcaagcugcuccugaagggcucccuggucuucauggacgugccgcgguucguggacgggagcuacguccagacguaccacuccaaggugcccgcgggcggccgcguccccaaccccguggacuggcucaacgcccuguucggggacggcaucacccgguggauccuggggaucaucggcgugcuccuggccugcgucaugcuguucgugguggucguggccaucacccgccggcucaucaagggccugacccagcgcgccaagguggcguga

SEQ ID NO: 12712 - RNA, 3231 nt, Artificial Sequence
  derived and/or modified CDS sequence (opt1) from HRTV(Patient2)__JX005844.1__GP
augaucgugcccaucguccuguuccucacccugugcccgagcgagcuguccgccuggggcagccccggggaccccaucgugugcggcgugcgcaccgagacgaacaaguccauccagaucgaguggaaggaggggcggagcgagaagcucugccagaucgaccgccugggccacgucaccuccuggcugcggaaccacagcuccuuccaggggcucaucggccaggugaagggccgccccagcguguccuacuucccggagggggccagcuacccccggugguccggccugcugagccccugcgacgcggaguggcucgggcugaucgccgucuccaaggccggcgacaccgacaugaucgugcccgggccgaccuacaagggcaagaucuucguggagcgccccacguacaacggcuacaagggguggggcugcgccgacggcaagagccugucccacagcgggaccuacugcgagaccgacuccagcgucuccagcggccucauccagggggaccgggugcugugggugggcgaggucgugugccagcgcgggacccccgugcccgaggacgucuucagcgagcuggugucccucagccaguccgaguucccggacgugugcaagaucgacggcgucgcccugaaccagugcgagcaggagagcaucccccagccccuggacguggcguggaucgacguggggcggucccacaagguccucaugcgcgagcacaagacgaagugggugcaggagagcuccgccaaggacuucgugugcuucaaggucggccagggccccugcagcaagcaggaggaggacgacugcauguccaaggggaacugccacggcgacgagguguucugccggauggccgggugcagcgcccgcaugcaggacaaccaggagggcugccggugcgagcugcugcagaagccgggggagaucaucgucaacuacggcggcguguccgugcgcccgaccugcuacggguucagccggaugauggcgacccucgagguccacaagcccgaccgcgagcugaccggcugcacggggugccaccuggagugcaucgagggcggggugaagaucgugacccucaccuccgagcugcggagcgccaccgucugcgccucccacuucugcgccagcgccaagggcggcuccaagacgaccgacauccuguuccacaccggggcgcucgugggccccaacagcauccgcaucaccgggcagcugcuggacggcuccaaguucagcuucgacggccacugcaucuuccccgacgggugcauggcccucgacugcacguucugcaaggaguuccugcggaacccccagugcuaccccgugaagaaguggcuguuccucgucguggugaucaugugcugcuacugcgcccugaugcugcucaccaacauccugcgcgccaucggcgucugggggaccuggguguucgcccccaucaagcuggcgcucgcccugggccugcggcucgccaagcugagcaagaaggggcugguggccgucgugacccgcggccagaugaucgugaacgacgagcuccaccagguccgcguggagcggggcgagcagaacgaggggcgccagggcuacgggccgcggggccccauccgccacuggcuguacucccccgcccugauccucauccugacgaccagcaucugcuccgggugcgacgagcuggugcacgcggagagcaaguccaucacgugcaagagcgccuccggcaacgagaaggagugcagcgucaccggccgggcccugcuccccgccgugaacccggggcaggaggccugccugcacuucuccgugcccggcagccccgacuccaagugccugaagaucaaggucaagagcaucaaccuccgcugcaagcaggcguccagcuacuacgugccggaggccaaggcccggugcaccuccgugcgccggugccgcugggccggggacugccagagcggcugccccaccuacuucuccagcaacagcuucuccgacgacugggcgaaccggauggaccgcgccgggcugggcaugagcggcugcuccgacgggugcggcggggccgccugcggcugcuucaacgccgcgcccagcugcaucuucuggcggaagugggucgagaaccccuccaaccgcguguggaaggugagcccgugcgccuccuggguccuggccgccaccaucgagcucacccugcccagcggggaggugaagacgcuggagcccgugaccggccaggccacccagauguucaagggcgucgcgaucaccuaccucggguccagcaucgagaucgugggcaugacgcggcugugcgagaugaaggagauggggaccggcaucauggcccuggcccccugcaacgacccgggccacgccaucauggggaacgugggcgagauccagugcuccagcaucgaguccgccaagcacauccgcagcgacgggugcaucuggaacgcggaccucgucggcaucgagcugcggguggacgacgccgugugcuucuccaagcugaccagcgucgaggccguggccaacuucuccaagauccccgcgaccaucagcggggugcgcuucgaccagggcaaccacggcgagucccggaucuacgggagcccccucgacaucacccgcgucagcggcgaguucuccgugagcuuccgcgggaugcggcugaagcuguccgagaucagcgccuccugcacgggcgagaucaccaacgugagcgggugcuacuccugcaugaccggcgccagcgucuccaucaagcuccacagcuccaagaacaccacgggccaccugaagugcgacagcgacgagaccgccuucuccgugauggaggggacccacaccuaccgcccccacaugagcuucgacaaggccgugaucgacgaggagugcguccugaacugcggcgggcacuccagcaagcuccugcugaagggcucccucguguucauggacgugccgcgguucgucgacgggagcuacgugcagacguaccacuccaagguccccgcgggcggccgcgugcccaaccccguggacuggcugaacgcccuguucggggacggcaucacccgguggauccucgggaucaucggcguccugcuggccugcgugaugcuguucguggucgugguggccaucacccgccggcucaucaagggccugacccagcgcgccaaggucgcguga

SEQ ID NO: 12713 - RNA, 3231 nt, Artificial Sequence
  derived and/or modified CDS sequence (opt1) from HRTV(Patient1)__JX005845.1__GP
augaucgcccccgugguccuguucuucacccucugcccgagccagcuguccgccuggggcagccccggggaccccaucgugugcggcgugcgcaccgagacgaacaaguccauccagaucgaguggaaggaggggcggagcgagaagcugugccagaucgaccgccucggccacgucaccuccuggcugcggaaccacagcuccuuccaggggcugaucggccaggugaagggccgccccagcguguccuacuucccggagggggcgagcuacccccggugguccggccuccugagccccugcgacgccgaguggcuggggcucaucgccgucuccaaggccggcgacaccgacaugaucgugcccgggccgaccuacaagggcaagaucuucguggagcgccccacguacaacggcuacaagggguggggcugcgccgacggcaagagccugucccacagcgggaccuacugcgagaccgacuccagcgucuccagcggccugauccagggggaccgggugcucugggugggcgaggucgugugccagcgcgggacccccgugcccgaggacgucuucagcgagcugaucucccugagccaguccgaguucccggacgugugcaagguggacggcgucgcgcucaaccagugcgagcaggagagcaucccccagccccuggacguggccuggaucgacguggggcggucccacaagguccugaugcgcgagcacaagacgaagugggugcaggagagcuccgccaaggacuucgugugcuucaaggucggccagggccccugcagcaagcaggaggaggacgacugcauguccaaggggaacugccacggcgacgagguguucugccggauggccgggugcagcgcgcgcaugcaggacaaccaggagggcugccggugcgagcuccugcagaagccgggggagaucaucgucaacuacggcggcguguccgugcgcccgaccugcuacggguucagccggaugauggccacccuggagguccacaagcccgaccgcgagcucaccggcugcacggggugccaccuggagugcaucgagggcggggugaagaucgugacccugaccuccgagcuccggagcgccaccgucugcgccucccacuucugcgccagcgcgaagggcggcuccaagacgaccgacauccuguuccacaccggggcccuggugggccccaagagcauccgcaucaccgggcagcuccuggacggcuccaaguucagcuucgacggccacugcaucuuccccgacgggugcauggcccuggacugcacguucugcaaggaguuccuccggaacccccagugcuaccccgugaagaaguggcuguuccuggucgugguggucaugugcugcuacugcgcccucaugcugcugaccaacauccuccgcgccaucggcgugugggggaccuggguguucgcgcccaucaagcugguccuggcccucggccugcggcuggccaagcucagcaagaaggggcugguggccguggucacccgcggccagaugaucgugaacgacgagcugcaccagauccgcguggagcggggcgagcagaacgaggggcgccucggccacgggccgcggggccccguccgccacuggcuguacucccccgcccugauccucauccugacgaccagcaucugcuccgggugcgacgagcuggugcacgcggagagcaaguccaucacgugcaagagcgccuccggcaacgagaaggagugcagcgugaccggccgggcccugcuccccgccgucaacccggggcaggaggccugccugcacuucuccaugcccggcagccccgacuccaagugccugaagaucaaggucaagagcaucaaccuccgcugcaagcaggcguccagcuacuacgugccggaggccaaggcccggugcaccuccgugcgccggugccgcugggccggggacugccagagcggcugccccaccuacuucuccagcaacagcuucuccgacgacugggcgaaccggauggaccgcgccgggcugggcaugagcggcugcuccgacgggugcggcggggccgccugcggcugcuucaacgccgcgcccagcugcaucuucuggcggaaguggguggagaaccccuccaaccgcguguggaaggucagcccgugcgccuccugggugcuggccgccaucaucgagcucacccugcccagcggggaggugaagacccuggagcccgucacgggccaggccacccagauguucaagggcguggcgaucaccuaccucggguccagcaucgagaucgugggcaugacccggcugugcgagaugaaggagauggggacgggcaucauggcccuggcccccugcaacgacccgggccacgccaucauggggaacgucggcgagauccagugcuccagcaucgaguccgccaagcacauccgcagcgacgggugcaucuggaacgcggaccucgugggcaucgagcugcggguggacgacgccgucugcuucuccaagcugaccagcguggaggccguggccaacuucuccaagauccccgcgaucaucagcgggguccgcuucgaccagggcaaccacggcgagucccggaucuacgggagcccccucgacaucaccaaggugagcggcgaguucuccgugagcuuccgcgggaugcgccugaagcuguccgagaucagcgccuccugcaccggcgagaucaccaacgucagcgggugcuacuccugcaugacgggcgccagcguguccaucaagcuccacagcuccaagaacaccaccggccaccugaagugcgacagcgacgagaccgccuucuccgugauggaggggacgcacaccuaccggccccacaugagcuucgacaaggccgucguggacgaggagugcgugcugaacugcggcgggcacuccagcaagcuccugcugaagggcucccucgucuucauggacgugccgcgcuucgucgacgggagcuacgugcagaccuaccacuccaaggugcccgcgggcggccggguccccaaccccguggacuggcugaacgcccuguucggggacggcaucacccgcuggauccucgggaucaucggcgugcugcuggccugcguccuccuguucgugguggucguggccaucacgcggcgccugaucaagggccucacccagcgggccaagguggcguga

SEQ ID NO: 12714 - RNA, 3942 nt, Artificial Sequence
  derived and/or modified CDS sequence (opt1) from PTV(PAN472868)__NC_027201.1__GP
augaucuucaccauccugaacgugcucacccgcgccaugcuggucaugagcauguacucccugacgaccugggacagcaccucccggaacgacaugugcuucagcaacgacagcccccucgagggccugguguacuacugggagacccacagcaagaagcacgacuacaagaagcaggagucccagcgcugccgggugggggacagcgacaagaagaugaucacgaacgucaccaucaucucccugaucagcgagauccagaaguccaucagcgagcucucccugagcugcggcaacgacgacaacuccaccggccaggugcugaccuucaacgggcucgaggacacgauccagggggacuacaucguggacugcgucaccggccuguaccagagcgacaucggcgugggggugggccuggggaagacccaccacgaccaccagcaggucaagaacaaggccguggugaucgacgagaaggagcgcaugaucuccuuccucgagacccagcagagcgagaacgacaucaagaugcagguccugauguccgagaucgagcagcugaagaaccagcucagcaagaagcggaacgagcgcggccaggagaagcgggacgcggagaaggugaugagcgaccugauggcccgcaacuccgaccugcggaagcacaacgacauccucacggccgagaucagccagauggagaacaacaacaccauccagcgcaacaagaacgugauguccaccaccgucgugccggccauccugagcguggcccugcucuccagcuccaucgcgcccaucauggccgccagccccgacucccccaugaucaacccguggccccacgccaagaaccgggucgggacgggcauguacaaguacgacgagaacgacgacagcggcugccgccccauccgguacgggguguccugcaucggcuucgacuucaugcugaagauggacaaguaccccuucuucaacgcguucaucgggcacaagaccccgcuggagagcuucgccgacaagaucaucgagaaggaggaggagaccugcgagaucggcaccaacaaggaguucaagugcuucgaggagcgcgccuacaucaagggcacgugccccaccaacaucaacgccgugcacuacaucgacaacaaggggaagcuccgguacgucaagugcaaggagaaccuggagaugaccgaggacugcgccuucugccgcaagaucaagaagaaggcgggccaguccauccaggugcagaagaccagcgugccccugcaggacgccaucugccaggagaacuccgacacguacagcgggcccaagaucccguucaagggcgucugcaagaucgggcucaucaaguacaaggagugcaaguucaagaccuccagcuacgagaccguguccuucaucacccugaaggagaagggcaagaucuacaucgagcaccugaugcucaagaacaucgaggucgugacgaacgugagcuucgucugcuacgagcacgccggccaggacgagcaggagguggagcaccgggcccugaagcgcgugagcgucaacgacugcaagaucguggacaacuccaagcagaagaucugcaccggggaccacaucuucugcgagaaguacgacugcagcaccuccuaccccgacgugaccugcauccacgcccccggcagcgggccccuguacaucaaccucaugggcuccuggaucaagccgcagugcgucggguacgagcgggugcugguggaccgcgaggucaagcagccccugcucgcgcccgagcagaacugcgacacgugcgugagcgagugccuggacgagggcgugcacaucaaguccaccggcuucgagaucaccagcgccgucgccugcucccacgggagcugcaucuccgcccaccaggaggccagcaccuccgugaucgugcccuacccgggccugcucgcgagcgucgggggccggaucgggauccaccugucccacacgagcgacuccgccagcgugcacaugguggucgugugcccgccccgcgacagcugcgccgcccacaacugccugcucugcuaccacggcauccugaacuaccagugccacuccacccugagcgccauccucaccuccuuccugcugauccucuucaucuacaccguguucagcgucaccacgaacaugcuguacgugcugcgccugauccccaagcagcucaagucccccgugggcuggcugcggcuguucaucaacuggcuccugaccgcgcugcgcaucaagacccggaacgucauggggcgcaucaaccagcggaucggcuggguggaccaccacgacguggagcgcccccggcaccgcgagcccaugcggcgcuucaagaccacgcuccugcugacccucaucaugaugaccgggggcaacgccugcagcaacaccgucguggccaacuccaagcagacgcggugcgugcaggagggcagcuccaccaagugcagcaucaccgccaccaucacgcugcgcgcgggggucaucggcgccgaguccugcuucaucaucaaggggcccauggagaaccagcagaagaccaucagcaucaagaccaucuccagcgagaccgugugccgggagggcuccagcuucuggacgucccuguacaucccgagcugccucuccagccgccggugccaccuggugggggacugcgucggcaacaagugccagagcuggcgcgacgaccagcugucccgggaguucagcggcgugaaggacaaccacaucaugaacgagaacaagugcuucgagcagugcggggccaucggcugcgggugcuucaacaucaaccccuccugccucuacgugcacgccuaccugaaguccgcccgcaacgaggcgguccggguguucuccugcagcgacugggugcaccgcgucuccuucgaggugaagggccccgacggggagaccgagcuggugacccucggcagccugggcaccaaguuccugaacugggggacgcucucccugagccuggacgccgagggcaucuccgggaccaacagcaucuccuuccucgagagcuccaagggcggguucgcccuguacgacgagggcuacagcgagaucccgcgcgagggcuuccugggggagauccggugcuccagcgaguccgccgccaucagcgcgcacaagagcugcauccgcgcccccggccucaucaaguacaagcccaugaccgaccagaucgagugcaccgccucccuggucgaccccuucgccaucuuccugaaggggagccucccgcagacgcggaacggccagaccuucaccuccaccaaggacaagaagacggugcaggccuucaccaacggggcgaucaaggcccugcugagcaucaaccucgacgaccacgagaucguguucaucaacaagguccgcuccugcgacgccaccuuccugaacgugagcggcugcuacuccugcgacuacggcgcccacgugugcgucaaggucaagagcuccgagagcgcggacuucuucgccgaguccgaggacaagaccacggugcugagcuuccccauccaguccgggacccacgacuacugccaggugcuccacuuccagaagccccugguggacgagcggcugagcuacuccugcggcagcgagcccaagcucaucgucaucaaggggacccugguguacaugggcguguacgacuuccgcaacaagaccggcggguccagcacggucgugaacccguccgagggcgccuggagcaucagcaacugguucuccgggcugcucgacuggcugggcgggcccaugaaggccauccugaagauccucggcuucaucgccaucggcaucgugugcuucauccuguucaugauccugauccggaucgcggucaacagcaucaacaucaagaagaagaacuga

SEQ ID NO: 12715 - RNA, 3942 nt, Artificial Sequence
  derived and/or modified CDS sequence (opt1) from PTV(Adames)__KR912209.1__GP
augaucuucaccauccugaacgugcucacccgcgccaugcuggucaugagcauguacucccugacgaccugggacagcuccagccggaacgacaucugcuucuccaacgacagcccccucgagggccugguguacuacugggagacccacuccaagaagcacgacuacaagaagcaggggagccagaagugccgcgugggcgacuccgacaagaagaugaucagcaacgucaccaucaucucccugaucagcgagauccagaaguccaucagcgagcucucccugagcugcgggaacaacgacaacuccacgggccaggugcugaccuucaacgggcucgaggacaccauccggggcgacuacaucguggacugcgucaccggccuguaccagagcgacaucggggugggcguggggcugggccgcaucaaccacgaccaccagcaggucaagaacaaggccguggugaucgacgagaaggagaagaugaucucccuccuggagacgcagcagagcgagaacgacaucaagacccagguccugaugagcgagaucgagcagcucaagaaccagcuguccaagcggcgcaacgagcgggggcaggagaagcgcgacgcggagaagcugaugagcgaccucauggcccggaacuccgaccugcgcaaccacaacgugauccugaccgacgagaucagccagaucaagaacaacaucaccauccaccggaaccgcaacaugauguccacgaccguggucccggccauccucagcguggcccugcuguccagcuccgugggccccaucaccgccgcgccgcccgacagcaccaugaucaaccccuggccccacgccaagaaccgggucggcacggggauguacaaguacgacgagaacgacgaguccggcugccgccccauccgguacggggugagcugcaucggcuucgacuucaugcucaagauggacaaguaccccuucuucaacgccuucaucggccacaagaccccgcuggaguccuucgccgacaagaucaucgagaaggaggaggagaccugcgagaucgggaccaacaaggaguucaagugcuucgaggagcgcgcguacaucaagggcacgugccccaccaacaucaacgccgugcacuacaucgacaacaaggggaagcugcgguacgucaagugcaaggagaaccucgagaugaccgaggacugcgccuucugccgcaagaucaagaagaaggccggccagagcguccaggugcagaagaccuccgugccccugcaggacgccaucugccaggagaacagcgacaucuacuccgggcccaagaucccguucaagggcgugugcaagaucggccugaucaaguacaaggagugcaaguucaagacgagcuccuacgagaccaucagcuucaucacccucaaggggaagggcaagaucuacaucgagcaccugaugcugaagaacaucgaggucgugaccaacgugagcuucgucugcuacgagcacgcggggcaggacgagcaggagguggagcaccgggcccucaagcgcguguccgucaacgacugcaagaucguggacaacagcaagcagaagaucugcacgggcgaccacaucuucugcgagaaguacgacugcuccaccagcuaccccgacgugaccugcauccacacccccggguccggcccccuguacaucaaccugaugggcagcuggaucaagccgcagugcgucggguacgagcgggugcucguggaccgcgaggucaagcagccccugcuggugcccgagcagaacugcgacacgugcguguccgagugccucgacgagggcguccacaucaagagcaccggguucgagaucaccuccgccguggccugcagccacggcuccugcaucagcgcccaccaggaggcguccaccagcgugaucauccccuacccggggcugcuggccuccgucggcggccgcaucgggauccaccucagccacacguccgacagcgccagcgugcacaugguggucgugugcccgccccgggacuccugcgccgcccacaacugccugcugugcuaccacggcauccucaacuaccagugccacagcacccuguccgcgauccugaccagcuuccuccugauccuguucaucuacaccgccuucuccgugaccacgaacguccuguacgugcuccgccugauccccaagcagcucaagagccccgugggguggcugaagcuguucgucaacuggcugcucaccgcccugcggaucaagacccgccgggugaugggccgcaucaaccagcggaucggcuggguggaccaccacgacgucgagcgcccccggcaccgcgagcccaugcggcgcuucaagaccacgcugcuccugacccugaucauggugaccgggggcaacgccugcuccaacaccguggucgccaacagcaagcagacgcggugcgugcaggagggguccaacaccaagugcagcaucaccgcgaccaucacgcuccgcgccggcgugaucggggccgaguccugcuucaucaucaagggccccauggagaaccagcagaagaccaucagcaucaagaccaucuccagcgagaccgucugccgggagggcuccagcuucuggacgucccuguacaucccgagcugccuguccagccgccggugccaccucgugggggacugcgugggcaacaagugccagagcuggcgcgacgaccagcugucccgggaguucagcggggucaaggacaaccacaucaugaacgagaacaagugcuucgagcagugcggcgccaucgggugcggcugcuucaacaucaaccccuccugccuguacgugcacgcguaccucaagagcgcccgcaacgaggccgugcgcgucuucuccugcagcgacugggugcaccggguguccuucgaggucaagggccccgacggggagauggagcuggugacccugggcagccucgggaccaaguuccugaacuggggcacccugucccucagccuggacgccgaggggaucuccggcacgaacagcaucuccuuccuggagagcuccaagggcggguucgcccucuacgacgagggcuacagcgagaucccgcgcgagggguuccugggcgagauccggugcuccagcgaguccgcggccaucagcgcccacaagagcugcauccgcgcccccgggcugaucaaguacaagcccaugaccgaccagaucgagugcaccgccucccucguggaccccuucgcgaucuuccugaagggcagccugccgcagacccggaacggccagacguucaccuccaccaaggacaagaagaccguccaggccuucacgaacggggccaucaaggcccuccugagcaucaaccuggacgaccacgagaucaucuucaucaacaaggugaaguccugcgacgccaccuuccucaacgugagcggcugcuacuccugcgacuacggggcgcacgucugcgugaaggucaagagcuccgagagcgccgacuucuucgccgaguccgaggacaagaccaccgugcugagcuuccccauccaguccggcacgcgcgacuacugccaggugcugcacuuccagaagccccucgucgacgagcggcugagcuacuccugcggcagcgagcccaagcugaucgugaucaaggggacccucguguacaugggcgucuacgacuuccgcgacaagaccgggggcuccagcaccgugaucaacccguccgaggggacguggagcaucagcaacugguucuccggccugcuggacuggcucggcgggcccaugaaggccauccugaagauccugggcuucaucgcgaucgggaucgugugcuucauccucuucaugauccugauccggaucgccgucaacagcaucaacaucaagaagaagaacuga

SEQ ID NO: 12716 - RNA, 3942 nt, Artificial Sequence
  derived and/or modified CDS sequence (opt1) from PTV(Balliet)__KR912213.1__GP
augaucuucaccauccugaacgugcucacccgcgccaugcuggucaugagcauguacucccugacgaccugggacagcaccucccggaacgacaugugcuucagcaacgacagcccccucgagggccugguguacuacugggagacccacagcaagaagcacgacuacaagaagcaggagucccagcgcugccgggugggggacagcgacaagaagaugaucacgaacgucaccaucaucucccugaucagcgagauccagaaguccaucagcgagcucucccugagcugcggcaacgacgacaacuccaccggccaggugcugaccuucaacgggcucgaggacacgauccgcggggacuacaucguggacugcgucaccggccuguaccagagcgacaucggcgugggggugggccuggggcggacccaccacggccaccagcagaugaagaacaaggccgucgugaucgacgagaaggagcgcaugaucucccuccuggagacccagcagagcgagaacgacaucaagaugcagguccugauguccgagaucgagcagcucaagaaccagcugagcaagaagcggaacgagcgcgggcaggagaagcgggacgcggagaaggugaugagcgaccugauggcccgcaacuccgaccuccggaagcacaacgacauccugacggccgagaucagccagaugaagaacaagaacaccauccagcgcaacaagaacaccguguccaccacgguggucccggccauccugagcguggcccuccuguccagcuccguggcgcccaucaucgccgccccgcccgacagccccaugaucaaccccuggccccacgccaagaaccgggucggcaccggcauguacaaguacgacgagaacgacgacuccgggugccgccccauccgguacggcgugagcugcaucggguucgacuucaugcugaagauggacaaguacccguucuucaacgcguucaucggccacaagacgccccucgaguccuucgccgacaagaucaucgagaaggaggaggagaccugcgagaucggcaccaacaaggaguucaagugcuucgaggagcgcgccuacaucaaggggaccugccccaccaacaucaacgccgugcacuacaucgacaacaagggcaagcugcgguacgucaagugcaaggagaaccuggagaugaccgaggacugcgccuucugccgcaagaucaagaagaaggcggggcagagcguccaggugcagaagacguccgugccccuccaggacgccaucugccaggagaacagcgacaccuacuccggcccgaagauccccuucaagggggugugcaagaucggccugaucaaguacaaggagugcaaguucaagaccagcuccuacgagaccgucagcuucaucacgcugaaggagaagggcaagaucuacaucgagcaccucaugcugaagaacaucgagguggugaccaacgucuccuucgugugcuacgagcacguggggcaggacgagcaggaggucgagcaccgggcccugaagcgcgugagcgugaacgacugcaagaucgucgacaacagcaagcagaagaucugcaccggcgaccacguguucugcgagaaguacgacugcuccaccagcuaccccgacgugacgugcauccacgcccccggguccggcccgcucuacaucaaccugauggggagcuggaucaagccccagugcgucggcuacgagcgggugcugguggaccgcgaggucaagcagccccuccuggcccccgagcagaacugcgacacgugcguguccgagugccuggacgagggcgugcacaucaagagcaccggguucgagaucaccuccgcggucgccugcagccacggcuccugcaucagcgcccaccaggagccguccaccagcgugaucgugcccuaccccgggcuccuggccuccgucggcgggcgcaucggcauccaccugagccacaccuccgacagcgccuccgugcacaugguggucgugugcccgccccgggacagcugcgcggcccacaacugccuccugugcuaccacggcauccugaacuaccagugccacagcacccucuccgccauccugaccagcuuccugcucauccuguucaucuacaccguguucuccgucacgaccaacauccuguacgugcugcgccucauccccaagcagcugaagucccccgugggguggcugaagcuguucaucaacuggcugcugaccgcccuccggaucaagacccgcaacgucaugcggcgcaucaaccagcggaucggcuggguggaccaccacgacguggagcgcccccggcaccgcgagccgaugcggcgcuucaagacgacccugcugcucacccugaucaugaugaccgggggcaacgccugcuccaacacggucguggcgaacagcaagcagacccggugcgugcaggagggcuccaacaccaagugcagcaucaccgccacgaucacccugcgcgccggggucaucggcgccgaguccugcuucaucaucaaggggcccauggagaaccagcagaagaccaucagcaucaagaccaucuccagcgagacggugugccgggagggcuccagcuucuggaccucccucuacauccccagcugccuguccagccgccggugccaccuggugggggacugcgucggcaacaagugccaguccuggcgcgacgaccagcucagccgggaguucagcggcgugaaggacaaccacaucaugaacgagaacaagugcuucgagcagugcggggcgaucggcugcgggugcuucaacaucaacccguccugccuguacgugcacgccuaccucaagagcgcccgcaacgaggccguccgcguguucuccugcagcgacugggugcaccgggucuccuucgaggugaagggccccgacggggagaccgagcucgugacccugggcagccugggcacgaaguuccucaacugggggacccugucccugagccucgacgccgagggcaucuccgggaccaacagcaucuccuuccuggagagcuccaagggcggguucgcgcuguacgacgagggcuacaacgagaucccccgcgagggcuuccucggggagauccggugcagcuccgagagcgccgccaucuccgcccacaagagcugcauccgcgcccccggccugaucaaguacaagccgaugaccgaccagaucgagugcacggcgucccuggucgaccccuucgccaucuuccucaaggggagccugccccagacccggaacggccagaccuucaccagcacgaaggacaagaagaccgugcaggccuucaccaacggggccaucaaggcccugcucuccaucaaccuggacgaccacgagaucguguucaucaacaaggucaagaacugcgacgcgaccuuccugaacgugagcggcugcuacuccugcgacuacggcgcccacgucugcgugaaggucaagagcuccgagagcgccgacuucuucgccgaguccgaggacaagacgaccgugcucagcuuccccauccaguccgggacccacgacuacugccaggugcugcacuuccagaagccgcugguggacgagcgccucagcuacuccugcggcagcgagcccaagcugaucgucaucaaggggacccugguguacaugggcguguacgacuuccggaacaagacgggcggguccagcaccgucgugaaccccuccgagggcgcguggagcaucuccaacugguucagcgggcuccuggacuggcugggcgggcccaugaaggccauccucaagauccugggcuucaucgccaucggcaucgugugcuucguccuguucaugauccucauccgcaucgccgugaacuccaucaacaucaagaagaagaacuga

SEQ ID NO: 12717 - RNA, 3942 nt, Artificial Sequence
  derived and/or modified CDS sequence (opt1) from PTV(PaAR2381)__KP272005.1__GP
augaucuucaccauccugaacauccucacccgcgccaugcuggugaugagcauguacucccugacgaccugggacagcaccucccggaacgacaugugcuucagcaacgacuccccccucgagggccuggucuacuacugggagacccacagcaagaagcacgacuacaagaagcaggagucccagaagugccgcgugggggacagcgacaagaagaugaucuccaacgugacgaucaucagccugaucuccgagauccagaagagcaucuccgagcucagccuguccugcggcaacgacgacaacagcaccgggcagguccugaccuucaacggccucgaggacaccauccggggggacuacaucguggacugcgugacgggccuguaccaguccgacaucggcgucggggugggccuggggcgcacccaccacgaccaccaccaggugaagaacaaggccgucgugaucgacgagaaggagcggaugaucagccuccuggagacccagcaguccgagaacgacaucaagaugcaggugcugaugagcgagaucgagcagcucaagaaccagcugagccgcaagcggaacgagcgcggccaggagaagcgggacgcggagaaggucauguccgaccugauggcccgcaacagcgaccuccggaagcacaacgacauccugaccgccgagaucucccagaugaaguacaacaacacgauccagcgcagcaagaacgugauguccaccaccguggucccggccauccugagcguggcccuccuguccagcuccguggcgcccaucauggccgccccccccgacagcccgaugaucaaccccuggccccacgccaagaaccgggucgggaccggcauguacaaguacgacgacaacgacgacuccggcugccgccccauccgguacggggugagcugcaucggcuucgacuucaugcugaagauggacaaguacccguucuucaacgcguucaucgggcacaagacgccccucgaguccuucgccgacaagaucaucgagaaggaggaggagaccugcgagaucggcaccaacaaggaguucaagugcuucgaggagcgcgccuacaucaagggcaccugccccacgaacaucaacgccgugcacuacaucgacaacaaggggaagcugcgguacgucaagugcaaggagaaccuggagaugaccgaggacugcgccuucugccgcaagaucaagaagaaggcgggccagagcgugcaggugcagaagaccuccgucccccuccaggacgccaucugccaggagaacagcgacaacuacuccgggccgaagauccccuucaagggcgugugccggaucgggcugaucaaguacaaggagugcaaguucaagaccagcuccuacgagacggucagcuucaucacccugaaggagaagggcaagaucuacaucgagcaccucaugcugaagaacaucgagguggugaccaacgucagcuucgugugcuacgagcacgccggccaggacgagcaggagguggagcaccgcgcccugaagcgggucuccgugaacgacugcaagaucguggacaacagcaagcagaagaucugcaccggggaccacgucuucugcgagaaguacgacugcuccacgagcuaccccgacgugaccugcauccacgcccccggcuccgggccgcucuacaucaaccugaugggcagcuggaucaagccccagugcgugggguacgagcgcguccugguggaccgcgaggugaagcagccccuccuggcgcccgagcagaacugcgacaccugcgucuccgagugccuggacgagggcgugcacaucaagagcaccggcuucgagaucacguccgccguggccugcagccacggguccugcaucagcgcccaccaggaggccuccaccagcgucaucgugccguaccccggccuccuggcguccguggggggccggaucgggauccaccugagccacaccuccgacagcgccagcguccacauggugguggucugccccccccgcgacuccugcgaggcccacaacugccuccugugcuaccacggcauccugaacuaccagugccacagcacccucuccgccauccugacgagcuuccugcucauccuguucaucuacaccguguucuccgugaccaccaacaugcuguacguccugcggcucaucccgaagcagcugaagagccccgugggcuggcugaagcucuucaucaacuggcugcugaccgcccuccgcaucaagacgcggaacgugauggggcgcaucaaccagcggaucggcugggucgaccaccacgacguggagcgcccccggcaccgcgagcccaugcggcgcuucaagaccacccugcugcucacccugaucaugaugacggggggcaacgcgugcuccaacaccguggucgccaacagcaagcagacccggugcgugcaggagggcuccaacaccaagugcagcaucacggccaccaucacccugcgcgccggggugaucggcgcggaguccugcuucaucaucaaggggccgauggagaaccagcagaagaccaucagcaucaagacgaucuccagcgagaccgucugccgggagggcuccagcuucuggaccucccucuacauccccagcugccuguccagccgccggugccaccuggugggggacugcgugggcaacaagugccagagcuggcgcgacgaccagcucucccgggaguucagcggcgucaaggacaaccacaucaugaacgagaacaagugcuucgagcagugcggggccaucggcugcgggugcuucaacaucaaccccuccugccuguacgugcacgccuaccugaagagcgcccgcaacgaggccgugcgcgucuucuccugcagcgacugggugcaccggguguccuucgaggucaagggcccggacggggagaccgagcucgugacgcugggcagccugggcaccaaguuccucaacugggggacccugucccugagccucgacgcggagggcaucuccgggaccaacagcaucuccuuccuggagagcuccaagggcggguucgcccuguacgacgagggcuacagcgagaucccccgcgagggcuuccucggggagauccggugcuccagcgaguccgccgccaucagcgcccacaagagcugcauccgcgcgcccggccugaucaaguacaagcccaugacggaccagaucgagugcaccgccucccugguggacccguucgccaucuuccucaaggggagccugccccagacccggaacggccagaccuucacguccaccaaggacaagaagaccguccaggccuucaccaacggggccaucaaggcgcugcucagcaucaaccuggacgaccacgagaucguguucaucaacaaggugaaguccugcgacgccacguuccugaacgucagcggcugcuacuccugcgacuacggcgcccacgugugcgucaaggugaagagcuccgagagcgccgacuucuucgcggaguccgaggacaagaccaccgugcucagcuuccccauccaguccgggacccacgacuacugccagguccugcacuuccagaagccccugguggacgagcgccucagcuacuccugcggcagcgagccgaagcugaucgugaucaaggggacgcuggucuacaugggcguguacgacuuccggaacaagaccggcggguccagcaccguggucaaccccuccgagggcgccuggagcaucagcaacugguucuccgggcuccuggacuggcugggcgggcccaugaaggccauccucaagauccugggcuucaucgccaucggcaucgugugcuucauccuguucaugaucaugauccgcaucgccgugaacagcaucaacaucaagaagaagaacuga

SEQ ID NO: 12718 - RNA, 3942 nt, Artificial Sequence
  derived and/or modified CDS sequence (opt1) from PTV(PAN483391)__KP272008.1__GP
augaucuucaccauccugaacauccucacccgcgccaugcuggugaugagcauguacucccugacgaccugggacagcaccucccggaacgacaugugcuucagcaacgacagcccccucgagggccuggucuacuacugggagacccacuccaagaagcacgacuacaagaagcaggagucccagcgcugccgggugggggacagcgacaagaagaugaucacgaacgugaccaucaucucccugaucagcgagauccagaaguccaucagcgagcucucccugagcugcggcaacgacgacaacuccaccgggcagguccugaccuucaacggccucgaggacacgauccgcggggacuacaucguggacugcgugaccggccuguaccagagcgacaucggcgucggggugggccuggggcggacccaccacgaccaccagcaggucaagaacaaggccgucgugaucgacgagaaggagcgcaugaucucccuccuggagacccagcagagcgagaacgacaucaagaugcagguccugauguccgagaucgagcagcucaagaaccagcugagcaagaagcggaacgagcgcggccaggagaagcgggacgcggagaaggugaugagcgaccugauggcccgcaacuccgaccuccggaagcacaacgacauccugacggccgagaucagccagaugaaguacgacaacaccauccagcgcaacaagaacgugauguccaccaccguggucccggccauccugagcguggcccuccuguccagcuccaucgcgcccaucauggccgccagccccgacucccccaugaucaacccguggccccacgccaagaaccggguggggacgggcauguacaaguacgacgagaacgacgacagcggcugccgccccauccgguacggggucuccugcaucggcuucgacuucaugcugaagauggacaaguaccccuucuucaacgcguucaucgggcacaagaccccgcucgagagcuucgccgacaagaucaucgagaaggaggaggagaccugcgagaucggcaccaacaaggaguucaagugcuucgaggagcgcgccuacaucaagggcacgugccccaccaacaucaacgccgugcacuacaucgacaacaaggggaagcugcgguacgugaagugcaaggagaaccuggagaugaccgaggacugcgccuucugccgcaagaucaagaagaaggcgggccaguccguccaggugcagaagaccagcgugccccuccaggacgccaucugccaggagaacuccgacacguacagcgggcccaagaucccguucaagggcgucugcaagaucgggcugaucaaguacaaggagugcaaguucaagaccuccagcuacgagaccguguccuucaucacccugaaggagaagggcaagaucuacaucgagcaccucaugcugaagaacaucgaggucgugacgaacgugagcuucgucugcuacgagcacgccggccaggacgagcaggagguggagcaccgggcccugaagcgcgugagcgucaacgacugcaagaucguggacaacuccaagcagaagaucugcaccggggaccacguguucugcgagaaguacgacugcagcaccuccuaccccgacgugaccugcauccacgcccccggcagcgggccccucuacaucaaccugaugggcuccuggaucaagccgcagugcgugggguacgagaaggugcuggucgaccgggaggugaagcagccccuccuggcgcccgagcagaacugcgacacgugcgugagcgagugccuggacgagggcguccacaucaaguccaccggcuucgagaucaccagcgccguggccugcucccacgggagcugcaucuccgcccaccaggaggccagcaccuccgugaucguccccuacccgggccuccuggcgagcgucgggggcaagaucgggauccaccugucccacacgagcgacuccgccagcgugcacauggugguggugugcccgccccgcgacagcugcgccgcccacaacugccuccugugcuaccacggcauccugaacuaccagugccacuccacccucagcgccauccugaccuccuuccugcucauccuguucaucuacaccgucuucagcgugaccacgaacaugcuguacgugcugcgccucauccccaagcagcugaagucccccgucggcuggcugcgccucuucaucaacuggcugcugaccgcgcuccggaucaagacccggaacgugauggggcgcaucaaccagcggaucggcuggguggaccaccacgacgucgagcgcccccggcaccgcgagcccaugcggcgcuucaagaccacgcugcugcucacccugaucaugaugaccgggggcaacgccugcagcaacaccgugguggccaacuccaagcagacgcggugcguccaggagggcagcaacaccaagugcuccaucaccgccaccaucacgcugaaggcgggggugaucggcgccgagagcugcuucaucaucaaggggcccauggagaaccagcagaagaccaucuccaucaagaccaucagcuccgagaccgugugccgcgagggcagcuccuucuggacgagccucuacaucccguccugccugagcucccggcgcugccaccuggucggggacugcgugggcaacaagugccagagcuggcgggacgaccagcucagccgcgaguucuccggcgugaaggacaaccacaucaugaacgagaacaagugcuucgagcagugcggggccaucggcugcgggugcuucaacaucaaccccagcugccuguacguccacgccuaccugaaguccgcccggaacgaggcggugcgcguguucagcugcuccgacuggguccaccgggugagcuucgaggugaagggccccgacggggagaccgagcucgucacccugggcucccugggcaccaaguuccucaacugggggacgcugagccugucccucgacgccgagggcaucagcgggaccaacuccaucagcuuccuggaguccagcaagggcggguucgcccuguacgacgagggcuacuccgagaucccgcgcgagggcuuccucggggagauccgcugcagcuccgagagcgccgccaucuccgcgcacaagagcugcauccgggcccccggccugaucaaguacaagcccaugaccgaccagaucgagugcaccgccagccugguggaccccuucgccaucuuccucaaggggucccugccgcagacgcgcaacggccagaccuucaccagcaccaaggacaagaagacggugcaggccuucaccaacggggcgaucaaggcccugcucuccaucaaccuggacgaccacgagaucgucuucaucaacaaggugcggagcugcgacgccaccuuccugaacguguccggcugcuacagcugcgacuacggcgcccacgucugcgugaaggucaaguccagcgaguccgcggacuucuucgccgagagcgaggacaagaccacggugcucuccuuccccauccagagcgggacccacgacuacugccaggugcugcacuuccagaagccccuggucgacgagcgccucuccuacagcugcggcuccgagcccaagcugaucgugaucaaggggacccugguguacaugggcgucuacgacuuccggaacaagaccggcgggagcuccacgguggugaacccgagcgagggcgccugguccaucagcaacugguucagcgggcuccuggacuggcugggcgggcccaugaaggccauccucaagauccugggcuucaucgccaucggcaucgucugcuucauccuguucaugauccucauccgcaucgcggugaacuccaucaacaucaagaagaagaacuga

SEQ ID NO: 12719 - RNA, 3942 nt, Artificial Sequence
  derived and/or modified CDS sequence (opt1) from PTV(GML902876)__KP272011.1__GP
augaucuucaccauccugaacgugcucacccgcgccaugcuggucaugagcauguacucccugacgaccugggacagcaccucccggaacgacaugugcuucagcaacgacagcccccucgagggccugguguacuacugggagacccacagcaagaagcacgacuacaagaagcaggagucccagaagugccgcgugggggacagcgacaagaagaugaucuccaacgucacgaucaucagccugaucuccgagauccagaaguccaucuccgagcucagccuguccugcggcaacgacgacaacagcaccggccaggugcugaccuucaacggccucgaggacaccauccgcggggacuacaucguggacugcgucacgggccuguaccaguccgacaucggcgugggggugggccuggggcggacccaccacgaccaccaccaggucaagaacaaggccguggugaucgacgagaaggagcggaugaucagccuccuggagacccagcaguccgagaacgacaucaagaugcagguccugaugagcgagaucgagcagcucaagaaccagcugagccgcaagcggaacgagcgcggccaggagaagcgggacgcggagaaggugauguccgaccugauggcccgcaacagcgaccuccggaagcacaacgacauccugaccgccgagaucucccagauggagaacaacaacacgauccagcgcaacaagaacgugaugagcaccaccgucgugccggccauccuguccguggcccuccugagcuccagcaucgcgcccaucauggccgccucccccgacagccccaugaucaacccguggccccacgccaagaaccgggucgggaccggcauguacaaguacgacgagaacgacgacuccggcugccgccccauccgguacggggugagcugcaucggcuucgacuucaugcugaagauggacaaguaccccuucuucaacgcguucaucgggcacaagacgccgcucgaguccuucgccgacaagaucaucgagaaggaggaggagaccugcgagaucggcaccaacaaggaguucaagugcuucgaggagcgcgccuacaucaaggggaccugccccacgaacaucaacgccgugcacuacaucgacaacaaggggaagcugcgguacgucaagugcaaggagaaccuggagaugaccgaggacugcgccuucugccgcaagaucaagaagaaggcgggccagagcauccaggugcagaagaccuccgugccccuccaggacgccaucugccaggagaacagcgacaccuacuccgggcccaagaucccguucaagggcgucugcaagaucgggcugaucaaguacaaggagugcaaguucaagacgagcuccuacgagaccgugagcuucaucacccugaaggagaagggcaagaucuacaucgagcaccucaugcugaagaacaucgaggucgugaccaacgugagcuucgucugcuacgagcacgccggccaggacgagcaggagguggagcaccgggcccugaagcgcguguccgucaacgacugcaagaucguggacaacagcaagcagaagaucugcacgggggaccacaucuucugcgagaaguacgacugcuccaccagcuaccccgacgugaccugcauccacgcccccggcuccgggccccucuacaucaaccugaugggcagcuggaucaagccgcagugcgucggguacgagcgggugcugguggaccgcgaggucaagcagccccuccuggcgcccgagcagaacugcgacacgugcguguccgagugccuggacgagggcgugcacaucaagagcaccggcuucgagaucaccuccgccgucgccugcagccacggguccugcaucagcgcccaccaggaggccuccaccagcgugaucgugcccuacccgggccuccuggcguccgucgggggccgcaucgggauccaccugagccacaccuccgacagcgccagcgugcacaugguggucgugugcccgccccgggacuccugcgccgcccacaacugccuccugugcuaccacggcauccugaacuaccagugccacagcacgcucuccgccauccugaccagcuuccugcucauccuguucaucuacaccguguucuccgucaccaccaacaugcuguacgugcugcgccucauccccaagcagcucaagagccccgugggcuggcugcggcuguucaucaacuggcugcugacggcgcuccgcaucaagacccggaacgucauggggcgcaucaaccagcggaucggcuggguggaccaccacgacguggagcgcccccggcaccgcgagcccaugcggcgcuucaagaccacccugcugcucacgcugaucaugaugaccgggggcaacgccugcuccaacaccgucguggccaacagcaagcagacccggugcgugcaggagggcuccagcacgaagugcuccaucaccgccaccaucacccugcgcgcgggggucaucggcgccgagagcugcuucaucaucaaggggcccauggagaaccagcagaagacgaucuccaucaagaccaucagcuccgagaccgugugccgggagggcagcuccuucuggaccagccucuacaucccguccugccugagcagccgccggugccaccuggugggggacugcgucggcaacaagugccaguccuggcgcgacgaccagcucagccgggaguucuccggcgugaaggacaaccacaucaugaacgagaacaagugcuucgagcagugcggggccaucggcugcgggugcuucaacaucaaccccagcugccuguacgugcacgccuaccugaaguccgcccgcaacgaggcgguccgcguguucagcugcuccgacugggugcaccgggucagcuucgaggugaagggccccgacggggagacggagcucguggcccugggcucccugggcaccaaguuccucaacugggggacccugagccugucccucgacgccgagggcaucagcgggaccaacuccaucagcuuccuggaguccagcaagggcggguucgcccuguacgacgagggcuacuccgagaucccgcgcgagggcuuccucggggagauccggugcagcuccgagagcgccgcgaucagcgcccacaaguccugcauccgcgcccccggccugaucaaguacaagcccaugacggaccagaucgagugcaccgccagccuggucgaccccuucgccaucuuccucaaggggucccugccgcagacccggaacggccagaccuucacgagcaccaaggacaagaagaccgugcaggcguucaccaacggggccaucaaggcccugcucuccaucaaccuggacgaccacgagaucguguucaucaacaaggucaagagcugcgacgccacguuccugaacguguccggcugcuacagcugcgacuacggcgcgcacgugugcgucaaggugaaguccagcgaguccgccgacuucuucgccgagagcgaggacaagaccaccguccucuccuuccccauccagagcgggacccacgacuacugccaggugcugcacuuccagaagccccugguggacgagcgccucuccuacagcugcggcuccgagcccaagcugaucgucaucaaggggacgcugguguacaugggcguguacgacuuccggaacaagaccggcgggagcuccaccgucgugaacccgagcgagggcgccuggagcaucuccaacugguucagcgggcuccuggacuggcugggcgggcccaugaaggccauccucaagauccugggcuucaucgcgaucggcaucgugugcuucauccuguucaugaucaugauccgcaucgccgucaacuccaucaacaucaagaagaagaacuga

SEQ ID NO: 12720 - RNA, 3942 nt, Artificial Sequence
  derived and/or modified CDS sequence (opt1) from PTV(PAN479603)__KP272014.1__GP
augaucuucaccauccugaacauccucacccgcgccaugcuggugaugagcauguacucccugacgaccugggacagcaccucccggaacgacaugugcuucagcaacgacagcccccucgagggccuggucuacuacugggagacccacagcaagcgccacgacuacaagaagcaggagucccagaagugccgggugggggacagcgacaagaagaugaucuccaacgugacgaucaucagccugaucuccgagauccagaaguccaucuccgagcucagccuguccugcggcaacgacgacaacagcaccgggcagguccugaccuucaacggccucgaggacaccauccgcggggacuacaucguggacugcgugacgggccuguaccaguccgacaucggcgucggggugggccuggggcggacccaccacgaccaccaccaggugaagaacaaggccgucgugaucgacgagaaggagcgcaugaucagccuccuggagacccagcaguccgagaacgacaucaagaugcagguccugaugagcgagaucgagcagcucaagaaccagcugagccggaagcgcaacgagcggggccaggagaagcgcgacgcggagaaggugauguccgaccugauggcccggaacagcgaccuccgcaagcacaacgacauccugaccgccgagaucucccagaugaaguacgacaacacgauccagcggaacaagaacgugaugagcaccaccguggucccggccauccuguccguggcccuccugagcuccagcguggcgcccaucaucgccgccccgcccgacucccccaugaucaaccccuggccccacgccaagaaccgcgucgggaccggcauguacaaguacgacgacaacgacgacagcggcugccggcccauccgcuacgggguguccugcaucggcuucgacuucaugcugaagauggacaaguacccguucuucaacgcguucaucgggcacaagacgccccucgagagcuucgccgacaagaucaucgagaaggaggaggagaccugcgagaucggcaccaacaaggaguucaagugcuucgaggagcgggccuacaucaaggggaccugccccacgaacaucaacgccgugcacuacaucgacaacaaggggaagcugcgcuacgucaagugcaaggagaaccuggagaugaccgaggacugcgccuucugccggaagaucaagaagaaggcgggccaguccguccaggugcagaagaccagcgugccccuccaggacgccaucugccaggagaacuccgacaccuacagcgggccgaagauccccuucaagggcgugugcaagaucgggcugaucaaguacaaggagugcaaguucaagacguccagcuacgagaccgucuccuucaucacccugaaggagaagggcaagaucuacaucgagcaccucaugcugaagaacaucgagguggugaccaacgucagcuucgugugcuacgagcacgccggccaggacgagcaggagguggagcaccgcgcccugaagcgggucagcgugaacgacugcaagaucguggacaacuccaagcagaagaucugcacgggggaccacgucuucugcgagaaguacgacugcagcaccuccuaccccgacgugaccugcauccacgcccccggcagcgggccgcucuacaucaaccugaugggcuccuggaucaagccccagugcgugggguacgagcgcguccugguggaccgcgaggugaagcagccccuccuggcgcccgagcagaacugcgacacgugcgucagcgagugccuggacgagggcgugcacaucaaguccaccggcuucgagaucaccagcgccguggccugcucccacgggagcugcaucuccgcccaccaggaggccagcaccuccgucaucgugccguaccccggccuccuggcgagcgugggcggccggaucgggauccaccugucccacaccagcgacuccgccagcguccacauggugguggucugcccgccccgcgacagcugcgccgcccacaacugccuccugugcuaccacggcauccugaacuaccagugccacuccacgcucagcgccauccugaccuccuuccugcucauccuguucaucuacaccguguucagcgugaccaccaacaugcuguacguccugcggcucauccccaagcagcugaagucccccgugggcuggcugaagcuguucaucaacuggcuccugacgacccuccgcaucaagacccggaacgugauggggcgcaucaaccagcggaucggcugggucgaccacuucgacguggagcgcccccggcaccgcgagcccaugcggcgcuucaagaccacgcugcugcucacccugaucaugaugaccgggggcaacgcgugcagcaacaccguggucgccaacuccaagcagacgcggugcgugcaggagggcagcaacaccaagugcuccaucaccgccaccaucacgcugcgcgccggggugaucggcgcggagagcugcuucaucaucaaggggccgauggagaaccagcagaagaccaucuccaucaagaccaucagcuccgagaccgucugccgggagggcagcuccuucuggacgagccucuacauccccuccugccugagcucccgccggugccaccuggugggggacugcgugggcaacaagugccagagcuggcgcgacgaccagcucagccgggaguucuccggcgucaaggacaaccacaucaugaacgagaacaagugcuucgagcagugcggggccaucggcugcgggugcuucaacaucaaccccagcugccuguacgugcacgccuaccugaaguccgcccgcaacgaggccgugcgcgucuucagcugcuccgacugggugcaccgggugagcuucgaggucaagggcccggacggggagaccgagcucgugacccugggcucccugggcaccaaguuccucaacugggggacgcugagccugucccucgacgcggagggcaucagcgggaccaacuccaucagcuuccuggaguccagcaagggcggguucgcccuguacgacgagggcuacuccgagaucccccgcgagggcuuccucggggagauccggugcagcuccgagagcgccgccaucuccgcccacaagagcugcauccgcgcgcccggccugaucaaguacaagcccaugaccgaccagaucgagugcaccgccagccugguggacccguucgccaucuuccucaaggggucccugccccagacgcggaacggccagaccuucaccagcaccaaggacaagaagacgguccaggccuucaccaacggggccaucaaggcgcugcucuccaucaaccuggacgaccacgagaucguguucaucaaccgcgucaagagcugcgacgccaccuuccugaacguguccggcugcuacagcugcgacuacggcgcccacgugugcgucaaggugaaguccagcgaguccgccgacuucuucgcggagagcgaggacaagaccacggugcucuccuuccccauccagagcgggacccacgacuacugccagguccugcacuuccagaagccccugguggacgagcggcucuccuacagcugcggcuccgagccgaagcugaucgugaucaaggggacccuggucuacaugggcguguacgacuuccgcaacaagaccggcgggagcuccacgguggucaaccccagcgagggcgccugguccaucagcaacugguucagcgggcuccuggacuggcugggcgggcccaugaaggccauccucaagauccugggcuucaucgccaucggcaucgugugcuucauccuguucaugauccucauccggaucgccgugaacuccaucaacaucaagaagaagaacuga

SEQ ID NO: 12721 - RNA, 3942 nt, Artificial Sequence
  derived and/or modified CDS sequence (opt1) from PTV(PAN478718)__KP272017.1__GP
augaucuucaccauccugaacgugcucacccgcgccaugcuggucaugagcauguacucccugacgaccugggacagcuccagccggaacgacaugugcuucuccaacgacagcccccucgagggccugguguacuacugggagacccacuccaagaagcacgacuacaagaagcaggagagccagcgcugccgggugggggacuccgacaagaagaugaucaccaacgucacgaucaucagccugaucuccgagauccagaaguccaucagcgagcucagccuguccugcggcaacgacgacaacagcaccggccaggugcugaccuucaacggccucgaggacaccauccgcggggacuacaucguggacugcgucacgggccuguaccaguccgacaucggcgugggggugggccuggggcggacccaccacgaccaccagcaggucaagaacaaggccguggugaucgacgagaaggagcgcaugaucagccuccuggagacccagcaguccgagaacgacaucaagaugcagguccugaugagcgagaucgagcagcucaagaaccagcugagcaagaagcggaacgagcgcggccaggagaagcgggacgcggagaaggugauguccgaccugauggcccgcaacagcgaccuccggaagcacaacgacauccugaccgccgagaucucccagaugaaguacaacaacacgauccagcgcaacaagaacaucaugagcaccaccguggucccggccauccuguccguggcccuccugagcuccagcguggcgcccaucauggccgccccgcccgacucccccaugaucaaccccuggccccacgccaagaaccgggucgggaccggcauguacaaguacgacgacaacgacgacagcggcugccgccccauccgguacgggguguccugcaucggcuucgacuucaugcugaagauggacaaguacccguucuucaacgcguucaucgggcacaagacgccccucgagagcuucgccgacaagaucaucgagaaggaggaggagaccugcgagaucggcaccaacaaggaguucaagugcuucgaggagcgcgccuacaucaaggggaccugccccacgaacaucaacgccgugcacuacaucgacaacaaggggaagcugcgguacgucaagugcaaggagaaccuggagaugaccgaggacugcgccuucugccgcaagaucaagaagaaggcgggccaguccguccaggugcagaagaccagcgugccccuccaggacgccaucugccaggagaacuccgacaccuacagcgggccgaagauccccuucaagggcgugugcaagaucgggcugaucaaguacaaggagugcaaguucaagacguccagcuacgagaccgucuccuucaucacccugaaggagaagggcaagaucuacaucgagcaccucaugcugaagaacaucgagguggugaccaacgucagcuucgugugcuacgagcacgccggccaggacgagcaggagguggagcaccgggcccugaagcgcgucagcgugaacgacugcaagaucguggacuccagcaagcagaagaucugcacgggggaccacgucuucugcgagaaguacgacugcuccaccagcuaccccgacgugaccugcauccacgcccccggcuccgggccgcucuacaucaaccugaugggcagcuggaucaagccccagugcgugggguacgagcggguccugguggaccgcgaggugaagcagccccuccuggcgcccgagcagaacugcgacacgugcgucuccgagugccuggacgagggcgugcacaucaagagcaccggcuucgagaucaccuccgccguggccugcagccacggguccugcaucagcgcccaccaggaggccuccaccagcgucaucgugccguaccccggccuccuggcguccgucgggggccgcaucgggauccaccugagccacaccuccgacagcgccagcgugcacauggugguggucugcccgccccgggacuccugcgccgcccacaacugccuccugugcuaccacggcauccugaacuaccagugccacagcacgcucuccgccauccugaccagcuuccugcucauccuguucaucuacaccguguucuccgugaccaccaacaugcuguacguccugcgccucauccccaagcagcucaagagccccgugggcuggcugaagcuguucaucaacuggcugcugacggcgcuccggaucaagacccgcaacgugauggggcggaucaaccagcgcaucggcugggucgaccaccacgacguggagcggccccgccaccgggagcccaugcgccgguucaagaccacccugcugcucacgcugaucaugaugaccgggggcaacgccugcuccaacaccguggucgccaacagcaagcagacccgcugcgugcaggagggcuccaacacgaagugcagcaucaccgccaccaucacccugcgggcgggggugaucggcgccgaguccugcuucaucgucaaggggccgauggagaaccagcagaagacgaucagcaucaagaccaucuccagcgagaccgugugccgcgagggcuccagcuucuggaccucccucuacauccccagcugccuguccagccggcgcugccaccuggugggggacugcgucggcaacaagugccagagcuggcgggacgaccagcucucccgcgaguucagcggcgugaaggacaaccacaucaugaacgagaacaagugcuucgagcagugcggggccaucggcugcgggugcuucaacaucaaccccuccugccuguacgugcacgccuaccucaagagcgcccggaacgaggcgguccgcguguucuccugcagcgacugggugcaccgcgucuccuucgaggugaagggcccggacggggagacggagcuggugacccugggcagccugggcaccaaguuccucaacugggggacccugucccugagccucgacgccgagggcaucuccgggacgaacagcaucuccuuccuggagagcuccaagggcggguucgcccuguacgacgagggcuacagcgagaucccccgggagggcuuccucggggagauccgcugcuccagcgaguccgccgccaucagcgcgcacaagagcugcauccgggcccccggccugaucaaguacaagcccaugaccgaccagaucgagugcaccgccucccuggucgacccguucgccaucuuccucaaggggagccugccccagacccgcaacggccagacguucaccuccaccaaggacaagaagaccgugcaggccuucacgaacggggcgaucaaggcccugcucagcaucaaccuggacgaccacgagaucguguucaucaacaaggucaucuccugcgacgccaccuuccugaacgugagcggcugcuacuccugcgacuacggcgcccacgucugcgugaaggucaagagcuccgagagcgcggacuucuucgccgaguccgaggacaagaccaccgugcucagcuuccccauccaguccgggacgcacgacuacugccaggugcugcacuuccagaagccccugguggacgagcggcucagcuacuccugcggcagcgagccgaagcugaucgucaucaaggggacccugguguacaugggcguguacgacuuccgcaacaagaccggcggguccagcaccgucgugaaccccuccgagggcgccuggagcaucagcaacugguucuccgggcuccuggacuggcugggcgggcccaugaaggccauccucaagauccugggcuucaucgccaucggcaucgugugcuucauccuguucaugauccucauccggaucgcggucaacagcaucaacaucaagaagaagaacuga

SEQ ID NO: 12722 - RNA, 3942 nt, Artificial Sequence
  derived and/or modified CDS sequence (opt1) from PTV(Balliet)__KP272023.1__GP
augaucuucaccauccugaacgugcucacccgcgccaugcuggucaugagcauguacucccugacgaccugggacagcaccucccggaacgacaugugcuucagcaacgacagcccccucgagggccugguguacuacugggagacccacuccaagaagcacgacuacaagaagcagaagucccagcgcugccgggugggggacagcgacaagaagaugaucacgaacgucaccaucaucucccugaucagcgagauccagaaguccaucagcgagcucucccugagcugcggcaacgacgacaacuccaccggccaggugcugaccuucaacgggcucgaggacacgauccgcggggacuacaucguggacugcgucaccggccuguaccagagcgacaucggcgugggggugggccuggggcggacccaccacggccaccagcagaugaagaacaaggccgucgugaucgacgagaaggagcgcaugauccuccugcuggagacccagcaguccgagaacgacaucaagaugcagguccucaugagcgagaucgagcagcugaagaaccagcuguccaagaagcggaacgagcgcgggcaggagaagcgggacgcggagaaggugaugagcgaccucauggcccgcaacagcgaccugcggaagcacaacgacauccugacggccgagaucucccagaugaagaacaagaacaccauccagcgcaacaagaacaccgugagcaccacgguggucccggccauccucuccguggcccugcugagcuccagcguggcgcccaucaucgccgccccgcccgacucccccaugaucaaccccuggccccacgccaagaaccgggucggcaccggcauguacaaguacgacgagaacgacgacagcgggugccgccccauccgguacggcguguccugcaucggguucgacuucaugcucaagauggacaaguacccguucuucaacgcguucaucggccacaagacgccccuggagagcuucgccgacaagaucaucgagaaggaggaggagaccugcgagaucggcacgaacaaggaguucaagugcuucgaggagcgcgccuacaucaaggggaccugccccaccaacaucaacgccgugcacuacaucgacaacaagggcaagcugcgguacgucaagugcaaggagaaccucgagaugaccgaggacugcgccuucugccgcaagaucaagaagaaggcggggcaguccguccaggugcagaagacgagcgugccccugcaggacgccaucugccaggagaacuccgacaccuacagcggcccgaagauccccuucaagggggugugcaagaucggccugaucaaguacaaggagugcaaguucaagaccuccagcuacgagaccgucuccuucaucacgcucaaggagaagggcaagaucuacaucgagcaccugaugcugaagaacaucgagguggugaccaacgucagcuucgugugcuacgagcacgccgggcaggacgagcaggagguggagcacaaggcccucaagcgggucuccgugaacgacugcaagaucguggacaacagcaagcagaagaucugcaccggcgaccacgucuucugcgagaaguacgacugcagcaccuccuaccccgacgugacgugcauccacgcccccgggagcggcccgcuguacaucaaccugaugggguccuggaucaagccccagugcgugggcuacgagcgcguccucguggaccgggaggugaagcagccccugcuggcgcccgagcagaacugcgacacgugcgucagcgagugccucgacgagggcgugcacaucaaguccaccggguucgagaucaccagcgccguggccugcucccacggcagcugcaucuccgcccaccaggagccgagcaccuccgucaucgugcccuaccccgggcugcuggccagcgugggcgggcgcaucggcauccaccucucccacaccagcgacuccgcgagcguccacauggugguggucugcccgccccgcgacuccugcgccgcccacaacugccugcugugcuaccacggcauccucaacuaccagugccacagcacccugagcgccauccugaccuccuuccuccugauccuguucaucuacaccguguucagcgugacgaccaacauccuguacguccuccggcugauccccaagcagcugaagucccccgugggguggcucaagcuguucaucaacuggcugcucaccgcccugcgcaucaagacccggaacgugaugggccgcaucaaccagcggaucgggugggucgaccaccacgacguggagcgcccccggcaccgcgagccgaugcggcgcuucaagacgacccugcuccugacccugaucaugaugaccggcggcaacgcgugcagcaacacgguggucgccaacuccaagcagacccggugcgugcaggaggggagcaacaccaagugcuccaucaccgccacgaucacccuccgcgccggcgugaucggggcggagagcugcuucaucaucaagggccccauggagaaccagcagaagaccaucuccaucaagaccaucagcuccgagacggucugccgggaggggagcuccuucuggaccagccuguacauccccuccugccugagcucccgccggugccaccucgugggcgacugcgugggcaacaagugccagagcuggcgcgacgaccagcugucccgggaguucagcggggucaaggacaaccacaucaugaacgagaacaagugcuucgagcagugcggcgccaucgggugcggcugcuucaacaucaacccgagcugccuguacgugcacgccuaccucaaguccgcccgcaacgaggccgugcgggucuucagcugcuccgacugggugcaccgcgugagcuucgaggucaaggggcccgacggcgagaccgagcuggugacccugggcucccucgggacgaaguuccugaacuggggcacccugagccucucccuggacgcggaggggaucagcggcaccaacuccaucagcuuccuggaguccagcaagggcggguucgcccucuacgacgagggcuacaacgagaucccccgcgagggguuccugggcgagauccggugcuccagcgaguccgccgccaucagcgcccacaaguccugcauccgcgcgcccgggcugaucaaguacaagccgaugaccgaccagaucgagugcacggccagccucguggaccccuucgccaucuuccugaagggcucccugccccagacccggaacgggcagaccuucaccagcacgaaggacaagaagaccguccaggccuucaccaacggcgccaucaaggcgcuccugagcaucaaccuggacgaccacgagaucguguucaucaacaaggugaagaacugcgacgccaccuuccucaacgucuccggcugcuacagcugcgacuacggggcccacgugugcgucaaggugaaguccagcgaguccgccgacuucuucgcggagagcgaggacaagacgaccgugcuguccuuccccauccagagcggcacccacgacuacugccagguccugcacuuccagaagccgcucguggacgagcgccuguccuacagcugcggguccgagcccaagcugaucgugaucaagggcacccucgucuacaugggcguguacgacuuccggaacaagaccgggggcagcuccaccguggucaaccccagcgagggggccugguccaucagcaacugguucuccggccugcuggacuggcucgggggccccaugaaggccauccugaagauccugggcuucaucgccaucgggaucgugugcuucguccucuucaugauccugauccgcaucgccgugaacagcaucaacaucaagaagaagaacuga

SEQ ID NO: 12723 - RNA, 3942 nt, Artificial Sequence
  derived and/or modified CDS sequence (opt1) from PTV(Adames)__KP272029.1__GP
augaucuucaccauccugaacgugcucacccgcgccaugcuggucaugagcauguacucccugacgaccugggacagcuccagccggaacgacaucugcuucuccaacgacagcccccucgagggccugguguacuacugggagacccacuccaagaagcacgacuacaagaagcaggggagccagaagugccgcgugggcgacuccgacaagaagaugaucagcaacgucaccaucaucucccugaucagcgagauccagaaguccaucagcgagcucucccugagcugcgggaacaacgacaacuccacgggccaggugcugaccuucaacgggcucgaggacaccauccggggcgacuacaucguggacugcgucaccggccuguaccagagcgacaucggggugggcguggggcugggccgcaucaaccacgaccaccagcaggucaagaacaaggccguggugaucgacgagaaggagaagaugaucucccuccuggagacgcagcagagcgagaacgacaucaagacccagguccugaugagcgagaucgagcagcucaagaaccagcuguccaagcggcgcaacgagcgggggcaggagaagcgcgacgcggagaagcugaugagcgaccucauggcccggaacuccgaccugcgcaaccacaacgugauccugaccgacgagaucagccagaucaagaacaacaucaccauccaccggaaccgcaacaugauguccacgaccguggucccggccauccucagcguggcccugcuguccagcuccgugggccccaucaccgccgcgccgcccgacagcaccaugaucaaccccuggccccacgccaagaaccgggucggcacggggauguacaaguacgacgagaacgacgaguccggcugccgccccauccgguacggggugagcugcaucggcuucgacuucaugcucaagauggacaaguaccccuucuucaacgccuucaucggccacaagaccccgcuggaguccuucgccgacaagaucaucgagaaggaggaggagaccugcgagaucgggaccaacaaggaguucaagugcuucgaggagcgcgcguacaucaagggcacgugccccaccaacaucaacgccgugcacuacaucgacaacaaggggaagcugcgguacgucaagugcaaggagaaccucgagaugaccgaggacugcgccuucugccgcaagaucaagaagaaggccggccagagcguccaggugcagaagaccuccgugccccugcaggacgccaucugccaggagaacagcgacaucuacuccgggcccaagaucccguucaagggcgugugcaagaucggccugaucaaguacaaggagugcaaguucaagacgagcuccuacgagaccaucagcuucaucacccucaaggggaagggcaagaucuacaucgagcaccugaugcugaagaacaucgaggucgugaccaacgugagcuucgucugcuacgagcacgcggggcaggacgagcaggagguggagcaccgggcccucaagcgcguguccgucaacgacugcaagaucguggacaacagcaagcagaagaucugcacgggcgaccacaucuucugcgagaaguacgacugcuccaccagcuaccccgacgugaccugcauccacacccccggguccggcccccuguacaucaaccugaugggcagcuggaucaagccgcagugcgucggguacgagcgggugcucguggaccgcgaggucaagcagccccugcuggugcccgagcagaacugcgacacgugcguguccgagugccucgacgagggcguccacaucaagagcaccggguucgagaucaccuccgccguggccugcagccacggcuccugcaucagcgcccaccaggaggcguccaccagcgugaucauccccuacccggggcugcuggccuccgucggcggccgcaucgggauccaccucagccacacguccgacagcgccagcgugcacaugguggucgugugcccgccccgggacuccugcgccgcccacaacugccugcugugcuaccacggcauccucaacuaccagugccacagcacccuguccgcgauccugaccagcuuccuccugauccuguucaucuacaccgccuucuccgugaccacgaacguccuguacgugcuccgccugauccccaagcagcucaagagccccgugggguggcugaagcuguucgucaacuggcugcucaccgcccugcggaucaagacccgccgggugaugggccgcaucaaccagcggaucggcuggguggaccaccacgacgucgagcgcccccggcaccgcgagcccaugcggcgcuucaagaccacgcugcuccugacccugaucauggugaccgggggcaacgccugcuccaacaccguggucgccaacagcaagcagacgcggugcgugcaggagggguccaacaccaagugcagcaucaccgcgaccaucacgcuccgcgccggcgugaucggggccgaguccugcuucaucaucaagggccccauggagaaccagcagaagaccaucagcaucaagaccaucuccagcgagaccgucugccgggagggcuccagcuucuggacgucccuguacaucccgagcugccuguccagccgccggugccaccucgugggggacugcgugggcaacaagugccagagcuggcgcgacgaccagcugucccgggaguucagcggggucaaggacaaccacaucaugaacgagaacaagugcuucgagcagugcggcgccaucgggugcggcugcuucaacaucaaccccuccugccuguacgugcacgcguaccucaagagcgcccgcaacgaggccgugcgcgucuucuccugcagcgacugggugcaccggguguccuucgaggucaagggccccgacggggagauggagcuggugacccugggcagccucgggaccaaguuccugaacuggggcacccugucccucagccuggacgccgaggggaucuccggcacgaacagcaucuccuuccuggagagcuccaagggcggguucgcccucuacgacgagggcuacagcgagaucccgcgcgagggguuccugggcgagauccggugcuccagcgaguccgcggccaucagcgcccacaagagcugcauccgcgcccccgggcugaucaaguacaagcccaugaccgaccagaucgagugcaccgccucccucguggaccccuucgcgaucuuccugaagggcagccugccgcagacccggaacggccagacguucaccuccaccaaggacaagaagaccguccaggccuucacgaacggggccaucaaggcccuccugagcaucaaccuggacgaccacgagaucaucuucaucaacaaggugaaguccugcgacgccaccuuccucaacgugagcggcugcuacuccugcgacuacggggcgcacgucugcgugaaggucaagagcuccgagagcgccgacuucuucgccgaguccgaggacaagaccaccgugcugagcuuccccauccaguccggcacgcgcgacuacugccaggugcugcacuuccagaagccccucgucgacgagcggcugagcuacuccugcggcagcgagcccaagcugaucgugaucaaggggacccucguguacaugggcgucuacgacuuccgcaacaagaccgggggcuccagcaccgugaucaacccguccgaggggacguggagcaucagcaacugguucuccggccugcuggacuggcucggcgggcccaugaaggccauccugaagauccugggcuucaucgcgaucgggaucgugugcuucauccucuucaugauccugauccggaucgccgucaacagcaucaacaucaagaagaagaacuga

SEQ ID NO: 12724 - RNA, 3942 nt, Artificial Sequence
  derived and/or modified CDS sequence (opt1) from PTV(GML488831)__KP272032.1__GP
augaucuucaccauccugaacgugcucacccgcgccaugcuggucaugagcauguacucccugacgaccugggacagcaccucccggaacgacaugugcuucagcaacgacagcccccucgagggccugguguacuacugggagacccacagcaagaagcacgacuacaagaagcaggagucccagcgcugccgggugggggacagcgacaagaagaugaucacgaacgucaccaucaucucccugaucagcgagauccagaaguccaucagcgagcucucccugagcugcggcaacgacgacaacuccaccggccaggugcugaccuucaacggccucgaggacacgauccgcggggacuacaucguggacugcgucaccggccuguaccagagcgacaucggcgugggggugggccuggggcgggcccaccacgaccaccagcaggucaagaacaaggcgguggugaucgacgagaaggagcgcaugaucucccuccuggagacccagcagagcgagaacgacaucaagaugcagguccugauguccgagaucgagcagcucaagaaccagcugagcaagaagcggaacgagcgcggccaggagaagcgggacgccgagaaggugaugagcgaccugauggcccgcaacuccgaccuccggaagcacaacgacauccugaccgccgagaucagccagaugaaguacaacaacacgauccagcgcuccaagaacgugaugagcaccaccgucgugccggccauccuguccguggcgcuccugagcuccagcgucgcccccaucauggccgccccgcccgacucccccaugaucaaccccuggccccacgcgaagaaccggguggggaccggcauguacaaguacgacgacaacgacgacagcggcugccgccccauccgguacgggguguccugcaucggcuucgacuucaugcugaagauggacaaguacccguucuucaacgccuucaucgggcacaagacgccccucgagagcuucgccgacaagaucaucgagaaggaggaggagaccugcgagaucggcaccaacaaggaguucaagugcuucgaggagcgcgccuacaucaaggggaccugccccacgaacaucaacgccguccacuacaucgacaacaaggggaagcugcgguacgugaagugcaaggagaaccuggagaugaccgaggacugcgcguucugccgcaagaucaagaagaaggccggccaguccgugcagguccagaagaccagcgugucccuccaggacgccaucugccaggagaacagcgacaacuacuccgggcccaagaucccguucaagggcgucugcaagaucgggcugaucaaguacaaggagugcaaguucaagaccagcuccuacgagacggugagcuucaucacccugaaggagaagggcaagaucuacaucgagcaccucaugcugaagaacaucgagguggucaccaacgugagcuucgugugcuacgagcacgccggccaggacgagcaggaggucgagcaccgggcccugaagcgcguguccgugaacgacugcaagaucgucgacaacagcaagcagaagaucugcaccggggaccacguguucugcgagaaguacgacugcuccacgagcuaccccgacgugaccugcauccacgcgcccggcuccgggccccucuacaucaaccugaugggcagcuggaucaagccgcagugcgucggguacgagcgggugcugguggaccgcgaggucaagcagccccuccuggcccccgagcagaacugcgacacgugcguguccgagugccuggacgagggcgugcacaucaagagcaccggcuucgagaucacguccgccgucgccugcagccacggguccugcaucagcgcccaccaggaggcguccaccagcgugaucgugcccuacccgggccuccuggccuccgucgggggccgcaucgggauccaccugagccacaccuccgacagcgccagcgugcacaugguggucgugugcccgccccgggacuccugcgccgcccacaacugccuccugugcuaccacggcauccugaacuaccagugccacagcacccucuccgcgauccugacgagcuuccugcucauccuguucaucuacaccguguucuccgucaccaccaacaugcuguacgugcugcgccucauccccaagcagcugaagucccccgugggcuggcugaagcuguucaucaacuggcugcugaccgcccuccggaucaagacgcgcaacgucauggggcggaucaaccagcgcaucggcuggguggaccaccacgacguggagcggccccgccaccgggagcccaugcgccgguucaagaccacccugcugcucacccugaucaugaugaccgggggcaacgccugcuccaacaccgucguggccaacagcaagcagacccgcugcgugcaggagggcuccaacaccaagugcagcaucacggcgaccaucacccugcgggccggggucaucggcgccgaguccugcuucaucaucaaggggcccauggagaaccagcagaagaccaucagcaucaagacgaucuccagcgagaccgugugccgcgagggcuccagcuucuggaccucccucuacaucccgagcugccuguccagccggcgcugccaccuggugggggacugcgucggcaacaagugccagagcuggcgggacgaccagcucucccgcgaguucagcggcgugaaggacaaccacaucaugaacgagaacaagugcuucgagcagugcggggccaucggcugcgggugcuucaacaucaaccccuccugccuguacgugcacgccuaccucaagagcgcgcggaacgaggccguccgcguguucuccugcagcgacugggugcaccgcgucuccuucgaggugaagggccccgacggggagaccgagcucgugacgcugggcagccugggcaccaaguuccucaacugggggacccugucccugagccucgacgccgagggcaucuccgggaccaacagcaucuccuuccuggagagcuccaagggcggguucgcccuguacgacgagggcuacagcgagaucccgcgggagggcuuccucggggagauccgcugcuccagcgaguccgccgcgaucagcgcccacaagagcugcauccgggcccccggccugaucaaguacaagcccaugacggaccagaucgagugcaccgccucccuggucgaccccuucgccaucuuccucaaggggagccugccgcagacccgcaacggccagaccuucacguccaccaaggacaagaagaccgugcaggcguucaccaacggggccaucaaggcccugcucagcaucaaccuggacgaccacgagaucguguucaucaacaagguccgguccugcgacgccacguuccugaacgugagcggcugcuacuccugcgacuacggcgcgcacgucugcgugaaggucaagagcuccgagagcgccgacuucuucgccgaguccgaggacaagaccaccgugcucagcuuccccauccaguccgggacccacgacuacugccaggugcugcacuuccagaagccccugguggacgagcgccucagcuacuccugcggcagcgagcccaagcugaucgucaucaaggggacgcugguguacaucggcguguacgacuuccggaacaagaccggcggguccagcaccgucgugaacccguccgagggcgccuggagcaucagcaacugguucuccgggcuccuggacuggcugggcgggcccaugaaggccauccucaagauccugggcuucaucgcgaucggcaucgugugcuucauccuguucaugauccucauccgcaucgccgucaacagcaucaacaucaagaagaagaacuga

SEQ ID NO: 12725 - RNA, 3942 nt, Artificial Sequence
  derived and/or modified CDS sequence (opt1) from PTV(GML488778)__KP272038.1__GP
augaucuucaccauccugaacgugcucauccgcgccaugcuggucaugagcauguacucccugaccacgugggacagcaccucccggaacgacaugugcuucagcaacgacagcccccucgagggccugguguacuacugggagacccacuccaagaagcacgacuacaagaagcaggagucccagcgcugccgggugggggacagcgacaagaagaugaucaccaacgucacgaucaucucccugaucagcgagauccagaaguccaucagcgagcucucccugagcugcggcaacgacgacaacuccaccggccaggugcugaccuucaacgggcucgaggacaccauccgcggggacuacaucguggacugcgucacgggccuguaccagagcgacaucggcgugggggugggccuggggcggacccaccacgaccaccagcaggucaagaacaaggccguggugaucgacgagaaggagcgcaugaucucccuccuggagacccagcagagcgagaacgacaucaagaugcagguccugauguccgagaucgagcagcucaagaaccagcugagcaagaagcggaacgagcgcggccaggagaagcgggacgcggagaaggugaugagcgaccugauggcccgcaacuccgaccuccggaagcacaacgggauccugaccgccgagaucagccagaugaaguacaacaacacggugcagcgcuccaagaacgucaugagcaccaccguggugccggccauccuguccgucgcccuccugagcuccagcguggcgcccaucauggccgccccgcccgacucccccaugaucaaccccuggccccacgccaagaaccgggugggcaccggcauguacaaguacgacgacaacgacgacagcgggugccgccccauccgguacggcgucuccugcaucggguucgacuucaugcugaagauggacaaguacccguucuucaacgcguucaucggccacaagacgccccucgagagcuucgccgacaagaucaucgagaaggaggaggagaccugcgagaucggcaccaacaaggaguucaagugcuucgaggagcgcgccuacaucaaggggaccugccccacgaacaucaacgccgugcacuacaucgacaacaagggcaagcugcgguacgugaagugcaaggagaaccuggagaugaccgaggacugcgccuucugccgcaagaucaagaagaaggcggggcaguccguccaggugcagaagaccagcgucucccuccaggacgccaucugccaggagaacagcgacaacuacuccggccccaagaucccguucaagggggugugcaagaucggccugaucaaguacaaggagugcaaguucaagaccagcuccuacgagacggugagcuucaucacccugaaggagaagggcaagaucuacaucgagcaccucaugcugaagaacaucgaggucgugaccaacgugagcuucgucugcuacgagcacgccgggcaggacgagcaggagguggagcaccgggcccugaagcgcguguccgucaacgacugcaagaucguggacagcuccaagcagaagaucugcaccggcgaccacguguucugcgagaaguucgacugcagcacguccuaccccgacgugaccugcauccacgcccccgggagcggcccccucuacaucaaccugaugggguccuggaucaagccgcagugcgugggcuacgagcgggugcuggucgaccgcgaggugaagcagccccuccuggcgcccgagcagaacugcgacacgugcgugagcgagugccuggacgagggcguccacaucaaguccaccggguucgagaucaccagcgccguggccugcucccacggcagcugcaucuccgcccaccaggaggccagcaccuccgugaucguccccuacccggggcuccuggcgagcgugggcgggcgcaucggcauccaccugucccacaccagcgacagcgccuccgugcacauggucguggugugcccgccccgggacagcugcgccgcccacaacugccuccugugcuaccacggcauccugaacuaccagugccacuccacccucagcgccauccugacguccuuccugcucauccuguucaucuacaccgucuucagcgugaccaccaacaugcuguacgugcugcgccucauccccaagcagcugaagucccccgucggguggcugaagcuguucaucaacuggcugcugaccgcgcuccggaucaagacgcgcaacgugaugggccggaucaaccagcgcaucggguggguggaccaccacgacgucgagcggccccgccaccgggagcccaugcgccgguucaagaccacccugcugcucacccugaucaugaugacgggcggcaacgccugcagcaacaccgugguggccaacuccaagcagacccgcugcguccaggaggggagcaacaccaagugcuccaucacggccaccaucacccugcgggcgggcgugaucggggccgagagcugcuucaucaucaagucccccauggagaaccagcagaagaccaucagcaucaagacgaucuccagcgagaccgugugccgcgagggcuccagcuucuggaccucccucuacaucccgagcugccugagcucccggcgcugccaccuggucggggacugcgugggcaacaagugccagagcuggcgggacgaccagcucucccgcgaguucagcggcgugaaggacaaccacaucaugaacgagaacaagugcuucgagcagugcggggccaucggcugcgggugcuucaacaucaaccccuccugccuguacguccacgccuaccucaagagcgcccggaacgaggcggugcgcguguucuccugcagcgacuggguccaccgcguguccuucgaggugaagggccccgacggggagaccgagcucgucacgcugggcagccugggcaccaaguuccucaacugggggacccugucccugagccucgacgccgagggcaucuccgggaccaacagcaucuccuuccuggagagcuccaagggcggguucgcccuguacgacgagggcuacagcgagaucccgcgggagggcuuccucggggagauccgcugcuccagcgagagcgccgccaucuccgcgcacaagagcugcauccgggcccccggccugaucaaguacaagcccaugacggaccagaucgagugcaccgccucccugguggaccccuucgccaucuuccucaaggggagccugccgcagacccgcaacggccagaccuucacguccaccaaggacaagaagaccgugcaggccuucaccaacggggcgaucaaggcccugcucagcaucaaccuggacgaccacgagaucaucuucaucaacaagguccgguccugcgacgccacguuccugaacgugagcggcugcuacuccugcgacuacggcgcccacgucugcgugaaggucaagagcuccgagagcgcggacuucuucgccgaguccgaggacaagaccaccguccucagcuuccccauccaguccgggacccacgacuacugccaggugcugcacuuccagaagccccugguggacgagcgccucagcuacuccugcggcagcgagcccaagcugaucgucaucaaggggacgcugguguacaugggcguguacgacuuccggaacaagaccggcggguccagcaccgucgugaacccgagcgagggcgccugguccaucagcaacugguucuccgggcuccuggacuggcugggcgggcccaugaaggccaucaucaagauccucggcuucaucgccaucggcguggucugcuucauccuguucaugauccugauccgcaucgcggugaacagcaucaacaucaagaagaagaacuga

SEQ ID NO: 12726 - RNA, 3945 nt, Artificial Sequence
  derived and/or modified CDS sequence (opt1) from PTV(Adames)__DQ363407.1__GP
augaucuucaccauccugaacgugcucacccgcgccaugcuggucaugagcauguacucccugacgaccugggacagcuccagccggaacgacaucugcuucuccaacgacagcccccucgagggccugguguacuacugggagacccacuccaagaagcacgacuacaagaagcaggggagccagaagugccgcgugggcgacuccgacaagaagaugaucagcaacgucaccaucaucucccugaucagcgagauccagaaguccaucagcgagcucucccugagcugcgggaacaacgacaacuccacgggccaggugcugaccuucaacgggcucgaggacaccauccggggcgacuacaucguggacugcgucaccggccuguaccagagcgacaucggggugggcguggggcugggccgcaucaaccacgaccaccagcaggucaagaacaaggccguggugaucgacgagaaggagaagaugaucucccuccuggagacgcagcagagcgagaacgacaucaagacccagguccugaugagcgagaucgagcagcucaagaaccagcuguccaagcggcgcaacgagcgggggcaggagaagcgcgacgcggagaagcugaugagcgaccucauggcccggaacuccgaccugcgcaaccacaacgugauccugaccgacgagaucagccagaucaagaacaacaucaccauccaccggaaccgcaacaugauguccacgaccguggucccggccauccucagcguggcccugcuguccagcuccgugggccccaucaccgccgcgccgcccgacagcaccaugaucaaccccuggccccacgccaagaaccgggucggcacggggauguacaaguacgacgagaacgacgaguccggcugccgccccauccgguacggggugagcugcaucggcuucgacuucaugcucaagauggacaaguaccccuucuucaacgccuucaucggccacaagaccccgcuggaguccuucgccgacaagaucaucgagaaggaggaggagaccugcgagaucgggaccaacaaggaguucaagugcuucgaggagcgcgcguacaucaagggcacgugccccaccaacaucaacgccgugcacuacaucgacaacaaggggaagcugcgguacgucaagugcaaggagaaccucgagaugaccgaggacugcgccuucugccgcaagaucaagaagaaggccggccagagcguccaggugcagaagaccuccgugccccugcaggacgccaucugccaggagaacagcgacaucuacuccgggcccaagaucccguucaagggcgugugcaagaucggccugaucaaguacaaggagugcaaguucaagacgagcuccuacgagaccaucagcuucaucacccucaaggggaagggcaagaucuacaucgagcaccugaugcugaagaacaucgaggucgugaccaacgugagcuucgucugcuacgagcacgcggggcaggacgacgagcaggagguggagcaccgggcccucaagcgcguguccgucaacgacugcaagaucguggacaacagcaagcagaagaucugcacgggcgaccacaucuucugcgagaaguacgacugcuccaccagcuaccccgacgugaccugcauccacacccccggguccggcccccuguacaucaaccugaugggcagcuggaucaagccgcagugcgucggguacgagcgggugcucguggaccgcgaggucaagcagccccugcuggugcccgagcagaacugcgacacgugcguguccgagugccucgacgagggcguccacaucaagagcaccggguucgagaucaccuccgccguggccugcagccacggcuccugcaucagcgcccaccaggaggcguccaccagcgugaucauccccuacccggggcugcuggccuccgucggcggccgcaucgggauccaccucagccacacguccgacagcgccagcgugcacaugguggucgugugcccgccccgggacuccugcgccgcccacaacugccugcugugcuaccacggcauccucaacuaccagugccacagcacccuguccgcgauccugaccagcuuccuccugauccuguucaucuacaccgccuucuccgugaccacgaacguccuguacgugcuccgccugauccccaagcagcucaagagccccgugggguggcugaagcuguucgucaacuggcugcucaccgcccugcggaucaagacccgccgggugaugggccgcaucaaccagcggaucggcuggguggaccaccacgacgucgagcgcccccggcaccgcgagcccaugcggcgcuucaagaccacgcugcuccugacccugaucauggugaccgggggcaacgccugcuccaacaccguggucgccaacagcaagcagacgcggugcgugcaggagggguccaacaccaagugcagcaucaccgcgaccaucacgcuccgcgccggcgugaucggggccgaguccugcuucaucaucaagggccccauggagaaccagcagaagaccaucagcaucaagaccaucuccagcgagaccgucugccgggagggcuccagcuucuggacgucccuguacaucccgagcugccuguccagccgccggugccaccucgugggggacugcgugggcaacaagugccagagcuggcgcgacgaccagcugucccgggaguucagcggggucaaggacaaccacaucaugaacgagaacaagugcuucgagcagugcggcgccaucgggugcggcugcuucaacaucaaccccuccugccuguacgugcacgcguaccucaagagcgcccgcaacgaggccgugcgcgucuucuccugcagcgacugggugcaccggguguccuucgaggucaagggccccgacggggagauggagcuggugacccugggcagccucgggaccaaguuccugaacuggggcacccugucccucagccuggacgccgaggggaucuccggcacgaacagcaucuccuuccuggagagcuccaagggcggguucgcccucuacgacgagggcuacagcgagaucccgcgcgagggguuccugggcgagauccggugcuccagcgaguccgcggccaucagcgcccacaagagcugcauccgcgcccccgggcugaucaaguacaagcccaugaccgaccagaucgagugcaccgccucccucguggaccccuucgcgaucuuccugaagggcagccugccgcagacccggaacggccagacguucaccuccaccaaggacaagaagaccguccaggccuucacgaacggggccaucaaggcccuccugagcaucaaccuggacgaccacgagaucaucuucaucaacaaggugaaguccugcgacgccaccuuccucaacgugagcggcugcuacuccugcgacuacggggcgcacgucugcgugaaggucaagagcuccgagagcgccgacuucuucgccgaguccgaggacaagaccaccgugcugagcuuccccauccaguccggcacgcgcgacuacugccaggugcugcacuuccagaagccccucgucgacgagcggcugagcuacuccugcggcagcgagcccaagcugaucgugaucaaggggacccucguguacaugggcgucuacgacuuccgcgacaagaccgggggcuccagcaccgugaucaacccguccgaggggacguggagcaucagcaacugguucuccggccugcuggacuggcucggcgggcccaugaaggccauccugaagauccugggcuucaucgcgaucgggaucgugugcuucauccucuucaugauccugauccggaucgccgucaacagcaucaacaucaagaagaagaacuga

SEQ ID NO: 12727 - RNA, 3942 nt, Artificial Sequence
  derived and/or modified CDS sequence (opt1) from PTV__M11156.1__GP
augaucuucaccauccugaacgugcucacccgcgccaugcuggucaugagcauguacucccugacgaccugggacagcaccucccggaacgacaugugcuucagcaacgacagcccccucgagggccugguguacuacugggagacccacagcaagcgccacgacuacaagaagcaggagucccagcggugccgcgugggggacagcgacaagaagaugaucacgaacgucaccaucaucucccugaucagcgagauccagaaguccaucagcgagcucucccugagcugcgugaacgacgacaacuccaccggccaggugcugaccuucaacgggcucgaggacacgauccggggcgacuacaucgucgacugcgugaccgggcuguaccagagcgacaucggcgugggcgucgggcugggccgcacccaccacgggcaccagcagaugaagaacaaggccguggugaucgacgagaaggagcggaugaucucccuccuggagacccagcagagcgagaacgacaucaagaugcagguccugauguccgagaucgagcagcucaagaaccagcugagcaagaagcgcaacgagcggggccaggagaagcgcgacgcggagaaggugaugagcgaccugauggcccggaacuccgaccuccgcaagcacaacgacauccugacggccgagaucagccagaugaagaacaagaacaccauccagcggaacaagaacaccguguccaccacggucgugccggccauccugagcguggcccuccuguccagcuccgucgcgcccaucaucgccgccccgcccgacagccccaugaucaaccccuggccccacgccaagaaccgcguggggaccggcauguacaaguacgacgagaacgacgacuccggcugccggcccauccgcuacggggugagcugcaucggcuucgacuucaugcugaagauggacaaguacccguucuucaacgcguucaucgggcacaagacgccccucgaguccuucgccgacaagaucaucgagaaggaggaggagaccugcgagaucggcaccaacaaggaguucaagugcuucgaggagcgggccuacaucaaggggaccugccccaccaacaucaacgccguccacuacaucgacaacaaggggaagcugcgcuacgugaagugcaaggagaaccuggagaugaccgaggacugcgccuucugccggaagaucaagaagaaggcgggccagagcgugcagguccagaagacguccgugccccuccaggacgccaucugccaggagaacagcgacaccuacuccgggccgaagauccccuucaagggcgucugcaagaucgggcugaucaaguacaaggagugcaaguucaagaccagcuccuacgagaccgugagcuucaucacgcugaaggagaagggcaagaucuacaucgagcaccucaugcugaagaacaucgagguggucaccaacguguccuucgugugcuacgagcacgucggccaggacgagcaggagguggagcaccgcgcccugaagcgggugagcgucaacgacugcaagaucguggacaacagcaagcagaagaucugcaccggggaccacguguucugcgagaaguacgacugcuccaccagcuaccccgacgucacgugcauccacgcccccggcuccgggccgcucuacaucaaccugaugggcagcuggaucaagccccagugcgugggguacgagcgcgugcuggucgaccgcgaggugaagcagccccuccuggcccccgagcagaacugcgacacgugcguguccgagugccuggacgagggcguccacaucaagagcaccggcuucgagaucaccuccgcgguggccugcagccacggguccugcaucagcgcccaccaggagccguccaccagcgugaucguccccuaccccggccuccuggccuccgucgggggccggaucgggauccaccugagccacaccuccgacagcgccuccgugcacauggugguggugugcccgccccgcgacagcugcgcggcccacaacugccuccugugcuaccacggcauccugaacuaccagugccacagcacccucuccgccauccugaccagcuuccugcucauccuguucaucuacaccgucuucuccgugacgaccaacauccuguacgugcugcggcucauccccaagcagcugaagucccccgucggcuggcugaagcuguucaucaacuggcugcugaccgcccuccgcaucaagacccggaacgugaugcgccggaucaaccagcgcaucggguggguggaccaccacgacgucgagcggccccgccaccgggagccgaugcgccgguucaagacgacccugcugcucacccugaucaugaugaccggcgggaacgccugcuccaacacggugguggcgaacagcaagcagacccgcugcguccaggagggcuccaacaccaagugcagcaucaccgccacgaucacccugcgggccggcgugaucggggccgaguccugcuucaucaucaagggccccauggagaaccagcagaagaccaucagcaucaagaccaucuccagcgagacggugugccgcgagggguccagcuucuggaccucccucuacauccccagcugccuguccagccggcgcugccaccuggucggcgacugcguggggaacaagugccaguccuggcgggacgaccagcucagccgcgaguucagcggcgugaaggacaaccacaucaugaacgagaacaagugcuucgagcagugcggcgcgaucgggugcggcugcuucaacaucaacccguccugccuguacguccacgccuaccucaagagcgcccgcaacgaggccgugcggguguucuccugcagcgacuggguccaccgcguguccuucgaggugaaggggcccgacggcgagaccgagcucgucacccuggggagccccggcacgaaguuccugaacuggggcacccucucccugagccuggacgccgaggggaucuccggcaccaacagcaucuccuuccucgagagcuccaagggcggcuucgcgcuguacgacgagggguacaacgagaucccccgggagggcuuccugggcgagauccgcugcagcuccgagagcgccgccaucuccgcccacaagagcugcauccgggccccggggcucaucaaguacaagcccaugaccgaccagaucgagugcacggcgucccugguggaccccuucgccaucuuccugaagggcagccucccccagacccgcaacgggcagaccuucaccagcacgaaggacaagaagaccgugcaggccuucaccaacggcgccaucaaggcccugcuguccaucaaccucgacgaccacgagaucgucuucaucaacaaggugaagaacugcgacgcgaccuuccugaacgucagcgggugcuacuccugcgacuacggcgcccacgugugcgugaaggucaagagcuccgagagcgccgacuucuucgccgaguccgaggacaagacgaccgugcugagcuucccgauccaguccggcacccacgacuacugccaggugcuccacuuccagaagccccuggucgacgagcggcugagcuacuccugcgggagcgagcccaagcucaucgugaucaagggcacccuggugugcaugggggucuacgacuuccgcaacaagacgggcggcuccagcaccguggugaaccccuccgagggggcguggagcaucuccaacugguucagcggccugcucgacuggcucgggggcccgaugaaggccauccugaagauccugggguucaucgccaucggcaucgucugcuucgugcuguucaugauccugauccggaucgccgugaacuccaucaacaucaagaagaagaacuga

SEQ ID NO: 12728 - RNA, 3852 nt, Artificial Sequence
  derived and/or modified CDS sequence (opt1) from Phlebovirus(CoAr170255)__HM566149.1__GP
auguacaagcugaucaccaacauccucaagcugagcguggucuccgccauguacagcaucauguucugggaccccaccggcaucuccaagcugugccucagcaacaacuccccgcuggaggggcugguguacuacugggagaacacgaugcgcgagggcgaguucaagcgggagaagcgcaagaagugccggcucgggaucagcgagcccgcccccguguccaaccagaccaucgucagccugaucgaggaggugcagaagucccccgcggagaugauccugaucugcgaggccaacggcaacagcaccggguccagccucuccuucgacggccugagcgacaacgagaucaagccguccaucguggacugcaccacgggcgaccgcaccagcgaccugcggguccucguggggaagggcaucuucgagaagaagauguccaugagcaacgagaucgaccgcguggucucccuggaggaccaccuccagcgggagaaggagcuggugcagaccuuccaggaccugcaccacaacgagagcgagaagaacaagcugcucgagcacgagcuggagaacgugcgccagcagcugaagcgggagcgcgagagcaacaagaucaagauguggaccacgaagcggcccgagaucaccaccaucgggcucaccacgaccaucgccaccauccugcuggccucccagagcgucgccuccagcgugcccaugcccggccagcucaacaccuggccgcacgcgaagaaccgcgucgggggcggcguguucaaggccaacgacgacgacgaggacuccugcaagcugaucgacuacgggaucgccugccacggcuucgacuaccugcuccggacggacaucuaccccuucuucaacgcccacgugagccaccgcucccugcuggaggcgagcaacgaggggaucauccucaaggacgaggccuccugcgagaucgagaccaacaaggacuucaagugcuacgaggagcgggccuuccugaaguggagcugcccccaccuggugaacuccgcccacuucaucgacagcaagggcaagcuccgcaucaucaagugcaaggccgaguacgagaucaccgaggacugcaccuacugccggcgcaucaagaagaaggcggcccagcagaagcaggucuacaaguccagcaucgcccugcaggacgccgugugccaggagaacuccgacuacuacgacggcccccggaucacguucaccggggugugcaagaucggcaccauggaguacaagaagugcaagcacaagagcuccagcuucgagaacaucggguucaucaccauccgcgacaagggcaaguacuacaucgagaacaugcggacgaagaacaucgagauggucuccaacgugagcuucaucugcuacaaccacaacgggcaggacaccgagaaggacgugcgccugcucaagcgcgucaagccgggcgacugcaagguggucgacgacagcaagaccaagcacugcaccggcgaccacguguucugcgagaaguacgacugcacgaaguccuaccccgaggcgaccugcaugcacgcccccgggagcggccccauccuggugcuggucaugggggugugguucaagccgcagugcgugggcuacgagcggguccucguggagcgcgaggugaaggcccccguccugauccaggagaaggacugcgacacgugcguguucgagugccuggaggacaagauccucaucaaguccaccggguucaagaugaucagcgccguggccugcucccacggcagcugcgucuccagccaccagucccccagcaccuuccuguacaucgacuaccccggccugaccgccuccgucgggggcgagaucgggcuccaccugagccacaccgacgacuccgugagcgugcacaagaagauccacugcccggcgcgggaccccugcgaggcccacuccugcaucgugugcuaccacggccuggugaacuaccagugccacaccguccucagcuacuccguggugagcuuccugcuggucugcaugauguaccuggccuucuucaucacgagccgccuccuguucuuccugcggaucaugccccgccggcuccgcaaccccaucuccuggcugacccugcucauccggugggugcugcagacccugcucgccauccugcgccugagcuucaagaagcucuccgagaccaucggguggaacagcccgaacaaccggcagcagauggacguggaggccaaccgccggccccugcgccgguaccgcaccacguucauccugacccuccuguucgucggccugaccuccgcgugcagcaacaccgccguguccaacagcaagcagacgaagugccuccaguccggcgggagcgugaagugcuccaucaccgccaccaucacccugaaggccggcacgaucggggcggagagcugcuucaucaucaagggccccuccgagaaccagcagaaggucauccgggugaagaccgugagcuccgagaccgucugccgcgagggcagcuccuucuggaccgggcaguucacgcccagcugcguguccagccggcgcugccaccuggugggcgacugcgucgggaaccgcugccaggccuggcgggacgagguggugagccgcgaguucggcaacaugaaggacaacaacgucauguccgagaacaagugcuucgagcagugcggggccgccggcugcggcugcuucaacaucaacccgagcugccucuacgugcacuccaccuucaagagcgugcggcgcgaggccauccgggucuucaagugcaacgacugggugcaccgccugaccuucgagguguccgggcccagcggcgagaaggaccggaucguccugaacucccucagcaccaaguuccugcagugggggacgaucucccugagccucgacgcggagggcaucuccgggaccaacagcuacuccuuccuggagagcaacaagggcggcuucgccauccacgacgaggaguucuccgagaucccccgcgagggguaccugggcgagauccggugcagcuccgagagcgccgugaucgccgcccacaaguccugcauccgcgcgccgaaccucaucaaguacaagcccaugaccgaccagaucgacugcaccgccagccugguggaccccuucgccaucuuccugaaggggagccucccccagucccggagcggcuacacguucaccuccagcaccgacaagaagaccguccaggccuucaacuccgggagcaucaaggcccugaucuccaucaacauggacgaccacgagaucgaguuccugaacgacgcggccgacugcgacgccacguuccucaacgugagcggcugcuacuccugcaacuacggcgcccaggugugcaucaagguccgcagcuccaagagcuccaucuucagcuccaacaacaacgacaacagcaucgugaucaacuucgacgcggaccaggggacccgggacuacugccgcaucauccacuucaacggcccgcugguggacgagacccugcacuacuccugcgggggcgagagcaagcuccugcagaugaaggggucccugaucaccgucggccccuacgacuuccggaacacgaccggcggcaagagcaccaucgugaacccccacgaggagagcuggaaccucuucuccugguucagcgggcugcuggacuggcucgggggcccccugcgcgccauccugaagaucguccucaucaucaucaucggcaucauccuguucaucgugguggccuuccugauccggcucgucaucuucaacgugcugcugaaguccaagaagaacuga

SEQ ID NO: 12729 - RNA, 3873 nt, Artificial Sequence
  derived and/or modified CDS sequence (opt1) from Phlebovirus(CoAr171616)__HM566154.1__GP
auguuccagaucaucuaccugcucaccaagcuguaccuggugagcuccauguacagcaucauguucugggagaacgagaacaucuccaagcucugccugagcaacaacagcccccuggagggccucgucuacuacugggagaacgugaugaaggagggggacuucaaggaggagaagcgcaagaagugccggaucggcccgagcgaccugaagcgcgugaccaaccagacgcugaccacccucaucgaggagguccagaagucccccagcgagauccagcugcugugcgaggaggacgggaacaagaccggcaucuccauguucuucgacgggcucagcgacgacaucuccacgcccagcaucguggacugcaacggcaacauccggaucuccgaccugcgcgugcaggucggccgggggcacuucgagaaggagaacgagauccgcaagaucgaggagaucgugacccuggaggacgaccuccggcgcgagcgggaccugaacaagcugcuccaggaccugaacaagaaggacgccgaggagcgccggaucaucgagcacgagcugaccaacaugcgcgagcagcuccagcgggagcgcgagcggagcaagcagcagaucaaggagcacgagaagaucgaggugaacaaccacaaggagcccgccacccaccugaacgucuccaagcugcucacgaucggccugcuggcgcagcaggucggccaggugaucgccaccgagccggggcagcucaacaccuggauccacgccaagaaccgcaucgggaagggccuguacaagaccgaggacacggacgaggacggcugccgggggcuggacuacggcgugagcugccucggguucgacuaccugcugcgcaccgacaucuaccccuucuucaacuccuucgugagccaccucuccaugcuggaggccagcaccgaggaccugaucgagaaggagggcaccagcugcgagaucgagacgaacaaggaguucaagugcuacgaggagcgggccuucaucaagggcuccugcccccaccucgugaacagcgcgcacuuccuggacaacaaggggaagcugcgcaucgucaagugcaagaccgacuucgagaugaccgaggacugcaccuucugccggaagaucaagaagaagaacucccagcacaagcaggucuucaagacgagcaucgcccuccaggacgccgugugccagaacaacuccgaccuguacaacggcccccgcaucguguacagcaacgugugcaagaucgggaugguguccuacaagcagugcaagagcaagaccuccagcuacgaguccgucggcuucgugauccugaaggggaagggcaaguucuacaucgagaacaugaagaucaagaacaucgaggugaucgccaacgucagcuucaucugccaccaguaccagggccaggacgggaccgagaaggagcagcgcucccucaagcggaucagcgugggcgagugcaaguccgucaacccgcagaagaccaagcacugcacgggggaccacguguucugcgagaaguacgacugcaccaagagcuaccccgaggugaccugccugauggcgcccggcuccgggcccauccugguccagaucaugggcagcuggaucaagccgcagugcgugggcuacgagaaggugcucgucgagcgcgaggugaagucccccacccugacggaggagcgggacugcgacacgugcguguacgagugccuggaggacaagauccucaucaagagcaccggguucaagaugaucagcgccgucgccugcucccacggcaugugcgugagcucccaccaggagcccagcaccuuccuguacaucaacuaccccgggauguccgccagcaucggcggggagaucggccugcaccugucccacaccgacgacagccucucccugcacaaggugaucagcugcccgucccgcaaccccugcgacguccacagcugcaucaucugcuaccacggcaucaucaacuaccagugccacaccgcccuguccuacaccaucguggcguucagcuucaucuccuuccucuaccugaccuucaaggugaucagccagcugcucuacacguucaaggucgugcccaagaagcugaaggggcccuucuacuggaugggcuaccugaucaaguggaucgugaagaccauccucggggucgugcggaacaccuucuucaccauguccaaccgcaucggcugggagcggcgcgacgagauccacgaggacaucgaggccaacccgcggcgccaccuccagcgguucaagaccacguucgugcugaccaugcugaugaucaacggcgggcugugcugcagcaacacccuggucagcaacuccaagcagacccgcugcgugcagagcggcaacgaggugaagugcuccgucagcgccacgguggugcucaaggccggggucaucggcgccgaguccugcuucaucaucaaggggcccagcgagaaccagcacaagaugaucuccgugcggacccugagcuccgagaccgugugccgcgagggcgcgagcuucuggaccggccacuucucccccagcugcgucuccagccggcgcugccaccuggugggggagugccacggcaaccggugccaguccuggcgcgacgaccagaucagccgggaguucgggggcgugaaggacaacaaccgcauguccgagaacaagugcuucgagcagugcgggagcaucggcugcggcugcuucaacaugaaccccuccugccucuacguccacacgacccugaaguccgcccgcaacgaggccgugcggguguucaagugcaacgacuggauccaccgccugaacuucgaggucaucgggccgagcggcgagaaggacguggugacccucaacuccaugagcaccaaguuccugcagugggggacgaucucccugagccucgacgccgagggcaucaccgggaccaacuccuacagcuuccuggaguccagcaagggcggcuucgccauccacgacgaggaguucuccgacaucccccgggagggguaccugggcgagauccgcugcagcuccgagagcgcggucaucuccgcccacagcuccugcauccgggcccccgaccucaucaaguacaagcccaugaccgaccagaucgagugcacgagcacccugaucgacccguucgccaucuucaugaaggggucccugccccagacccgcagcggcuacaccuucacguccagcaaggacaagaagaccauccaggccuucaacaccaacagcaucaaggcgcucaucucccugaaccuggacgaccacgagaucguguucgugagcgaccagaccaacugcgagugcacguuccucaaccugaccgggugcuacuccugcgacuacggcgcccacgucugcuuccggaucaagagcgacaagaagggcguguucguguccaacaccgaggccaaggacaucagcuucggguucgagguccugaccggcacgcacgacuacugccagauccagcacuucaacucccccagcguguacaagacccucuccuacagcugcgggggcgaguccaagcugcuggugaucaagggcagccucaucaccaucgggccgcacgacuaccgcaacaagaccggcggggccuccacggucgugaaccccagcgaggagggcugguccgugaccaacuggaucgggggcuucaucagcuggcugggcgggccccugaaggcgcuccugaagaucgccgucaccauccuggccggcguggucaucuuccucaucaucuacuucuuccugcggcugaucgccaccaacauccucaugaagacgaagaagaacuga

SEQ ID NO: 12730 - RNA, 3852 nt, Artificial Sequence
  derived and/or modified CDS sequence (opt1) from Buenaventura virus(CoAr3319)__KP272002.1__GP
auguacaagcugaucaccaacauccucaagcugagcaugguguccgccauguacagcaucauguucugggaccccaccggcaucuccaagcugugccucagcaacaacuccccgcuggaggggcuggucuacuacugggagaacacgaugcgcgagggcgaguucaagcgggagaagcgcaagaagugccggcucgggaucagcgagcccgcccccguguccaaccagaccaucgugagccugaucgaggagguccagaagucccccgcggagaugauccugaucugcgagaccagcggcaacgccaccggguccagccucuccuucgacggccugagcgacaacgaggugaagccguccaucguggacugcgccacgggcgagcgcaccagcgaccugcggguccucguggggaagggcaccuucgagaagaagauguccaugagcaacgagaucgaccgcguggucucccuggaggaccaccuccagcgggagcgcgagcucgugcagaccuuccaggaccugcaccacaacgagagcgagaagaacaagcugcucgagcacgagcuggagaacgugcggcagcagcugcgccgggagcgcgagagcaacaaggucaagguguggacgaccaagaagcccgaggugaccaccaucgggcucacgaccaccaucgccaccauccugcuggccucccagagcaucgcguccagcguccccaugcccggccagcucaacacguggccgcacgccaagaaccgggucgggggcggcguguucaaggccaacgacgacgacgaggacuccugcaagcugaucgacuacgggaucgccugccacggcuucgacuaccugcuccgcaccgacaucuaccccuucuucaacgcgcacgugagccaccgguccaugcuggaggccagcaacgaggggaucauccugaaggacgaggccuccugcgagaucgagaccaacaaggaccucaagugcuacgaggagcgcgccuuccugaaguggagcugcccccaccuggugaacuccgcccacuucaucgacagcaagggcaagcuccggaucaucaagugcaaggcggaguacgagaucaccgaggacugcacguacugccgccggaucaagaagaaggccgcccagcagaagcaggucuacaaguccagcaucgcccugcaggacgccgugugccaggagaacuccgacuacuacgacggcccccgcaucaccuucaccggggugugcaagaucggcagcauggaguacaagaagugcaagcacaaguccagcuccuucgagaacgugggguucaucaccauccgggacaagggcaaguacuacaucgagaacaugcgcaucaagaacaucgagauggucagcaacgugagcuucaucugcuacaaccacaacgggcaggacacggagaaggacauccgccugcucaagcgggucaagccguccgacugcaaggugguggacgacagcaaguccaagcacugcaccggcgaccacaucuucugcgacaaguacgacugcaccaagagcuaccccgaggcguccugcaugcacgcccccggcagcgggcccauccugguccuggugaugggcgugugguucaagccgcagugcgucggguacgagcgcgugcucguggagcgggaggucaaggugcccgugcugacccaggagaaggacugcgacacgugcgucuucgagugccaggaggacaagauccugaucaaguccaccggcuucaagaugaucagcgccguggccugcucccacgggagcugcguguccagccaccagucccccagcaccuuccucuacaucgacuaccccggccugaccgccuccgucggcggggagaucggccugcaccucagccacacggacgacuccaucagcgugcacaagaagauccacugcccggcgcgcgaccccugcgaggcccacaacugcgugaucugcuaccacgggcugaucaacuaccagugccacaccuuccugagcuacuccgucgugagcuuccucuucaucuccgugcuguaccugaccuucuucaucgucagccggcugcuccuguuccugaagaucaugcccaagcgccucaagaaccccaucuccuggcugacccugcucauccggugggugcugcagacgcugaucaccauccuccgccugagcuucaagaagcuguccgagaccaucggcuggaccaccaacgacaaccggcagcacguggacgucgaggccaaccgccggccgcuccgccgguaccgcacgaccuucauccugacccugcuguucaucgggcuggccagcggcugcuccaacaccgccgugagcaacuccaagcagacgaagugccugcagagcggcggguccgugaagugcagcaucaccgcgaccaucacccucaaggccggcaucaucggggccgaguccugcuucaucaucaagggccccagcgagaaccagcagcgggucauccgcgugaagacgaucuccagcgagaccgugugccgggagggcuccagcuucuggaccgggcuguucacccccagcugcgucuccagccgccggugccaccuggugggcgacugcguggggaaccgcugccaguccuggcgcgacgaggucgugagccgggaguucggcaacaugaaggacaacaacgccauguccgagaacaagugcuucgagcagugcggggcggccggcugcggcugcuucaacaucaaccccagcugccucuacgugcacuccgucuucaagagcgugcgccgggaggccauccgcguguucaagugcaacgacuggguccaccggcugacguucgagguguccgggccgagcggcgagaaggaccgcaucgugcugaacucccucagcaccaaguuccugcagugggggaccaucucccugagccucgacgccgagggcaucuccgggaccaacagcuacuccuuccuggagagcaacaagggcggcuucgccauccacgacgaggaguucuccgagaucccccgggagggguaccugggcgagauccgcugcagcagcgaguccgcggucaucgccgcccacaagagcugcauccgggcccccaaccucaucaaguacaagccgaugacggaccagaucgacugcaccgccucccugguggaccccuucgcgaucuuccugaaggggagccucccccagucccgcagcggcuacaccuucaccuccagcacggacaagaagaccgugcaggccuucaacuccggggccaucaaggcccugaucagcaucaaccuggacgaccacgagaucgaguuccucuccgacaccgccgacugcgacgcgaccuuccugaacaucagcggcugcuacuccugcaacuacggcgcccaggucugcaucaaggugcggagcuccaagagcuccaucuucagcuccaacaacaacgacaacagcaucgugaucaacuucgacgccgagcaggggacgcgcgacuacugccggaucauccacuucaacggcccccuggucgacgagacccuccacuacagcugcgggggcgaguccaagcugcugcagaugaaggggagccucaucaccgugggcccguacgacuuccgcaacaccacgggcgggaaguccaccguggucaacccccacgaggagagcuggaaccuguucuccugguucagcggccugcucgacuggcucgggggcccccugcgggccauccugaagaucgugcugaucgucaucaucggcaucauccuguucaucgugguggucuuccucaugcgccuggcgauccugaacgugcuccugaaguccaagaagaacuga

SEQ ID NO: 12731 - RNA, 3942 nt, Artificial Sequence
  derived and/or modified CDS sequence (opt1) from Cocle virus(GML244915)__KP272034.1__GP
augauguucacccaccuggacgugcucacccgcgccaugcuggucaugagcauguacucccugacgaccugggacagcauccggcgcaacgacaucugcuucuccaacgacagcccccucgagggccugguguacuacugggagacccaguccaagaugcacgaguacaagaaggaggacagccagaagugccgggugggggacuccgagaagaagaugaucagcaacgucaccaucaucucccugaucagcgagauccagaaguccaucagcgagcucucccugagcugcggcaacgacgacaacuccacgggccaggugcugauguucaacggccucgaggacaccauccgcggggacuacaucguggacugccugaccggccuguaccagagcgacaucggcgucggggugggcuccgggaagaccaagcacgaccacacgaagcuccggaacaaggccgugaucaucgacgagaaggagaagaugaucagccugcuggaggcgcagcaguccgagaacgacaucaagacccagguccucaugagcgagaucgagcagcugaagacccagcugcucaaccgccggagcgagcgcggccacgagaagcggaagaacgaggagaucguguccgaccugauggcccgcaacagcgaccugcggaagcacaacgacauccucaaggacgagauggaccagaucaaggagaaccugaccaucuucaagucccgcaacgccaucagcacgaccuccgugccggccaucaugagcaucgcccugcucuccagcuccgucaugcccaucaucgcggccgugagcgacucccccaugaucaaccccuggccgcacgccaagaaccggguggggagcggcauguacaaguacgacgacaacgacgaguccggcugccgccccauccgguacggggucagcugcaucggcuucgaccacaugcugaagauggacaaguaccccuucuucaacgccuucaucgggcacaagacccugcucgaguccuucguggacaagaucaucgagaaggaggacgagaccugcgagaucggcacgaacaaggaguucaagugcuucgaggagcgcgcguacaucaaggggaccugcccccacaacaucaacgccgugcacuaccuggacaacaaggggaagcugcgguacgucaagugcaaggagaaccucgagaugaccgaggacugcgccuucugccgcaagaucaagaagaaggccggccagagcguccaggugcagaagaccuccgugccgcugcaggacgccaucugccaggacaacagcgacaucuacacggggccccggauccccuacaagggcaugugcaagaucgggcuggugaaguacaaggagugcaaguccaagaccagcagcuacgagaccguguccuucaucacccucaagggcaagggcaagaucuacaucgagcaccugaugcugaagaacaucgaggucgugacgaacgucagcuucgugugcuacgagcacgcgggccagguggagcaggaggucgagcaccgcgcccucaagcggguguccgugaacgacugcaagaucgucgacagcuccaagcagaagaucugcaccggggaccacguguucugcgagaaguacgacugcagcaccuccuaccccgacgugaccugcauccaggccccggggagcggcccccuguacgucaaccugaugggguccuggaucaagccccagugcgugggcuacgagcgcgugcucgucgagcgcgaggugaagcagccccugcugacgccggagcagaacugcgacacgugcgugagcgagugccucgacgagggcguccacaucaaguccaccggguucgagaucaccagcgccguggccugcucccacggcagcugcaucuccgcgcaccaggaggccagcaccuccaucaucgugcccuaccccgggcugcuggccagcgucggcgggaagaucggccuccaccugagccacaccuccgacagcgccuccgugcacaugaucguggucugcccgccccgggacagcugcgccgcgcacaacugccugcucugcuaccacggcaugcugaacuaccagugccacuccacccugagcgccauccugaccuccuuccuccugauccuguucaucuacacgaccuucagcuucaucaccaacauccucuaccugcugcgccuccugcccaagcagcugaagucccccaucggguggcucaagcuguucaucaacuggcuguucaccauccuccggauccgcaccaaguaccugaugggccggcugaaccagcgcaucggguggguggagaaccacgacguggagcggccccgcccgcgggagcccaugcgccgguucaagacgacccucaugcugaccaugcugaugaucaccggcggcuacgccugcagcaacacggucguggccaacuccaagcagacccgcugcgugcaggaggggagcaacaccaagugcuccgucaccgccacggugacccucaaggcgggcgugaucggggccgagagcugcuucgucaucaagggccccauggagaaccagcagaagaccaucuccaucaagaccgugagcuccgagacggugugccgggaggggagcuccuucuggaccagccuguacauccccagcugccuguccagccgccggugccaccucgucggcgacugcgugggcaaccgcugccaguccuggcgggaggaccagcugagccgcgaguucuccggggugaaggacaaccagaucaugaacgagaacaagugcuucgagcagugcggcgccaucgggugcggcugcuucaacaucaacccgagcugccuguacguccacgccuaccucaaguccgcgcggaacgaggccgugcgcguguucagcugcuccgacuggguccaccgcgugagcuucgaggugaaggggcccgacggcgagaccgagcuggucacccugggcucccucgggacgaaguuccugaacuggggcacccugagccucucccuggacgccgaggggaucaccggcaccaacagccuguccuuccucgagagcuccaagggcggguucgcccuguacgacgagggcuucagcgagaucccccgggagggguuccugggcgagauccgcugcuccagcgagagcgccgcgaucuccgcccacaagagcugcauccgggccccggggcucaucaaguacaagcccaugacggaccagaucgagugcaccgccucccugguggaccccuucgccaucuuccugaagggcagccucccccagacccgcaacgggcagaccuucacguccaccaaggacaagaagaccgugcaggcguucaccacgggcgccauccgggcccugcugagcaucaaccucgacgaccacgagaucaccuucaucuccaagaucaagaacugcgaggccaccuuccugaacgucagcggcugcuacuccugcgacuacggggcccacgugugcaucaagaucaagagcuccgagagcgcggacuucuacgccgaguccgaggacaagaccacggugcugagccucccggucuccagcggcacccaggacuacugccaggugcugcacuuccagaagccccugguggacgagcgccucuccuacagcugcggguccgagcccaagcugauggucaucaagggcacccugguguacaugggcgucuacgacuuccggaacaagaccgggggcagcagcacgguggugaaccccuccgacgccagcugguccaucgccaacugguucagcgggcuccuggacuggcugggcgggccgcucaaggcgauccugaagauccugggcuucaucgccaugggcgucgugugcuucauccucuucaugauccugaucaagaucgccgugcgcuccgucaacaugaagaagaagaacuga

SEQ ID NO: 12732 - RNA, 3873 nt, Artificial Sequence
  derived and/or modified CDS sequence (opt1) from Campana virus(VP-334K)__KP272041.1__GP
augcugcacuucaucaccaucaccacgaaguuccucgccguggccagcauguacaaccugcuguacugggaccccaacggccucucccgccugugccugagcaacaacuccccgcucgaggggcuggucuacuacugggagaaccugaugaaggagagcgacuucaagaaggacaagaagaagcacugccggaucggcaccuccguggcggcccccgugaccaacgagacccucacgacccugaucgaggagguccagaagucccccagcgagaucauccugcagugcgagagccgcaacaacgacaccgggaacuccaucuacuucgacggccucgccgacgacaucgagagccccuccaucgugaacugcgagagcgggaagcgggaguccgaccugcgcgugcuggucggccagggccucaagaaggagaucauccugaacgagaucgccgccaucgaccggcaggcgagccuggaggagcaccuccgcggggagaaggcccugaccucccugcuccaggagaucagcaagcaggacgaggccgagcggaagcgccuggagcacgagguguccagccugcggcagcagcucaugaacgagcgcgaggagaacaagaagcggaagaacaucccggccuucggcguguccagcacgaccagcuccagccugaugaacaucucccgcgucgugaccaucgggcugcucagccagcaggcgaucgccaaccccucccugcccggccaggugaacaccuggccccacgccaagaaccggaucgggcagggccuguaccgcaucgacacgagcgacgaggacggcugccgggggcucaacuacggcgucaucugccugggguucgaccaccuccugcgcauggaccuguacccguucuucaacgccuacgugucccaccugagccuccuggaggccuacaccgagaacaucauccagaaggacgagaccgagugcgagaucgagggcggcaaggaguucaagugcuacgaggagcgggcguacaucaagggggugugcccccaccgcaucaaguccgcccacuaccuggaccagaagggcaagcuccggaucaucaagugcaaggagaaccuggagcugaccgaggacugcacguacugccgcaagaucaagaaggaccgggggcacaccaagcaggucuacaagaccagcgugccccuccaggacgccaucugccaggacaacuccgacgacuacagcggccccaagaucuccuucaagggggugugcaagaucggcaugaucgaguacaaggagugcaaguacaagagcuccagcuucgagaccgucggcuucaucacgaucaaggagaaggggaaguucuacaucgaggacaugaagcugaagaaccuggaggugaccaacaacguggccuucaucugccaccaguacaccggccaggacgggaccacggacgaggagaaccgccaccucaagcgcauguccgucaaggacugcaagaacgugaacagcuccaagagcaaguacugcaccggcgaccacaucuucugccagguguacgacugcaccaagagcuacccggaggcgaccugcuucgucgcccccggguccggccccgugcugguccaggugaugggcagcuggaucaagccccagugcgugggguacgagaagguccugguggagcgggaggugaagaugccgauccucacggaggagcgcgacugcgacacgugcgucuacgagugcaaggaggaccacauccugaucaaguccaccggcuucaacaugaucagcgccguggccugcucccacgggagcugcguguccgcccaccaggaccccagcaccuuccugaacaucgaguaccccggcauguccgccagcgucgggggcgagaucggcauccacaucucccacaccgacgacagccugucccuccacaagaagaucuacugccccgcgcgggacagcugcgaggcccacaacugcaucaugugcuaccacgggcugaucaacuaccagugccacaccgcccuguccuacgccguggugagcuucauguucgucuccaucgccuacgugaucuucaacgugcuccgccugguccugguggcgcuccacguggucccgcggaagcucaagagccccaucgacuggcugauccugcugaucaaguggguguuccugcuccuggccaaggugauccgcgccuuccugacccaccucaacaccacgaucggcuggcgggagcgccagaacaacuucgccgcggaccuggaggcccagcggcgcccccugcagcgguucaagaccaccguccuccugaugaugaugcugaucagcgugguguccagcugcuccaacagcgucguguccaacagcaagcagacccgcugcauccaguccgggagcaacaccaagugcuccgugagcgccacgaucacccucaaggccggcgucaucggcgccgaguccugcuucgugaucaaggggcccagcgagaaccagcacaagaccaucgugauccggaccgucuccagcgagacgaucugccgcgagggcuccagcuucuggaccgggcacuucaccccguccugccugagcucccggcgcugccaccuggugggcgacugcguggggagccggugccagggcuggcgcgaggacgucaucagccgggaguucggcggggugaaggacaacaaccagauguccgagaacaagugcuucgagcagugcggcgcggccgggugcggcugcuucaacaucaaccccagcugccucuacgugcacaccauccugcgcuccgcccgcaacgaggccguccggguguucaagugcaacgacugggugcacaagcugacguuccacaucaaggggcccaacggcgaggaggaggacgucgugcucaacagccuguccaccaaguuccugagcuggggcaccaucucccucagccuggacuccgaggggaucaccggcacgaacagcuacuccuuccuggagagcuccaagggcggguucgccauccacgacgaggaguucagcgagaucccccgcgagggguuccucggcgagauccggugcuccagcgaguccgcgguggucagcgcccacaaguccugcauccgcgccccgggccugaucaaguacaagcccaugaccgaccagguggagugcagcgccagccugguggaccccuucgccaucuucaucaaggggucccucccgcagacccggagcggcuacaccuucacguccagccgcgacaagcggaccauccaggcguucaacaacggggccaucaaggcccugcugacccucaaccuggacgaccacgaggucaucuucuccgagagcgugaucacgugcgagugcaccuuccugaacaucuccggcugcuacagcugcaacuucggggcccaggugugcuucaagaucaaguccagcggcaucggcgacuucgucuccagcuccgagaccgggaacauccucuucagcuuccccgugaaguccggcaccgaggacuacugccagauccagcacuucaacagccccaugguguccgagagccugcaguacuccugcgggggcgagagcaagcugcuccugaucaagggcagccugaucuccgucgggcccuacgacuaccgcaacaagaccggcgggagcuccacgguggucaacccggcggaggacagcugguccaucuucaacuggcucagcggcuuccuggacuggcucgggggcccccugcgggcccuggugaagaucgcccuggccaucaucggcgcccucgcgcugcuguucaucaccaucaugcucgcccgcuccgugaucagcaacacccugucccggaagaagaagaacuga

SEQ ID NO: 12733 - RNA, 3594 nt, Artificial Sequence
  derived and/or modified CDS sequence (opt1) from RVFV(ZH-548)__DQ380206.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggcgugcagcuccuucgacguccugcuggagaagggcaaguucccccuguuccagagcuacgcccaccaccggacccugcucgaggccgugcacgacaccaucaucgccaaggccgacccgcccuccugcgaccugcugagcgcgcacggcaaccccugcaugaaggagaagcucgugaugaagacccacugccccaacgacuaccaguccgcccacuaccugaacaacgacgggaagauggccagcgucaagugcccgcccaaguacgagcugacggaggacugcaacuucugccgccagaugaccggcgccucccucaagaaggggagcuacccccugcaggaccuguucugccagagcuccgaggacgacggcagcaagcucaagaccaagaugaagggcgugugcgagguggggguccaggcccugaagaagugcgacggccagcuguccaccgcgcacgagguggugcccuucgccgucuucaagaacagcaagaagguguaccucgacaagcuggaccugaagacggaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcucugcgugggcuacgagcgcguggucgugaagcgggagcugagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccucaaguaccccggcaucucccagagcuccgggggcgacaucggcgugcacauggcccacgacgaccagagcgucuccagcaagaucguggcgcacugcccgccccaggaccccugccuggugcacgacugcaucgucugcgcccacgggcugaucaacuaccagugccacacggcccucuccgccuucgugguggucuucguguucagcuccaucgccaucaucugccuggcgauccuguaccgcgugcucaagugccugaagaucgcgccccggaagguccugaacccccucauguggaucaccgccuucauccgcuggaucuacaagaagaugguggcccgcguggccgacaacaucaaccaggucaaccgggagaucggcuggauggagggcgggcagcuggugcugggcaacccggcccccaucccccgccacgcccccaucccgcgguacagcaccuaccugaugcuccugcugaucguguccuacgccagcgccugcuccgagcucauccaggcgagcucccgcaucaccacgugcagcaccgagggggucaacaccaagugccggcuguccggcaccgcccugauccgcgccgggagcgugggcgccgaggccugccucaugcugaagggggugaaggaggaccagacgaaguuccugaagaucaagaccgucagcuccgagcucagcugccgggagggccaguccuacuggaccggcagcuucucccccaagugccugagcucccgccggugccaccuggugggggagugccacgugaaccgcugccucagcuggcgggacaacgagaccuccgcggaguucagcuucgucggcgaguccaccacgaugcgcgagaacaagugcuucgagcagugcgggggcugggggugcggcugcuucaacgugaaccccagcugccuguucgugcacaccuaccugcaguccguccggaaggaggcccuccgcguguucaacugcaucgacugggugcacaagcugacccuggagaucaccgacuucgacggcagcgucuccacgaucgaccucggggccagcuccagccgguucaccaacuggggcuccgugagccugagccuggacgccgaggggaucuccggcagcaacuccuucagcuucaucgagucccccgggaagggcuacgccaucguggacgagccguucagcgagaucccccgccagggcuuccucggggagauccggugcaacuccgagagcuccguccugagcgcgcacgaguccugccugcgcgcccccaaccucaucagcuacaagcccaugaucgaccagcuggagugcaccaccaaccugaucgacccguucgugguguucgagcggggcucccucccccagacgcgcaacgacaagaccuucgccgccagcaaggggaaccgcggcguccaggccuucuccaaggggagcgugcaggcggaccugacccugauguucgacaacuucgagguggacuucgucggcgccgccguguccugcgacgccgcguuccucaaccugaccggcugcuacagcugcaacgccggggcccgggugugccuguccaucacgagcaccggcaccgggagccucuccgcccacaacaaggacggcagccugcacaucguccugcccuccgagaacggcaccaaggaccagugccagauccuccacuucacggugcccgaggucgaggaggaguucauguacagcugcgacggggacgagcgcccgcugcuggugaagggcacccucaucgccaucgaccccuucgacgaccggcgcgaggccgggggcgaguccaccguggucaaccccaagagcggguccuggaacuucuucgacugguucagcggccugauguccugguucggcgggccccugaagaccauccuccugaucugccuguacguggcccucagcaucggccuguucuuccugcucaucuaccuggggcggacgggccuguccaagauguggcucgccgccaccaagaaggccagcuga

SEQ ID NO: 12734 - RNA, 3594 nt, Artificial Sequence
  derived and/or modified CDS sequence (opt1) from RVFV(ZS-6365)__DQ380205.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcugugcgugggcuacgagcgcguggucgugaagcgggagcucagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccugaaguaccccggcaucucccagagcuccgggggcgacaucggcgugcacauggcccacgacgaccagagcgucuccagcaagaucguggcgcacugcccgccccaggaccccugccucgugcacgggugcaucgucugcgcccacggccugaucaacuaccagugccacacggcccuguccgccuucgugguggucuucguguucagcuccaucgccaucaucugccucgcgauccuguaccgcgugcugaagugccucaagaucgcgccccggaagguccugaacccccugauguggaucaccgccuucauccgcuggaucuacaagaagaugguggcccgcguggccgacaacaucaaccaggucaaccgggagaucggguggauggagggcggccagcucgugcuggggaacccggcccccaucccccgccacgcccccaucccgcgguacagcaccuaccugaugcugcuccugaucguguccuacgccagcgccugcuccgagcugauccaggcgagcucccgcaucaccacgugcagcaccgagggcgucaacaccaagugccggcucuccgggaccgcccugauccgcgccggcagcgugggggccgaggccugccugaugcucaagggcgugaaggaggaccagacgaaguuccugaagaucaagaccgucagcuccgagcugagcugccgggagggccaguccuacuggaccgggagcuucucccccaagugccucagcucccgccggugccaccuggugggcgagugccacgugaaccgcugccugagcuggcgggacaacgagaccuccgcggaguucagcuucgucggggaguccaccacgaugcgcgagaacaagugcuucgagcagugcggcggguggggcugcggcugcuucaacgugaaccccagcugccucuucgugcacaccuaccugcaguccguccggaaggaggcccugcgcguguucaacugcaucgacugggugcacaagcucacccuggagaucaccgacuucgacgggagcgucuccacgaucgaccugggcgccagcuccagccgguucaccaacuggggguccgugagccucagccuggacgccgagggcaucuccgggagcaacuccuucagcuucaucgagucccccggcaagggcuacgccaucguggacgagccguucagcgagaucccccgccagggguuccugggcgagauccggugcaacuccgagagcuccguccucagcgcgcacgaguccugccugcgcgcccccaaccugaucagcuacaagcccaugaucgaccagcucgagugcaccaccaaccugaucgacccguucgugguguucgagcgggggucccugccccagacgcgcaacgacaagaccuucgccgccagcaagggcaaccgcgggguccaggccuucuccaagggcagcgugcaggcggaccucacccugauguucgacaacuucgagguggacuucgucggcgccgccguguccugcgacgccgcguuccugaaccucaccgggugcuacagcugcaacgccggcgcccgggugugccuguccaucacgagcaccgggaccggcagccuguccgcccacaacaaggacggcagccuccacaucguccugcccuccgagaacgggaccaaggaccagugccagauccugcacuucacggugcccgaggucgaggaggaguucauguacagcugcgacggcgacgagcgcccgcuccuggugaaggggacccugaucgccaucgaccccuucgacgaccggcgcgaggcgggcggggaguccaccguggucaaccccaagagcggcuccuggaacuucuucgacugguucagcggccucauguccugguucgggggcccccugaagaccauccugcucaucugccuguacguggcccugagcaucgggcuguucuuccugcugaucuaccucggccggacggggcuguccaagauguggcuggccgccaccaagaaggccagcuga

SEQ ID NO: 12735 - RNA, 3594 nt, Artificial Sequence
  derived and/or modified CDS sequence (opt1) from RVFV(CAR-R1622)__DQ380219.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcugugcgugggcuacgagcgcguggucgugaagcgggagcucagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccugaaguaccccggcaucucccagagcuccgggggcgacaucggcgugcacauggcccacgacgaccagagcgucuccagcaagaucguggcgcacugcccgccccaggaccccugccucgugcacgggugcaucgucugcgcccacggccugaucaacuaccagugccacacggcccuguccgccuucgugguggucuucguguucagcuccaucgccaucaucugccucgcgauccuguaccgcgugcugaagugccucaagaucgcgccccggaagguccugaacccccugauguggaucaccgccuucauccgcuggguguacaagaagaugguggcccgcgucgccgacaacaucaaccaggugaaccgggagaucggguggauggagggcggccagcucgugcuggggaacccggcccccaucccccgccacgcccccaucccgcgguacagcaccuaccugaugcugcuccugaucgucuccuacgccagcgccugcuccgagcugauccaggcgagcucccgcaucaccacgugcagcaccgagggcgugaacaccaagugccggcucuccgggaccgcccugauccgcgccggcagcgugggggccgaggccugccugaugcucaagggcgucaaggaggaccagacgaaguuccugaagaucaagaccgugagcuccgagcugagcugccgggagggccaguccuacuggaccgggagcuucucccccaagugccucagcucccgccggugccaccuggugggcgagugccacgucaaccgcugccugagcuggcgggacaacgagaccuccgcggaguucagcuucgugggggaguccaccacgaugcgcgagaacaagugcuucgagcagugcggcggguggggcugcggcugcuucaacgugaaccccagcugccucuucguccacaccuaccugcaguccgugcggaaggaggcccugcgcguguucaacugcaucgacuggguccacaagcucacccuggagaucaccgacuucgacgggagcguguccacgaucgaccugggcgccagcuccagccgguucaccaacuggggguccgugagccucagccuggacgccgagggcaucuccgggagcaacuccuucagcuucaucgagucccccggcaagggcuacgccaucgucgacgagccguucagcgagaucccccgccagggguuccugggcgagauccggugcaacuccgagagcuccgugcucagcgcgcacgaguccugccugcgcgcccccaaccugaucagcuacaagcccaugaucgaccagcucgagugcaccaccaaccugaucgacccguucguggucuucgagcgggggucccugccccagacgcgcaacgacaagaccuucgccgccagcaagggcaaccgcggggugcaggccuucuccaagggcagcgugcaggcggaccucacccugauguucgacaacuucgaggucgacuucgugggcgccgccguguccugcgacgccgcguuccugaaccucaccgggugcuacagcugcaacgccggcgcccgggucugccuguccaucacgagcaccgggaccggcacccugagcgcccacaacaaggacggcucccuccacaucgugcugcccagcgagaacgggacgaaggaccagugccagauccugcacuucaccguccccgagguggaggaggaguucauguacuccugcgacggcgacgagcgcccgcuccuggugaaggggacccugaucgccaucgaccccuucgacgaccggcgcgaggcgggcggggagagcaccgucgugaaccccaaguccggcagcuggaacuucuucgacugguucuccggccucaugagcugguucgggggcccccugaagacgauccugcucaucugccuguacguggcccuguccaucgggcuguucuuccugcugaucuaccucggccggaccgggcugagcaagauguggcuggccgccaccaagaaggccuccuga

SEQ ID NO: 12736 - RNA, 3594 nt, Artificial Sequence
  derived and/or modified CDS sequence (opt1) from RVFV(2250/74)__DQ380209.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcugugcgugggcuacgagcgcguggucgugaagcgggagcucagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccugaaguaccccggcaucucccagagcuccgggggcgacaucggcgugcacauggcccacgacgaccagagcgucuccagcaagaucguggcgcacugcccgccccaggaccccugccucgugcacgggugcaucgucugcgcccacggccugaucaacuaccagugccacacggcccuguccgccuucgugguggucuucguguucagcuccaucgccaucaucugccucgcgauccuguaccgcgugcugaagugccucaagaucgcgccccggaagguccugaacccccugauguggaucaccgccuucauccgcuggaucuacaagaagaugguggcccgcguggccgacaacaucaaccaggucaaccgggagaucggguggauggagggcggccagcucgugcuggggaacccggcccccaucccccgccacgcccccaucccgcgguacagcaccuaccugaugcugcuccugaucguguccuacgccagcgccugcuccgagcugauccaggcgagcucccgcaucaccacgugcagcaccgagggcgucaacaccaagugccggcucuccgggaccgcccugauccgcgccggcagcgugggggccgaggccugccugaugcucaagggcgugaaggaggaccagacgaaguuccugaagaucaagaccgucagcuccgagcugagcugccgggagggccaguccuacuggaccgggagcuucucccccaagugccucagcucccgccggugccaccuggugggcgagugccacgugaaccgcugccugagcuggcgggacaacgagaccuccgcggaguucagcuucgucggggaguccaccacgaugcgcgagaacaagugcuucgagcagugcggcggguggggcugcggcugcuucaacgugaaccccagcugccucuucgugcacaccuaccugcaguccguccggaaggaggcccugcgcguguucaacugcaucgacugggugcacaagcucacccuggagaucaccgacuucgacgggagcgucuccacgaucgaccugggcgccagcuccagccgguucaccaacuggggguccgugagccucagccuggacgccgagggcaucuccgggagcaacuccuucagcuucaucgagucccccggcaagggcuacgccaucguggacgagccguucagcgagaucccccgccagggguuccugggcgagauccggugcaacuccgagagcuccguccucagcgcgcacgaguccugccugcgcgcccccaaccugaucagcuacaagcccaugaucgaccagcucgagugcaccaccaaccugaucgacccguucgugguguucgagcgggggucccugccccagacgcgcaacgacaagaccuucgccgccagcaagggcaaccgcgggguccaggccuucuccaagggcagcgugcaggcggaccucacccugauguucgacaacuucgagguggacuucgucggcgccgccguguccugcgacgccgcguuccugaaccucaccgggugcuacagcugcaacgccggcgccaaggugugccuguccaucacgagcaccgggaccggcagccuguccgcccacaacaaggacggcagccuccacaucguccugcccuccgagaacgggaccaaggaccagugccagauccugcacuucacggugcccgaggucgaggaggaguucauguacagcugcgacggcgacgagcggccgcuccuggugaaggggacccugaucgccaucgaccccuucgacgaccgccgggaggcgggcggggaguccaccguggucaaccccaagagcggcuccuggaacuucuucgacugguucagcggccucauguccugguucgggggcccccugaagaccauccugcucaucugccuguacguggcccugagcaucgggcuguucuuccugcugaucuaccucggccgcacggggcuguccaagauguggcuggccgccaccaagaaggccagcuga

SEQ ID NO: 12737 - RNA, 3594 nt, Artificial Sequence
  derived and/or modified CDS sequence (opt1) from RVFV(T1)__DQ380201.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcugugcgugggcuacgagcgcguggucgugaagcgggagcucagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccugaaguaccccggcaucucccagagcuccgggggcgacaucggcgugcacauggcccacgacgaccagagcgucuccagcaagaucguggcgcacugcccgccccaggaccccugccucgugcacgggugcaucgucugcgcccacggccugaucaacuaccagugccacacggcccuguccgccuucgugguggucuucguguucagcuccaucgccaucaucugccucgcggugcuguaccgcguccugaagugccucaagaucgcgccccggaaggugcugaacccccugauguggaucaccgccuucauccgcuggaucuacaagaagaugguggcccgcgucgccgacaacaucaaccaggugaaccgggagaucggguggauggagggcggccagcucgugcuggggaacccggcccccaucccccgccacgcccccaucccgcgguacagcaccuaccugaugcugcuccugaucgucuccuacgccagcgccugcuccgagcugauccaggcgagcucccgcaucaccacgugcagcaccgagggcgugaacaccaagugccggcucuccgggaccgcccugauccgcgccggcagcgugggggccgaggccugccugaugcucaagggcgucaaggaggaccagacgaaguuccugaagaucaagaccgugagcuccgagcugagcugccgggagggccaguccuacuggaccgggagcuucucccccaagugccucagcucccgccggugccaccuggugggcgagugccacgucaaccgcugccugagcuggcgggacaacgagaccuccgcggaguucagcuucgugggggaguccaccacgaugcgcgagaacaagugcuucgagcagugcggcggguggggcugcggcugcuucaacgugaaccccagcugccucuucguccacaccuaccugcaguccgugcggaaggaggcccugcgcguguucaacugcaucgacuggguccacaagcucacccuggagaucaccgacuucgacgggagcguguccacgaucgaccugggcgccagcuccagccgguucaccaacuggggguccgugagccucagccuggacgccgagggcaucuccgggagcaacuccuucagcuucaucgagucccccggcaagggcuacgccaucgucgacgagccguucagcgagaucccccgccagggguuccugggcgagauccggugcaacuccgagagcuccgugcucagcgcgcacgaguccugccugcgcgcccccaaccugaucagcuacaagcccaugaucgaccagcucgagugcaccaccaaccugaucgacccguucguggucuucgagcgggggucccugccccagacgcgcaacgacaagaccuucgccgccagcaagggcaaccgcggggugcaggccuucuccaagggcagcgugcaggcggaccucacccugauguucgacaacuucgaggucgacuucgugggcgccgccguguccugcgacgccgcguuccugaaccucaccgggugcuacagcugcaacgccggcgcccgggucugccuguccaucacgagcaccgggaccggcagccuguccgcccacaacaaggacggcagccuccacaucgugcugcccuccgagaacgggaccaaggaccagugccagauccugcacuucacgguccccgagguggaggaggaguucauguacagcugcgacggcgacgagcgcccgcuccuggugaaggggacccugaucgccaucgaccccuucgacgaccggcgcgaggcgggcggggaguccaccgucgugaaccccaagagcggcuccuggaacuucuucgacugguucagcggccucauguccugguucgggggcccccugaagaccauccugcucaucugccuguacguggcccugagcaucgggcuguucuuccugcugaucuaccucggccggacggggcuguccaagauguggcuggccgccaccaagaaggccagcuga

SEQ ID NO: 12738 - RNA, 3594 nt, Artificial Sequence
  derived and/or modified CDS sequence (opt1) from RVFV(1853/78)__DQ380220.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcgucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucguguucguguucagcuccaucgccaucaucugccucgcgauccuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggguggauggagggcggccagcucguccuggggaacccggcccccaucccccgccacgcccccaucccgcgguacagcaccuaccugaugcugcuccugaucguguccuacgccagcgccugcuccgagcugauccaggcgagcucccgcaucaccacgugcagcaccgagggcgugaacaccaagugccggcucuccgggaccgcccugauccgcgccggcagcgucggggccgaggccugccugaugcucaagggcgugaaggaggaccagacgaaguuccugaagaucaagaccgugagcuccgagcugagcugccgggagggccaguccuacuggaccgggagcuucucccccaagugccucagcucccgccggugccaccuggucggcgagugccacgugaaccgcugccugagcuggcgggacaacgagaccuccgcggaguucagcuucgugggggaguccaccacgaugcgcgagaacaagugcuucgagcagugcggcggguggggcugcggcugcuucaacgucaaccccagcugccucuucgugcacaccuaccugcaguccgugcggaaggaggcccugcgcgucuucaacugcaucgacugggugcacaagcucacccuggagaucaccgacuucgacgggagcguguccacgaucgaccugggcgccagcuccagccgguucaccaacuggggguccgucagccucagccuggacgccgagggcaucuccgggagcaacuccuucagcuucaucgagucccccggcaagggcuacgccaucguggacgagccguucagcgagaucccccgccagggguuccugggcgagauccggugcaacuccgagagcuccgugcucagcgcgcacgaguccugccugcgcgcccccaaccugaucagcuacaagcccaugaucgaccagcucgagugcaccaccaaccugaucgacccguucgucguguucgagcgggggucccugccccagacgcgcaacgacaagaccuucgccgccagcaagggcaaccgcggggugcaggccuucuccaagggcagcguccaggcggaccucacccugauguucgacaacuucgagguggacuucgugggcgccgccgucuccugcgacgccgcguuccugaaccucaccgggugcuacagcugcaacgccggcgcccgggugugccuguccaucacgagcaccgggaccggcacccugagcgcccacaacaaggacggcucccuccacaucguccugcccagcgagaacgggacgaaggaccagugccagauccugcacuucaccgugcccgagguggaggaggaguucauguacuccugcgacggcgacgagcgcccgcuccuggucaaggggacccugaucgccaucgaccccuucgacgaccggcgcgaggcgggcggggagagcaccguggugaaccccaaguccggcagcuggaacuucuucgacugguucuccggccucaugagcugguucgggggcccccugaagacgauccugcucaucugccuguacgucgcccuguccaucgggcuguucuuccugcugaucuaccucggccggaccgggcugagcaagauguggcuggccgccaccaagaaggccuccuga

SEQ ID NO: 12739 - RNA, 3594 nt, Artificial Sequence
  derived and/or modified CDS sequence (opt1) from RVFV(MP-12)__DQ380208.1__GP
auguacgugcugcucaccauccugaccagcguccuggugugcgaggccaucauccgcgugucccucagcuccacgcgggaggagaccugcuucggcgacagcaccaaccccgagaugaucgagggggccugggacucccugcgcgaggaggagaugccggaggagcugagcugcuccaucagcggcauccgggaggucaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucgugcgcugcgagcggcgccgggacgccaagcagaucggccgcgagaccauggcggggaucgccaugaccguccugcccgcccuggccguguucgcgcucgcccccguggucuucgccgaggacccccaccuccggaaccgccccggcaaggggcacaacuacaucgacggcaugacccaggaggacgccacgugcaagccggugaccuacgccggggcgugcagcuccuucgacgugcugcuggagaagggcaaguucccccuguuccagagcuacgcccaccaccggacccugcucgaggccguccacgacaccaucaucgccaaggccgacccgcccuccugcgaccugcugagcgcgcacggcaaccccugcaugaaggagaagcucgugaugaagacgcacugccccaacgacuaccaguccgcccaccaccugaacaacgacgggaagauggccagcgugaagugcccgcccaaguacgagcugaccgaggacugcaacuucugccgccagaugaccggcgccucccucaagaaggggagcuacccccugcaggaccuguucugccagagcuccgaggacgacggcagcaagcucaagaccaagaugaagggcgucugcgaggugggggugcaggcccugaagaagugcgacggccagcuguccacggcgcacgaggucgugcccuucgccguguucaagaacagcaagaaggucuaccucgacaagcuggaccugaagaccgaggagaaccuccugcccgacuccuucgugugcuucgagcacaaggggcaguacaagggcaccauggacagcgggcagaccaagcgggagcugaaguccuucgacaucagccagugccccaagaucggcggccacggguccaagaagugcacgggcgacgccgccuucugcagcgccuacgagugcaccgcgcaguacgccaacgccuacugcucccacgccaacgggagcggcaucgugcagauccaggucuccgggguguggaagaagccgcucugcgucggcuacgagcgcgugguggucaagcgggagcugagcgcgaagcccauccagcgcguggagcccugcacgaccugcaucaccaagugcgagccccacggccuggugguccgguccaccggguucaagaucagcuccgccguggccugcgccagcggcgugugcgucaccgggucccagagcccgagcaccgagaucacgcucaaguaccccggcaucucccagagcuccgggggcgacaucggcgugcacauggcccacgacgaccagagcguguccagcaagaucgucgcgcacugcccgccccaggaccccugccuggugcacgacugcaucgugugcgcccacgggcugaucaacuaccagugccacaccgcccucuccgccuucgucgugguguucgucuucagcuccaucgccaucaucugccuggcgauccuguaccgcgugcucaagugccugaagaucgcgccccggaaggugcugaacccccucauguggaucaccgccuucauccgcuggaucuacaagaagauggucgcccgcguggccgacaacaucaaccaggugaaccgggagaucggcuggauggagggcgggcagcugguccugggcaacccggcgcccaucccccgccacgcccccaucccgcgguacagcaccuaccugaugcuccugcugaucguguccuacgccagcgccugcuccgagcucauccaggcgagcucccgcaucacgaccugcagcaccgagggggugaacaccaagugccggcuguccggcacggcccugauccgcgccgggagcgucggcgccgaggccugccucaugcugaagggggugaaggaggaccagaccaaguuccugaagcucaagaccgugagcuccgagcugagcugccgggagggccaguccuacuggaccggcagcuucucccccaagugccugagcucccgccggugccaccucgucggggagugccacgugaaccgcugccugagcuggcgggacaacgagaccuccgcggaguucagcuucgugggcgaguccacgaccaugcgcgagaacaagugcuucgagcagugcgggggcugggggugcggcugcuucaacgucaaccccagcugccuguucgugcacaccuaccuccaguccgugcggaaggaggcccugcgcgucuucaacugcaucgacugggugcacaagcugacccucgagaucacggacuucgacggcagcguguccaccaucgaccugggggccagcuccagccgguucaccaacuggggcuccgucagccugagccucgacgccgaggggaucuccggcagcaacuccuucagcuucaucgagucccccgggaagggcuacgccaucguggacgagccguucagcgagaucccccgccagggcuuccugggggagauccggugcaacuccgagagcuccgugcugagcgcgcacgaguccugccuccgcgcccccaaccugaucagcuacaagcccaugaucgaccagcuggagugcaccacgaaccucaucgacccguucgucguguucgagcggggcucccugccccagacccgcaacgacaagaccuucgccgccagcaaggggaaccgcggcgugcaggccuucuccaaggggagcguccaggcggaccugacccucauguucgacaacuucgagguggacuucgugggcgccgccgucuccugcgacgccgcguuccugaaccugacgggcugcuacagcugcaacgccggggcccgggugugccucuccaucaccagcaccggcaccgggagccuguccgcccacaacaaggacggcagccugcacaucgugcuccccuccgagaacggcacgaaggaccagugccagauccugcacuucaccguccccgagguggaggaggaguucauguacagcugcgacggggacgagcgcccgcugcucgucaagggcacccugaucgccaucgaccccuucgacgaccggcgcgaggccgggggcgaguccaccguggugaaccccaagagcggguccuggaacuucuucgacugguucagcggccugauguccugguucggcgggccccucaagacgauccugcugaucugccucuacgucgcccugagcaucggccuguucuuccuccugaucuaccucgggggcaccgggcuguccaagauguggcuggccgccaccaagaaggccagcuga

SEQ ID NO: 12740 - RNA, 3594 nt, Artificial Sequence
  derived and/or modified CDS sequence (opt1) from RVFV(ZM-657)__DQ380204.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaaggccuacugcucccacgccaacgggagcggcaucguccagauccagguguccggggucuggaagaagccgcugugcgugggcuacgagcgcguggucgugaagcgggagcucagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccugaaguaccccggcaucucccagagcuccgggggcgacaucggcgugcacauggcccacgacgaccagagcgucuccagcaagaucguggcgcacugcccgccccaggaccccugccucgugcacgggugcaucgucugcgcccacggccugaucaacuaccagugccacacggcccuguccgccuucgugguggucuucguguucagcuccaucgccaucaucugccucgcgauccuguaccgcgugcugaagugccucaagaucgcgccccggaagguccugaacccccugauguggaucaccgccuucauccgcuggaucuacaagaagaugguggcccgcguggccgacaacaucaaccaggucaaccgggagaucggguggauggagggcggccagcucgugcuggggaacccggcccccaucccccgccacgcccccaucccgcgguacagcaccuaccugaugcugcuccugaucguguccuacgccagcgccugcuccgagcugauccaggcgagcucccgcaucaccacgugcagcaccgagggcgucaacaccaagugccggcucuccgggaccgcccugauccgcgccggcagcgugggggccgaggccugccugaugcucaagggcgugaaggaggaccagacgaaguuccugaagaucaagaccgucagcuccgagcugagcugccgggagggccaguccuacuggaccgggagcuucucccccaagugccucagcucccgccggugccaccuggugggcgagugccacgugaaccgcugccugagcuggcgggacaacgagaccuccgcggaguucagcuucgucggggaguccaccacgaugcgcgagaacaagugcuucgagcagugcggcggguggggcugcggcugcuucaacgugaaccccagcugccucuucgugcacaccuaccugcaguccguccggaaggaggcccugcgcguguucaacugcaucgacugggugcacaagcucacccuggagaucaccgacuucgacgggagcgucuccacgaucgaccugggcgccagcuccagccgguucaccaacuggggguccgugagccucagccuggacgccgagggcaucuccgggagcaacuccuucagcuucaucgagucccccggcaagggcuacgccaucguggacgagccguucagcgagaucccccgccagggguuccugggcgagauccggugcaacuccgagagcuccguccucagcgcgcacgaguccugccugcgcgcccccaaccugaucagcuacaagcccaugaucgaccagcucgagugcaccaccaaccugaucgacccguucgugguguucgagcgggggucccugccccagacgcgcaacgacaagaccuucgccgccagcaagggcaaccgcgggguccaggccuucuccaagggcagcgugcaggcggaccucacccugauguucgacaacuucgagguggacuucgucggcgccgccguguccugcgacgccgcguuccugaaccucaccgggugcuacagcugcaacgccggcgcccgggugugccuguccaucacgagcaccgggaccggcagccuguccgcccacaacaaggacggcagccuccacaucguccugcccuccgagaacgggaccaaggaccagugccagauccugcacuucacggugcccgaggucgaggaggaguucauguacagcugcgacggcgacgagcgcccgcuccuggugaaggggacccugaucgccaucgaccccuucgacgaccggcgcgaggcgggcggggaguccaccguggucaaccccaagagcggcuccuggaacuucuucgacugguucagcggccucauguccugguucgggggcccccugaagaccauccugcucaucugccuguacguggcccugagcaucgggcuguucuuccugcugaucuaccucggccggacggggcuguccaagauguggcuggccgccaccaagaaggccagcuga

SEQ ID NO: 12741 - RNA, 3594 nt, Artificial Sequence
  derived and/or modified CDS sequence (opt1) from RVFV(ZH-501-777)__DQ380202.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggaccccgggcagaccaagcgggagcucaagagcuucgacaucucccagugcccgaagaucggcggccacgggagcaagaagugcaccggcgacgccgccuucugcuccgccuacgagugcacggcgcaguacgccaacgccuacugcagccacgccaacggguccggcaucguccagauccaggugagcggggucuggaagaagccccugugcgugggcuacgagcgcguggucgugaagcgggagcuguccgcgaagcccauccagcgcguggagcccugcacgaccugcaucaccaagugcgagccgcacggccuggucgugcggagcaccggguucaagaucuccagcgccguggccugcgccuccggcgucugcgugaccgggagccagucccccagcaccgagaucacccugaaguaccccggcaucagccaguccagcgggggcgacaucggcgugcacauggcccacgacgaccaguccgucagcuccaagaucguggcgcacugcccgccccaggaccccugccucgugcacgggugcaucgucugcgcccacggccugaucaacuaccagugccacacggcccugagcgccuucgugguggucuucguguucuccagcaucgccaucaucugccucgcggugcuguaccgcguccugaagugccucaagaucgcgccccggaaggugcugaacccgcugauguggaucaccgccuucauccgcuggaucuacaagaagaugguggcccgcgucgccgacaacaucaaccaggugaaccgggagaucggguggauggagggcggccagcucgugcuggggaaccccgcccccaucccccgccacgccccgaucccccgguacuccaccuaccugaugcugcuccugaucgucagcuacgccuccgccugcagcgagcugauccaggcguccagccgcaucaccacgugcuccaccgagggcgugaacaccaagugccggcucagcgggaccgcccugauccgcgccggcuccgugggggccgaggccugccugaugcucaagggcgucaaggaggaccagacgaaguuccugaagaucaagaccgugagcagcgagcuguccugccgggagggccagagcuacuggaccggguccuucagccccaagugccucuccagccgccggugccaccuggugggcgagugccacgucaaccgcugccuguccuggcgggacaacgagaccagcgcggaguucuccuucgugggggagagcaccacgaugcgcgagaacaagugcuucgagcagugcggcggguggggcugcggcugcuucaacgugaaccccuccugccucuucguccacaccuaccugcagagcgugcggaaggaggcccugcgcguguucaacugcaucgacuggguccacaagcucacccuggagaucaccgacuucgacggguccgugagcacgaucgaccugggcgccuccagcucccgguucaccaacugggggagcgugucccucagccuggacgccgagggcaucagcggguccaacagcuucuccuucaucgagagcccgggcaagggcuacgccaucgucgacgagcccuucuccgagaucccccgccagggguuccugggcgagauccggugcaacagcgaguccagcgugcucuccgcgcacgagagcugccugcgcgcccccaaccugaucuccuacaagccgaugaucgaccagcucgagugcaccaccaaccugaucgaccccuucguggucuucgagcgggggagccugccccagacgcgcaacgacaagaccuucgccgccuccaagggcaaccgcggggugcaggccuucagcaagggcuccgugcaggcggaccucacccugauguucgacaacuucgaggucgacuucgugggcgccgccgugagcugcgacgccgcguuccugaaccucaccgggugcuacuccugcaacgccggcgcccgggucugccugagcaucacguccaccgggaccggcagccugagcgcccacaacaaggacggcucccuccacaucgugcugcccagcgagaacgggaccaaggaccagugccagauccugcacuucacggucccggagguggaggaggaguucauguacuccugcgacggcgacgagcgcccccuccuggugaaggggacccugaucgccaucgaccccuucgacgaccggcgcgaggcgggcggggagagcaccgucgugaaccccaaguccggcagcuggaacuucuucgacugguucuccggccucaugagcugguucgggggcccgcugaagaccauccugcucaucugccuguacguggcccuguccaucgggcuguucuuccugcugaucuaccucggccggacggggcugagcaagauguggcuggccgccaccaagaaggccuccuga

SEQ ID NO: 12742 - RNA, 3594 nt, Artificial Sequence
  derived and/or modified CDS sequence (opt1) from RVFV(OS-3)__DQ380184.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcgucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucguguucguguucagcuccgucgccaucaucugccucgcgauccuguacaaggugcugaagugccucaagaucgcgccccgcaaggugcugaacccccugauguggaucaccgccuucauccggugggucuacaagaagaugguggcccgcguggccgacaacaucaaccaggucaaccgcgagaucggguggauggagggcggccagcucgcccuggggaacccggcccccaucccccggcacgcccccaucccgcgcuacagcaccuaccugaugcugcuccugaucguguccuacgccagcgcgugcuccgagcugauccaggccagcucccggaucaccacgugcagcaccgagggcgugaacaccaagugccgccucuccgggaccgcccugauccgggccggcagcgucggggccgaggcgugccugaugcucaagggcgugaaggaggaccagacgaaguuccugaagaucaagaccgugagcuccgagcugagcugccgcgagggccaguccuacuggaccgggagcuucucccccaagugccucagcucccggcgcugccaccuggucggcgagugccacgugaaccggugccugagcuggcgcgacaacgagaccuccgccgaguucagcuucgugggggaguccaccacgaugcgggagaacaagugcuucgagcagugcggcggguggggcugcggcugcuucaacgucaaccccagcugccucuucgugcacaccuaccugcaguccgugcgcaaggaggcccugcgggucuucaacugcaucgacugggugcacaagcucacccuggagaucaccgacuucgacgggagcguguccacgaucgaccugggcgccagcuccagccgcuucaccaacuggggguccgucagccucagccuggacgccgagggcaucuccgggagcaacuccuucagcuucaucgagucccccggcaagggcuacgcgaucguggacgagccguucagcgagaucccccggcagggguuccugggcgagauccgcugcaacuccgagagcuccgugcucagcgcccacgaguccugccugcgggcccccaaccugaucagcuacaagcccaugaucgaccagcucgagugcaccaccaaccugaucgacccguucgucguguucgagcgcgggucccugccccagacgcggaacgacaagaccuucgccgccagcaagggcaaccgcggggugcaggcguucuccaagggcagcguccaggccgaccucacccugauguucgacaacuucgagguggacuucgugggcgccgccgucuccugcgacgcggccuuccugaaccucaccgggugcuacagcugcaacgccggcgcccgcgugugccuguccaucacgagcaccgggaccggcacccugagcgcccacaacaaggacggcucccuccacaucguccugcccagcgagaacgggacgaaggaccagugccagauccugcacuucaccgugcccgagguggaggaggaguucauguacuccugcgacggcgacgagcggccgcuccuggucaaggggacccugaucgcgaucgaccccuucgacgaccgccgggaggccggcggggagagcaccguggugaaccccaaguccggcagcuggaacuucuucgacugguucuccggccucaugagcugguucgggggcccccugaagacgauccugcucaucugccuguacgucgcccuguccaucgggcuguucuuccugcugaucuaccucggccgcaccgggcugagcaagauguggcuggccgccaccaagaaggcguccuga

SEQ ID NO: 12743 - RNA, 3594 nt, Artificial Sequence
  derived and/or modified CDS sequence (opt1) from RVFV(Sudan 86-2010)__JQ820489.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucguguucguguucagcuccaucgccaucaucugccucgcgauccuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggguggauggagggcggccagcucguccuggggaacccggcccccaucccccgccacgcccccaucccgcgguacagcaccuaccugaugcugcuccugaucguguccuacgccagcgccugcuccgagcugauccaggcgagcucccgcaucaccacgugcagcaccgagggcgugaacaccaagugccggcucuccgggaccgcccugauccgcgccggcagcgucggggccgaggccugccugaugcucaagggcgugaaggaggaccagacgaaguuccugaagaucaagaccgugagcuccgagcugagcugccgggagggccaguccuacuggaccgggagcuucucccccaagugccucagcucccgccggugccaccuggucggcgagugccacgugaaccgcugccugagcuggcgggacaacgagaccuccgcggaguucagcuucgugggggaguccaccacgaugcgcgagaacaagugcuucgagcagugcggcggguggggcugcggcugcuucaacgucaaccccagcugccucuucgugcacaccuaccugcaguccgugcggaaggaggcccugcgcgucuucaacugcaucgacugggugcacaagcucacccuggagaucaccgacuucgacgggagcguguccacgaucgaccugggcgccagcuccagccgguucaccaacuggggguccgucagccucagccuggacgccgagggcaucuccgggagcaacuccuucagcuucaucgagucccccggcaagggcuacgccaucguggacgagccguucagcgagaucccccgccagggguuccugggcgagauccggugcaacuccgagagcuccgugcucagcgcgcacgaguccugccugcgcgcccccaaccugaucagcuacaagcccaugaucgaccagcucgagugcaccaccaaccugaucgacccguucgucaucuucgagcgggggucccugccccagacgcgcaacgacaagaccuucgccgccagcaagggcaaccgcggggugcaggccuucuccaagggcagcgugcaggcggaccucacccugauguucgacaacuucgaggucgacuucgugggcgccgccguguccugcgacgccgcguuccugaaccucaccgggugcuacagcugcaacgccggcgcccgggucugccuguccaucacgagcaccgggaccggcacccugagcgcccacaacaaggacggcucccuccacaucgugcugcccagcgagaacgggacgaaggaccagugccagauccugcacuucaccguccccgagguggaggaggaguucauguacuccugcgacggcgacgagcgcccgcuccuggugaaggggacccugaucgccaucgaccccuucgacgaccggcgcgaggcgggcggggagagcaccgucgugaaccccaaguccggcagcuggaacuucuucgacugguucuccggccucaugagcugguucgggggcccccugaagacgauccugcucaucugccuguacguggcccuguccaucgggcuguucuuccugcugaucuaccucggccggaccgggcugagcaagauguggcuggccgccaccaagaaggccuccuga

SEQ ID NO: 12744 - RNA, 3594 nt, Artificial Sequence
  derived and/or modified CDS sequence (opt1) from RVFV(T-46 (228113))__DQ380199.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccaaggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcugugcgugggcuacgagcgcguggucgugaagcgggagcucagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccugaaguaccccggcaucucccagagcuccgggggcgacaucggcgugcacauggcccacgacgaccagagcgucuccagcaagaucguggcgcacugcccgccccaggaccccugccucgugcacgggugcaucgucugcgcccacggccugaucaacuaccagugccacacggcccuguccgccuucgugguggucuucguguucagcuccaucgccaucaucugccucgcggugcuguaccgcguccugaagugccucaagaucgcgccccggaaggugcugaacccccugauguggaucaccgccuucauccgcuggaucuacaagaagaugguggcccgcgucgccgacaacaucaaccaggugaaccgggagaucggguggauggagggcggccagcucgugcuggggaacccggcccccaucccccgccacgcccccaucccgcgguacagcaccuaccugaugcugcuccugaucgucuccuacgccagcgccugcuccgagcugauccaggcgagcucccgcaucaccacgugcagcaccgagggcgugaacaccaagugccggcucuccgggaccgcccugauccgcgccggcagcgugggggccgaggccugccugaugcucaagggcgucaaggaggaccagacgaaguuccugaagaucaagaccgugagcuccgagcugagcugccgggagggccaguccuacuggaccgggagcuucucccccaagugccucagcucccgccggugccaccuggugggcgagugccacgucaaccgcugccugagcuggcgggacaacgagaccuccgcggaguucagcuucgugggggaguccaccacgaugcgcgagaacaagugcuucgagcagugcggcggguggggcugcggcugcuucaacgugaaccccagcugccucuucguccacaccuaccugcaguccgugcggaaggaggcccugcgcguguucaacugcaucgacuggguccacaagcucacccuggagaucaccgacuucgacgggagcguguccacgaucgaccugggcgccagcuccagccgguucaccaacuggggguccgugagccucagccuggacgccgagggcaucuccgggagcaacuccuucagcuucaucgagucccccggcaagggcuacgccaucgucgacgagccguucagcgagaucccccgccagggguuccugggcgagauccggugcaacuccgagagcuccgugcucagcgcgcacgaguccugccugcgcgcccccaaccugaucagcuacaagcccaugaucgaccagcucgagugcaccaccaaccugaucgacccguucguggucuucgagcgggggucccugccccagacgcgcaacgacaagaccuucgccgccagcaagggcaaccgcggggugcaggccuucuccaagggcagcgugcaggcggaccucacccugauguucgacaacuucgaggucgacuucgugggcgccgccguguccugcgacgccgcguuccugaaccucaccgggugcuacagcugcaacgccggcgcccgggucugccuguccaucacgagcaccgggaccggcagccuguccgcccacaacaaggacggcagccuccacaucgugcugcccuccgagaacgggaccaaggaccagugccagauccugcacuucacgguccccgagguggaggaggaguucauguacagcugcgacggcgacgagcgcccgcuccuggugaaggggacccugaucgccaucgaccccuucgacgaccggcgcgaggcgggcggggaguccaccgucgugaaccccaagagcggcuccuggaacuucuucgacugguucagcggccucauguccugguucgggggcccccugaagaccauccugcucaucugccuguacguggcccugagcaucgggcuguucuuccugcugaucuaccucggccggacggggcuguccaagauguggcuggccgccaccaagaaggccagcuga

SEQ ID NO: 12745 - RNA, 3594 nt, Artificial Sequence
  derived and/or modified CDS sequence (opt1) from RVFV(2007000094)__EU574055.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucguguucguguucagcuccaucgccaucaucugccucgcgauccuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggguggauggagggcggccagcucguccuggggaacccggcccccaucccccgccacgcccccaucccgcgguacagcaccuaccugaugcugcuccugaucguguccuacgccagcgccugcuccgagcugauccaggcgagcucccgcaucaccacgugcagcaccgagggcgugaacaccaagugccggcucuccgggaccgcccugauccgcgccggcagcgucggggccgaggccugccugaugcucaagggcgugaaggaggaccagacgaaguuccugaagaucaagaccgugagcuccgagcugagcugccgggagggccaguccuacuggaccgggagcuucucccccaagugccucagcucccgccggugccaccuggucggcgagugccacgugaaccgcugccugagcuggcgggacaacgagaccuccgcggaguucagcuucgugggggaguccaccacgaugcgcgagaacaagugcuucgagcagugcggcggguggggcugcggcugcuucaacgucaaccccagcugccucuucgugcacaccuaccugcaguccgugcggaaggaggcccugcgcgucuucaacugcaucgacugggugcacaagcucacccuggagaucaccgacuucgacgggagcguguccacgaucgaccugggcgccagcuccagccgguucaccaacuggggguccgucagccucagccuggacgccgagggcaucuccgggagcaacuccuucagcuucaucgagucccccggcaagggcuacgccaucguggacgagccguucagcgagaucccccgccagggguuccugggcgagauccggugcaacuccgagagcuccgugcucagcgcgcacgaguccugccugcgcgcccccaaccugaucagcuacaagcccaugaucgaccagcucgagugcaccaccaaccugaucgacccguucgucguguucgagcgggggucccugccccagacgcgcaacgacaagaccuucgccgccagcaagggcaaccgcggggugcaggccuucuccaagggcagcguccaggcggaccucacccugauguucgacaacuucgagguggacuucgugggcgccgccgucuccugcgacgccgcguuccugaaccucaccgggugcuacagcugcaacgccggcgcccgggugugccuguccaucacgagcaccgggaccggcacccugagcgcccacaacaaggacggcucccuccacaucguccugcccagcgagaacgggacgaaggaccagugccagauccugcacuucaccgugcccgagguggaggaggaguucauguacuccugcgacggcgacgagcgcccgcuccuggucaaggggacccugaucgccaucgaccccuucgacgaccggcgcgaggcgggcggggagagcaccguggugaaccccaaguccggcagcuggaacuucuucgacugguucuccggccucaugagcugguucgggggcccccugaagacgauccugcucaucugccuguacgucgcccuguccaucgggcuguucuuccugcugaucuaccucggccggaccgggcugagcaagauguggcuggccgccaccaagaaggccuccuga

SEQ ID NO: 12746 - RNA, 3594 nt, Artificial Sequence
  derived and/or modified CDS sequence (opt1) from RVFV(ZC-3349)__DQ380207.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcugugcgugggcuacgagcgcguggucgugaagcgggagcucagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccugaaguaccccggcaucucccagagcuccgggggcgacaucggcgugcacauggcccacgacgaccaggcggucagcuccaagaucguggcccacugcccgccccaggaccccugccucgugcacgggugcaucgucugcgcccacggccugaucaacuaccagugccacacggcccugagcgccuucgugguggucuucguguucuccagcaucgcgaucaucugccucgccauccuguaccgcgugcugaagugccucaagaucgcgccccggaagguccugaacccccugauguggaucaccgccuucauccgcuggaucuacaagaagaugguggcccgcguggccgacaacaucaaccacgucaaccgggagaucggguggauggagggcggccagcucgugcuggggaacccggcccccaucccccgccacgcccccaucccgcgguacuccaccuaccugaugcugcuccugaucgugagcuacgccuccgcgugcagcgagcugauccaggccuccagccgcaucaccacgugcuccaccgagggcgucaacaccaagugccggcucagcgggaccgcccugauccgcgccggcuccgugggggccgaggcgugccugaugcucaagggcgugaaggaggaccagacgaaguuccugaagaucaagaccgucagcagcgagcuguccugccgggagggccagagcuacuggaccggguccuucagccccaagugccucuccagccgccggugccaccuggugggcgagugccacgugaaccgcugccuguccuggcgggacaacgagaccagcgccgaguucuccuucgucggggagagcaccacgaugcgcgagaacaagugcuucgagcagugcggcggguggggcugcggcugcuucaacgugaaccccuccugccucuucgugcacaccuaccugcagagcguccggaaggaggcccugcgcguguucaacugcaucgacugggugcacaagcucacccuggagaucaccgacuucgacggguccgucagcacgaucgaccugggcgccuccagcucccgguucaccaacugggggagcgugucccucagccuggacgccgagggcaucagcggguccaacagcuucuccuucaucgagagccccggcaagggcuacgcgaucguggacgagccguucuccgagaucccccgccagggguuccugggcgagauccggugcaacagcgaguccagcguccucuccgcccacgagagcugccugaaggcccccaaccugaucuccuacaagcccaugaucgaccagcucgagugcaccaccaaccugaucgacccguucgugguguucgagcgcgggagccugccccagacgcggaacgacaagaccuucgccgccuccaagggcaaccgcgggguccaggcguucagcaagggcuccgugcaggccgaccucacccugauguucgacaacuucgagguggacuucgucggcgccgccgugagcugcgacgcggccuuccugaaccucaccgggugcuacuccugcaacgccggcgcccgcgugugccugagcaucacguccaccgggaccggcagccugagcgcccacaacaaggacggcucccuccacaucguccugcccagcgagaacgggaccaaggaccagugccagauccugcacuucacggugcccgaggucgaggaggaguucauguacuccugcgacggcgacgagcggccgcuccuggugaaggggacccugaucgcgaucgaccccuucgacgaccgccgggaggccggcggggagagcaccguggucaaccccaaguccggcagcuggaacuucuucgacugguucuccggccucaugagcugguucgggggcccccugaagaccauccugcucaucugccuguacguggcccuguccaucgggcuguucuuccugcugaucuaccucggccgcacggggcugagcaagauguggcuggccgccaccaagaaggcguccuga

SEQ ID NO: 12747 - RNA, 3594 nt, Artificial Sequence
  derived and/or modified CDS sequence (opt1) from RVFV(2007001602)__EU574043.1__GP
auguacgugcugcucaccauccugaucagcguccuggugugcgaggccgugauccgcgucuccaucagcuccacccgggaggagacgugcuucggcgacagcaccaaccccgagaugaucgagggggccugggacucccuccgcgaggaggagaugccggaggagcugagcugcuccgugagcggcauccgggaggugaagaccuccagccaggagcuguaccgcgcgcucaaggccaucaucgccgccgacgggcugaacaacaucacgugccacggcaagaaccccgaggacaagaucucccugaucaaggggccgccccacaagaagcgggucggcaucgugcgcugcgagcggcgccgggacgccaagcagaucggccgcgagaccauggcggggaucgccaugaccgugcuccccgcccuggccgucuucgcgcuggcccccgugguguucgccgaggacccccaccuccggaaccgccccggcaaggggcacaacuacaucgacggcaugacccaggaggacgcgaccugcaagccggucacguacgccggggccugcagcuccuucgacgugcugcuggagaagggcaaguucccccucuuccagagcuacgcccaccaccggacccugcuggaggccgugcacgacaccaucaucgccaaggccgacccgcccuccugcgaccuccagagcgcgcacggcaaccccugcaugaaggagaagcuggucaugaagacccacugccccaacgacuaccaguccgcccacuaccugaacaacgacgggaagauggccagcgugaagugcccgcccaaguacgagcucacggaggacugcaacuucugccgccagaugaccggcgccucccugaagaaggggagcuacccccugcaggaccucuucugccagagcuccgaggacgacggcagcaagcugaagaccaagaugaagggcgugugcgaggucggggugcaggcccugaagaagugcgacggccagcucuccaccgcgcacgaggugguccccuucgccguguucaagaacagcaagaagguguaccuggacaagcuggaccucaagacggaggagaaccugcugcccgacuccuucgucugcuucgagcacaaggggcaguacaagggcaccauggacagcgggcagaccaagcgggagcucaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcugagcgcgaagcccauccagcgcgucgagcccugcacgaccugcaucaccaagugcgagccccacggccucguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccugguccacgggugcaucgugugcgcccacggccucaucaacuaccagugccacacggcccuguccgccuucguggucaucuucguguucagcuccaccgccaucaucugccuggcggugcucuaccgcguccugaagugccugaagaucgcgccccggaaggugcucaacccccugauguggaucaccgccuucauccgcuggguguacaagaagauggucgcccgcguggccgacaacaucaaccaggugaaccgggagaucggguggauggagggcggccagcuggcccucgggaacccggcccccaucccccgccacgcccccaucccgcgguacagcaccuaccugaugcugcugcucaucgucuccuacgccagcgcgugcuccgagcugauccaggccagcucccgcaucacgaccugcagcaccgagggcgugaacaccaagugccggcuguccgggacggcccucauccgcgccggcagcgugggggccgaggcgugccugaugcugaagggcgucaaggaggaccagaccaaguuccucaagaucaagaccgugagcuccgagcugagcugccgggagggccaguccuacuggaccgggagcuucucccccaagugccugagcucccgccggugccaccucgugggcgagugccacgucaaccgcugccugagcuggcgggacaacgagaccuccgccgaguucagcuucgugggggaguccacgaccaugcgcgagaacaagugcuucgagcagugcggcggguggggcugcggcugcuucaacgugaaccccagcugccuguucguccacaccuaccuccaguccgugcggaaggaggcccugcgcguguucaacugcaucgacuggguccacaagcugacccucgagaucacggacuucgacgggagcguguccaccaucgaccugggcgccagcuccagccgguucaccaacuggggguccgugagccugagccucgacgccgagggcaucuccgggagcaacuccuucagcuucaucgagucccccggcaagggcuacgcgaucgucgacgagccguucagcgagaucccccgccagggguuccugggcgagauccggugcaacuccgagagcuccgugcugagcgcccacgaguccugccuccgcgcccccaaccuggugagcuacaagcccaugaucgaccagcuggagugcaccacgaaccucaucgacccguucgucguguucgagcgggggucccugccccagacccgcaacgacaagaccuucgccgccagcaagggcaaccgcggggugcaggcguucuccaagggcagcguccaggccgaccugacccucauguucgacaacuucgagguggacuucgugggcgccgccgucuccugcgacgcggccuuccugaaccugacggggugcuacagcugcaacgccggcgcccgggugugccucuccaucaccagcaccgggaccggcacgcugagcgcccacaacaaggacggcucccugcacaucguccuccccagcgagaacgggaccaaggaccagugccagauccugcacuucaccgugcccgagguggaggaggaguucauguacuccugcgacggcgacgagcgcccgcugcucgucaaggggacccugaucgcgaucgaccccuucgacgaccggcgcgaggccggcggggagagcacgguggugaaccccaaguccggcagcuggaacuucuucgacugguucuccggccugaugagcugguucgggggcccccucaagaccauccugcugaucugccucuacgucgcccuguccaucgggcuguucuuccuccugaucuaccugggccggaccgggcucagcaagauguggcuggccgccaccaagaaggcguccuga

SEQ ID NO: 12748 - RNA, 3594 nt, Artificial Sequence
  derived and/or modified CDS sequence (opt1) from RVFV(1260/78)__DQ380214.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccaucagcggcauccgggaggugaagaccuccagccaggagcucuaccgcgcgcugaaggccaucaucgccgccgacgggcugaacaacaucacgugccacggcaaggaccccgaggacaagaucucccucaucaaggggccgccccacaagaagcgggugggcaucguccgcugcgagcggcgccgggacgccaagcagaucggccgcgagaccauggcggggaucgccaugaccgugcugcccgcccuggccguguucgcgcucgcccccgucguguucgccgaggacccccaccuccggaaccgccccggcaaggggcacaacuacaucgacggcaugacccaggaggacgcgaccugcaagccggugacguacgccggggccugcagcuccuucgacguccugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggugaugaagacccacugccccaacgacuaccaguccgcccacuaccucaacaacgacgggaagauggccagcgucaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgagguggggguccaggcccucaagaagugcgacggccagcuguccaccgcgcacgagguggugcccuucgccgucuucaagaacagcaagaagguguaccuggacaagcucgaccugaagacggaggagaaccugcuccccgacuccuucgugugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucguccagauccagguguccggggucuggaagaagccgcugugcgugggcuacgagcgcguggucgugaagcgggagcucagcgcgaagcccauccagcgcguggagcccugcacgaccugcaucaccaagugcgagccccacggccuggucgugcgguccaccggguucaagaucagcuccgccguggccugcgccagcggcgucugcgugaccgggucccagagcccgagcaccgagaucacccugaaguaccccggcaucucccagagcuccgggggcgacaucggcgugcacauggcccacgacgaccagagcgucuccagcaagaucguggcgcacugcccgccccaggaccccugccucgugcacgggugcaucgucugcgcccacggccugaucaacuaccagugccacacggcccuguccgccuucgugguggucuucguguucagcuccaucgccaucaucugccucgcgauccugcaccgcgugcugaagugccucaagaucgcgccccggaagguccugaacccccugauguggaucaccgccuucauccgcuggguguacaagaagaugguggcccgcgucgccgacaacaucaaccaggugaaccgggagaucggguggauggagggcggccagcucgugcuggggaacccggcccccaucccccgccacgcccccaucccgcgguacagcaccuaccugaugcugcuccugaucgucuccuacgccagcgccugcuccgagcugauccaggcgagcucccgcaucaccacgugcagcaccgagggcgugaacaccaagugccggcucuccgggaccgcccugauccgcgccggcagcgugggggccgaggccugccugaugcucaagggcgucaaggacgaccagacgaaguuccugaagaucaagaccgugagcuccgagcugagcugccgggagggccaguccuacuggaccgggagcuucucccccaagugccucagcucccgccggugccaccuggugggcgagugccacgucaaccgcugccugagcuggcgggacaacgagaccuccgcggaguucagcuucgugggggaguccaccacgaugcgcgagaacaagugcuucgagcagugcggcggguggggcugcggcugcuucaacgugaaccccagcugccucuucguccacaccuaccugcaguccgugcggaaggaggcccugcgcguguucaacugcaucgacuggguccacaagcucacccuggagaucaccgacuucgacgggagcguguccacgaucgaccugggcgccagcuccagccgguucaccaacuggggguccgugagccucagccuggacgccgagggcaucuccgggagcaacuccuucagcuucaucgagucccccggcaagggcuacgccaucgucgacgagccguucagcgagaucccccgccagggguuccugggcgagauccggugcaacuccgagagcuccgugcucagcgcgcacgaguccugccugcgcgcccccaaccugaucagcuacaagcccaugaucgaccagcucgagugcaccaccaaccugaucgacccguucguggucuucgagcgggggucccugccccagacgcgcaacgacaagaccuucgccgccagcaagggcaaccgcggggugcaggccuucuccaagggcagcgugcaggcggaccucacccugauguucgacaacuucgaggucgacuucgugggcgccgccguguccugcgacgccgcguuccugaaccucaccgggugcuacagcugcaacgccggcgcccgggucugccuguccaucacgagcaccgggaccggcacccugagcgcccacaacaaggacggcucccuccacaucgugcugcccagcgagaacgggacgaaggaccagugccagauccugcacuucaccguccccgagguggaggaggaguucauguacuccugcgacggcgacgagcgcccgcuccuggugaaggggacccugaucgccaucgaccccuucgacgaccggcgcgaggcgggcggggagagcaccgucgugaaccccaaguccggcagcuggaacuucuucgacugguucuccggccucaugagcugguucgggggcccccugaagacgauccugcucaucugccuguacguggcccuguccaucgggcuguucuuccugcugaucuaccucggccggaccgggcugagcaagauguggcuggccgccaccaagaaggccuccuga

SEQ ID NO: 12749 - RNA, 3594 nt, Artificial Sequence
  derived and/or modified CDS sequence (opt1) from RVFV(2007000324)__JF326195.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucaacaacgacgggaagauggccagcgugaagugcccgcccaaguacgagcugacggaggacugcaacuucugccgccagaugaccggcgccucccugaagaaggggagcuacccccuccaggaccuguucugccagagcuccgaggacgacggcagcaagcugaagaccaagaugaagggcgugugcgaggucggggugcaggcccucaagaagugcgacggccagcuguccaccgcgcacgaggugguccccuucgccguguucaagaacagcaagaagguguaccuggacaagcucgaccugaagacggaggagaaccugcuccccgacuccuucgucugcuucgagcacaaggggcaguacaagggcaccauggacagcgggcagaccaagcgggagcugaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcucagcgcgaagcccauccagcgcgucgagcccugcacgaccugcaucaccaagugcgagccccacggccugguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccucguccacgggugcaucgugugcgcccacggccugaucaacuaccagugccacacggcccuguccgccuucguggucaucuucguguucagcuccaccgccaucaucugccucgcggugcuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggguggauggagggcggccagcucgcccuggggaacccggcccccaucccccgccacgcccccaucccgcgguacagcaccuaccugaugcugcuccugaucgucuccuacgccagcgcgugcuccgagcugauccaggccagcucccgcaucacgaccugcagcaccgagggcgugaacaccaagugccggcucuccgggacggcccugauccgcgccggcagcgugggggccgaggcgugccugaugcucaagggcgucaaggaggaccagaccaaguuccugaagaucaagaccgugagcuccgagcugagcugccgggagggccaguccuacuggaccgggagcuucucccccaagugccucagcucccgccggugccaccuggugggcgagugccacgucaaccgcugccugagcuggcgggacaacgagaccuccgccgaguucagcuucgugggggaguccacgaccaugcgcgagaacaagugcuucgagcagugcggcggguggggcugcggcugcuucaacgugaaccccagcugccucuucguccacaccuaccugcaguccgugcggaaggaggcccugcgcguguucaacugcaucgacuggguccacaagcucacccuggagaucacggacuucgacgggagcguguccaccaucgaccugggcgccagcuccagccgguucaccaacuggggguccgugagccucagccuggacgccgagggcaucuccgggagcaacuccuucagcuucaucgagucccccggcaagggcuacgcgaucgucgacgagccguucagcgagaucccccgccagggguuccugggcgagauccggugcaacuccgagagcuccgugcucagcgcccacgaguccugccugcgcgcccccaaccuggugagcuacaagcccaugaucgaccagcucgagugcaccacgaaccugaucgacccguucgucguguucgagcgggggucccugccccagacccgcaacgacaagaccuucgccgccagcaagggcaaccgcggggugcaggcguucuccaagggcagcguccaggccgaccucacccugauguucgacaacuucgagguggacuucgugggcgccgccgucuccugcgacgcggccuuccugaaccucacggggugcuacagcugcaacgccggcgcccgggugugccuguccaucaccagcaccgggaccggcacgcugagcgcccacaacaaggacggcucccuccacaucguccugcccagcgagaacgggaccaaggaccagugccagauccugcacuucaccgugcccgagguggaggaggaguucauguacuccugcgacggcgacgagcgcccgcuccuggucaaggggacccugaucgcgaucgaccccuucgacgaccggcgcgaggccggcggggagagcacgguggugaaccccaaguccggcagcuggaacuucuucgacugguucuccggccucaugagcugguucgggggcccccugaagaccauccugcucaucugccuguacgucgcccuguccaucgggcuguucuuccugcugaucuaccucggccggaccgggcugagcaagauguggcuggccgccaccaagaaggcguccuga

SEQ ID NO: 12750 - RNA, 3594 nt, Artificial Sequence
  derived and/or modified CDS sequence (opt1) from RVFV(KEN/Gar-Msq/131B-04/06)__HM586972.1__GP
auguacgugcugcucaccauccugaucagcguccuggugugcgaggccgugauccgcgucucccucagcuccacccgggaggagacgugcuucggcgacagcaccaaccccgagaugaucgagggggccugggacuccuuccgcgaggaggagaugccggaggagcugagcugcuccgugagcggcauccgggaggugaagaccuccagccaggagcuguaccgcgcgcucaaggccaucaucgccgccgacgggcugaacaacaucacgugccacggcaagaaccccgaggacaagaucucccugaucaaggggccgccccacaagaagcgggucggcaucgugcgcugcgagcggcgccgggacgccaagcagaucggccgcgagaccauggcggggaucgccaugaccgugcuccccgcccuggccgucuucgcgcuggcccccgugguguucgccgaggacccccaccuccggaaccgccccggcaaggggcacaacuacaucgacggcaugacccaggaggacgcgaccugcaagccggucacguacgccggggccugcagcuccuucgacgugcugcuggagaagggcaaguucccccucuuccagagcuacgcccaccaccggacccugcuggaggccgugcacgacaccaucaucgccaaggccgacccgcccuccugcgaccuccagagcgcgcacggcaaccccugcaugaaggagaagcuggucaugaagacccacugccccaacgacuaccaguccgcccacuaccugaacaacgacgggaagauggccagcgugaagugcccgcccaaguacgagcucacggaggacugcaacuucugccgccagaugaccggcgccucccugaagaaggggagcuacccccugcaggaccucuucugccagagcuccgaggacgacggcagcaagcugaagaccaagaugaagggcgugugcgaggucggggugcaggcccugaagaagugcgacggccagcucuccaccgcgcacgaggugguccccuucgccguguucaagaacagcaagaagguguaccuggacaagcuggaccucaagacggaggagaaccugcugcccgacuccuucgucugcuucgagcacaaggggcaguacaagggcaccauggacagcgggcagaccaagcgggagcucaaguccuucgacaucagccagugccccaagaucggcggccacggguccaagaagugcaccggcgacgccgccuucugcagcgccuacgagugcacggcgcaguacgccaacgccuacugcucccacgccaacgggagcggcaucgugcagauccaggucuccgggguguggaagaagccgcugugcgugggcuacgagcgcgucguggugaagcgggagcugagcgcgaagcccauccagcgcgucgagcccugcacgaccugcaucaccaagugcgagccccacggccucguggugcgguccaccggguucaagaucagcuccgccgucgccugcgccagcggcgugugcgugaccgggucccagagcccgagcaccgagaucacccugaaguaccccggcaucucccagagcuccgggggcgacaucggcguccacauggcccacgacgaccagagcguguccagcaagaucguggcgcacugcccgccccaggaccccugccugguccacgggugcaucgugugcgcccacggccucaucaacuaccagugccacacggcccuguccgccuucguggucaucuucguguucagcuccaccgccaucaucugccuggcggugcucuaccgcguccugaagugccugaagaucgcgccccggaaggugcucaacccccugauguggaucaccgccuucauccgcuggguguacaagaagauggucgcccgcguggccgacaacaucaaccaggugaaccgggagaucggguggauggagggcggccagcuggcccucgggaacccggcccccaucccccgccacgcccccaucccgcgguacagcaccuaccugaugcugcugcucaucgucuccuacgccagcgcgugcuccgagcugauccaggccagcucccgcaucacgaccugcagcaccgagggcgugaacaccaagugccggcuguccgggacggcccucauccgcgccggcagcgugggggccgaggcgugccugaugcugaagggcgucaaggaggaccagaccaaguuccucaagaucaagaccgugagcuccgagcugagcugccgggagggccaguccuacuggaccgggagcuucucccccaagugccugagcucccgccggugccaccucgugggcgagugccacgucaaccgcugccugagcuggcgggacaacgagaccuccgccgaguucagcuucgugggggaguccacgaccaugcgcgagaacaagugcuucgagcagugcggcggguggggcugcggcugcuucaacgugaaccccagcugccuguucguccacaccuaccuccaguccgugcggaaggaggcccugcgcguguucaacugcaucgacuggguccacaagcugacccucgagaucacggacuucgacgggagcguguccaccaucgaccugggcgccagcuccagccgguucaccaacuggggguccgugagccugagccucgacgccgagggcaucuccgggagcaacuccuucagcuucaucgagucccccggcaagggcuacgcgaucgucgacgagccguucagcgagaucccccgccagggguuccugggcgagauccggugcaacuccgagagcuccgugcugagcgcccacgaguccugccuccgcgcccccaaccuggugagcuacaagcccaugaucgaccagcuggagugcaccacgaaccucaucgacccguucgucguguucgagcgggggucccugccccagacccgcaacgacaagaccuucgccgccagcaagggcaaccgcggggugcaggcguucuccaagggcagcguccaggccgaccugacccucauguucgacaacuucgagguggacuucgugggcgccgccgucuccugcgacgcggccuuccugaaccugacggggugcuacagcugcaacgccggcgcccgggugugccucuccaucaccagcaccgggaccggcacgcugagcgcccacaacaaggacggcucccugcacaucguccuccccagcgagaacgggaccaaggaccagugccagauccugcacuucaccgugcccgagguggaggaggaguucauguacuccugcgacggcgacgagcgcccgcugcucgucaaggggacccugaucgcgaucgaccccuucgacgaccggcgcgaggccggcggggagagcacgguggugaaccccaaguccggcagcuggaacuucuucgacugguucuccggccugaugagcugguucgggggcccccucaagaccauccugcugaucugccucuacgucgcccuguccaucgggcuguucuuccuccugaucuaccugggccggaccgggcucagcaagauguggcuggccgccaccaagaaggcguccuga

SEQ ID NO: 12751 - RNA, 3594 nt, Artificial Sequence
  derived and/or modified CDS sequence (opt1) from RVFV(2007004194)__EU574031.1__GP
auguacgugcugcucaccauccugaucagcguccuggugugcgaggccgugauccgcgucucccucagcuccacccgggaggagacgugcuucggcgacagcaccaaccccgagaugaucgagggggccugggacucccugcgcgaggaggagaugccggaggagcugagcugcuccgugagcggcauccgggaggugaagaccuccagccaggagcucuaccgcgcgcugaaggccaucaucgccgccgacgggcugaacaacaucacgugccacggcaagaaccccgaggacaagaucucccucaucaaggggccgccccacaagaagcgggucggcaucgugcgcugcgagcggcgccgggacgccaagcagaucggccgcgagaccauggcggggaucgccaugaccgugcugcccgcccuggccgucuucgcgcucgcccccgugguguucgccgaggacccccaccuccggaaccgccccggcaaggggcacaacuacaucgacggcaugacccaggaggacgcgaccugcaagccggucacguacgccggggccugcagcuccuucgacgugcugcucgagaagggcaaguucccccuguuccagagcuacgcccaccaccggacccugcucgaggccgugcacgacaccaucaucgccaaggccgacccgcccuccugcgaccugcagagcgcgcacggcaaccccugcaugaaggagaagcuggucaugaagacccacugccccaacgacuaccaguccgcccacuaccucagcaacgacgggaagauggccuccgugaagugcccgcccaaguacgagcugacggaggacugcaacuucugccgccagaugaccggcgccagccugaagaaggggagcuacccccuccaggaccuguucugccaguccagcgaggacgacggcuccaagcugaagaccaagaugaagggcgugugcgaggucggggugcaggcccucaagaagugcgacggccagcugagcaccgcgcacgaggugguccccuucgccguguucaagaacuccaagaagguguaccuggacaagcucgaccugaagacggaggagaaccugcuccccgacagcuucgucugcuucgagcacaaggggcaguacaagggcaccauggacuccgggcagaccaagcgggagcucaagagcuucgacaucucccagugccccaagaucggcggccacgggagcaagaagugcaccggcgacgccgccuucugcuccgccuacgagugcacggcgcaguacgccaacgccuacugcagccacgccaacggguccggcaucgugcagauccaggucagcgggguguggaagaagccgcugugcgugggcuacgagcgcgucguggugaagcgggagcuguccgcgaagcccauccagcgcgucgagcccugcacgaccugcaucaccaagugcgagccccacggccugguggugcggagcaccggguucaagaucuccagcgccgucgccugcgccuccggcgugugcgugaccgggagccagagcccguccaccgagaucacccugaaguaccccggcaucagccaguccagcgggggcgacaucggcguccacauggcccacgacgaccaguccgugagcuccaagaucguggcgcacugcccgccccaggaccccugccucguccacgggugcaucgugugcgcccacggccugaucaacuaccagugccacacggcccugagcgccuucguggucguguucguguucuccagcaucgccaucaucugccucgcgauccuguaccgcguccugaagugccucaagaucgcgccccggaaggugcugaacccccugauguggaucaccgccuucauccgcuggguguacaagaagauggucgcccgcguggccgacaacaucaaccaggugaaccgggagaucggguggauggagggcggccagcucguccuggggaacccggcccccaucccccgccacgcccccaucccgcgguacuccaccuaccugaugcugcuccugaucgugagcuacgccuccgccugcagcgagcugauccaggcguccagccgcaucaccacgugcuccaccgagggcgugaacaccaagugccggcucagcgggaccgcccugauccgcgccggcagcgucggggccgaggccugccugaugcucaagggcgugaaggaggaccagacgaaguuccugaagaucaagaccguguccagcgagcuguccugccgggagggccagagcuacuggaccggguccuucagccccaagugccucuccagccgccggugccaccuggucggcgagugccacgugaaccgcugccuguccuggcgggacaacgagaccagcgcggaguucuccuucgugggggagagcaccacgaugcgcgagaacaagugcuucgagcagugcggcggguggggcugcggcugcuucaacgucaaccccuccugccucuucgugcacaccuaccugcagagcgugcggaaggaggcccugcgcgucuucaacugcaucgacugggugcacaagcucacccuggagaucaccgacuucgacggguccgugagcacgaucgaccugggcgccuccagcucccgguucaccaacugggggagcgucagccucucccuggacgccgagggcaucagcggguccaacagcuucuccuucaucgagagccccggcaagggcuacgccaucguggacgagccguucuccgagaucccccgccagggguuccugggcgagauccggugcaacagcgaguccagcgugcucuccgcgcacgagagcugccugcgcgcccccaaccugaucuccuacaagcccaugaucgaccagcucgagugcaccaccaaccugaucgacccguucgucguguucgagcgggggagccugccccagacgcgcaacgacaagaccuucgccgccuccaagggcaaccgcggggugcaggccuucagcaagggcuccguccaggcggaccucacccugauguucgacaacuucgagguggacuucgugggcgccgccgucagcugcgacgccgcguuccugaaccucaccgggugcuacuccugcaacgccggcgcccgggugugccugagcaucacgagcaccgggaccggcacccuguccgcccacaacaaggacggcagccuccacaucguccugcccuccgagaacgggacgaaggaccagugccagauccugcacuucaccgugcccgagguggaggaggaguucauguacagcugcgacggcgacgagcgcccgcuccuggucaaggggacccugaucgccaucgaccccuucgacgaccggcgcgaggcgggcggggaguccaccguggugaaccccaagagcggcuccuggaacuucuucgacugguucagcggccucauguccugguucgggggcccccugaagacgauccugcucaucugccuguacgucgcccugagcaucgggcuguucuuccugcugaucuaccucggccggaccgggcuguccaagauguggcuggccgccaccaagaaggccagcuga
